United States Patent 7,368,527 (HADDE71 POLYPEPTIDES) - sequence listing, part 4

SEQ ID NO: 7329 - DNA, 58181 bp, Homo sapiens
agtttgctggaacattatcagatggcttagggaagacgatggacaatcggcatcagtcagagcgggagtacatcaggtaccatgcagccacaagtggtgaacaccttgtagccggcatccatggcctggctcatggtaagtcatgggtgacatcaggctctgctgctgctggtcctcagaggcgcctttgtatcaatctgattgcagctataaaaaaagaaaggtgggctgggcgcggtggctcatgcttgtaatcccagcattttgggaggcctaggagagtggatcatgaggtcaggagtttgagaccagcctggccaacacagtgaaaccccgcctctactaagaatacaaaaattaggccaggcacagtggctcaatcctgtaatcccagcattttgggaggtcgaggcgggtggatcatttgaggtcaggagtttgagaccagtctggccaacatggtggaaccccatctctatcaaaaatacgaaaattagacaggcgtggtggtacatgcctgtagtcccagctactcgggaggctgaggcaggagaattgctcgaaccctggaggcagaggttgcaatgagctgagatcgtgccactgcactccagcctggcaacagagcaagactccaattcaaaaaaaaaaaaaaaaaaaaaaagaaaaggctgacaacagaggaaatcctgtgttggcgtacctgatagccttccaagctctcttactttatcctccttgcagttgaaatacgacagccggtgagaactcctcattcgctttctgaatgttgtgcacattgcaattccttttcgttctctggcttctgttcccaaagtatcataaggtgtaatcaaccagacctgttcttagaattgtagctgctacttctcttagaattgtaacctctgccttctccttactgatcattccttccaaagaaattgaaatgaggaatttgtggccaggtttgtagcccaggtgttttttagttttacataaatgtgcattcactaaaattataaatttatttgcctaagagatgttggtgatggcatgaatgcatttggtctctgactttgaattcttttaatgctttaattctgagtcatttgccttttgttgcatttttcttaacaatttcttagtacggcatccaaggcccttggaactataaatccagccaattttccaaccaccatccttcagccatgctgcactttggccacacacagctatgtactgcttcccaggtgtgcttccaagtccttgctcacacatggtccttctgctctccctcctctgcctcatttccttgtctatcaaaatcctactcagcctgtaagtcccaactcaatacattttcccagctctattgtccctgttagagttaatgacagagcacagtctgggttgtgtatgtcaccagctgtgtacatctgatagattgagaatgtgaggaggggagaaggaccactttgcattcacctttctccttgtgtacctcacatgacacctggcacatagctcatgcatagtaaggcttagtaaattaaactctttgtaccagatccttaggaaccatccaaagctatcagagtcatatcaagactgatcagtattaattatctgcatttggaagaagaggaaggaatatagacagtaaaatattatatttctatttgtgcttaggacacgtttagaatagagtttttgtttatcagctttcctaatggtgagatttggatcaaaatgcctttgcttttcctaaggctgcccaaccgtaaagggagctgtccctaaggagacgtcaggccagaagtgaaatttggctgaaagtaatttgtttatggattttaaaagttgactgttgggcaatcatttggggttaaggtttaatcattctttctcgtaatggtaatgacagtacattggactcttagaagacttttaaaatgaatataaaatgctttgttatgtgtggtggcctttatctggccagcatccttgtgacgtggagagagcatggctctcctcactttctggatgaacacacaaatgtgctgagaaaatgcatgattggttcaaagttgcaaaatcacctcccatcaagaatcattcctataatatgtacagcctctccaggagccaatggcttcatccaaagaggatccactgagctctgggttatacgaaggcagtatcctagagtgagagtcttcccttaggatgaaaagacctttagaaggtgataagaaccagaatccactcaatccccttgatgtaagaaatgggaattgtgctcagttctctctgcaggccttgctggacccaggttcagtcatgttctgtctctcaggtcccagtctgaattcctgttctgtgtgtgctctgccaaaaactttgttcaaaagtttgggaaagggctgggtgcagtggctcaggacagtaagcccagcactttggaagacctagagggagaatcgcttgagcccaggagtttaaggctgcagcaagcggtaatcatgccactgcactcctgcctgggtgatagacggacaccctgtttctaaaaaaaaaaaaagtttgggaaagagatattgcctcactggagcaaatttacccagaatccaaaagaaatgttgtgaattgttagtacattctcacccaaggagtttcctttaccaatttgtctcactagagctgaagagtctagagagcttcctcacaccccactgtcagagggtaaacatcctgtgagtgtccctggcacaggtcctggagatgctccctagacgggctgcctcttcccttcagtgactgtgacctcttcagcctctgccagcttctggcctcttctaaggtgttttcagccattgctgtcaacttgcaaaatgtttggaatgcctttttgacctggattggtcttttgaactgactccattgagggtcccagccagctttcacagctttttggggtgctcttcatgaaggttttatataatcgccgataccgaatttcatcaaagcatgcagtagcttttaccttatttcaagcatccagtggggttggccagtcacccccatagtgttctttgaaaattgcaaatgtataccatcagctctccatatccacagattcagccaaccatggatggaaaatatttggggggaaaaaagatttcacgaagtgccagaaagcaaaatttgaatttgccacacgtttcaaatactgtattgactccacacaaatgaagtgatatgtgggcatcgtattagctacaataaataatctagaggtgatttaacgtatacaggacggtgtgtgtaggttatatgcaaacacctacagcacattatgtaagggacttgagcatcctaggattttggtatctgcaggggatcctggatcaatcccacatggatactaaggaacaactacatttagttatctctctctgccttagatatctttcttttcttttctttttttttttttttttgagacagtctcgctcggtcgccagactggagtgcaatgctgcgatctcggctcactgcaacctctgcctcctgggttcaagcaattctcctgccttagcctcccgagtagctgggactacaggcacgcatcaccacgcccagctaatttttgtatttttagtaaagatggggtttcaccatgttggccaggatggtctcgatctcttgacctcgtgatctgcccgccgcagcctcccaaagtgctgggattatgggcgtgagccactgcgcccagcctctgccttatatttcataggatgccatcatcttcaaactttccccgaaggcccaattttctagtctcctgttgatttaatcctctatctgtatcctctcctgatcgtccgtaggctgcccaagctctgggatcgaaaaattggccactgttaacctctcagcttttctctgatttttttttttttttttttttgaactggagcacactttacttctgactaacatgtaacatatatcctctgactctggacttaatgggcaaatctgcaggatcctcttctgtgagttggcctgtctgtggcctctctggcacagagattaatagaatggccttaagttatcattccataatcaaggggtttggctttaaatgcttttgcttttgtcctcgtcaggttacaacagcccttgtctttttcactaggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggtcagtggtgtgggaagaatggcttttgcagtttccagcctaggtctgctgcttctcctaatccatactgatgtgtttaattgtgcactttcttagttatagggtttttaattcaaatacttgtaactgaaatttctgatctgcctaatataaaaagatgaaaatgaggtacagaaacctggcatgaattttttcagataaatatatatatagcatattttatatatgctatatattttatatatgtatgtatatatagcatattatatataagtatgtataactatattatgttatttttctccattagagaggtcagaattaggattaaactgttagaagcttcttctgttcaccaagccaactggatccccacatgcctatgaagaaaactgtcagattgtagtctggttcttactcctacaccccgtgatatagttctagaatccccactgttgttgttcaccatgtgggtctgttccttcttaattttccttccgcttgaaagtatcagccccaaccccataaagaaaagtgccaccccccatccccccagcaggtcagcagttctgctgtgggattgctgtctggccttgataccagctgagactggaaatcagggacagcccatatggttccaaaccccacagaacccaactgctttaacgtagctgtttgcttgaatggcctattttagcctcccttttccagagtgactaattggggattcttatcaacaaagggtataatgaatgttaagggcccagccaagctagactcgacttaagcccagaaggattttgctgctgcttggataatagattttccctgagtgaattagtacgcccttttagaatgcctagggcctggcccacatccacaccctatcactccctcaaataggatgtgaagtgaaattgtccccaattgaagtgaatccatttgtctgtcaccaggaaaacttactgaagacacattactgcagtaggggaaatgctccgattgtggactggggccatgcagtgtgctgtgccagaatgccttccatctggaagcagctgagtaaactctgtatggtttactttagttaagttacattctattctcagatacaaaactaaaacaatccttgagtatattttgaagcatttatgaagttgtggggaggggcaggcagtgaggaggcttcgaaagtatttccagttagtttttccatctctgctcgaagcccaagaagtccacctccagtatttgttaagataataagacttaatgaagtgtaaagctgaagacgcctaagagttcccaaagaagcatgtgtattcttaaaatgtcaaaatagccaagggattggttgattaaaaagggttcaaggtatatgtgataaattttttaaagatgattttgtgctgtgaagttttaataatgttgacgagaaagaaacggcttgaattttatacattgtcagcttgcaagtcttcatgggggtttttcattctttttaggagcacaagtaatgtagccacagtcactgcagaaagaatgtctttgagagggacattcttgtcatttttattagttgttcaacattgccacagaagtttgattttctgtcagccagtacatagctgccatttattcattgcctgtcagtaaatagtgattgaaaatttcctatgaactcagggttgggaatagcagaaaccaaaactgtctctggtctcaaagagcttataatcaagcagggcagcaaacataaaaaattatataaacacttatttgctgaaattgtgacaaatgacatcgaggacacttagagggtgccgtgagactatgatcagagaaggtgatggggagaaggagggtggctaacctagtgatcaggggagttgagacaggcttttctaggaaagtaatctttgaggtgaagcctggagtatgaagtaggagttggccaggtgaagagaagagagaatcaccttccaggtaaaagggaactactgtgtgtgcaacagcaaaaggaaggaacttatctatgtgccaggcattgtctttgtgcctccacgtgtggaatcccatttaatcttcatagttgatttacaaatgaggacaagacagtccagagaagtcatggagcttgtccacagccacacagctggtgggaaatggtagacctagacttagacccagcctatgtcttgaccctgtgcccagcaccactgcattgcaccctgctgcctgggtctgcgaggagggggctcattggatttctcttgtacgtgtttcagagtcagttagtgtcaagatatggcattccacatagtttcttccctgctgactcaagatttactttactattacctgcacactgacatgattcaggtcttgaccaacactgcatttttgtctgtctgtttcctctggcctgccaccttagccttatctggacctcagcagcagagaccatgccctcatgaaggcactggggagccgttcacagtcagcactggccactcctcatctcagcccaatgaagttttacatttccatgtagatgaggcactcgggatatagaaaagttgtgcagcttgactcaaagcagacagtaattgggtagcctaattgaagtttaactgcaagttccaactttgtaggctgcagaaaaaaaggaaaaaaaaaaacaacaacaacaaagtttaactgcaagtttcatgagacagcgatctgcctaaccattcactcctcctagaagcaaaagctaccgtgatcattgaggcacagccggtcttcatatatcctcaaaggagggggattagcttccacatcccttctctattcctggaggtgccagtagtgggagagtcatggcagaagttaccagaggcaagtggggcagaggcaagtagggtatatgtttggatcagtggatcagtgtcctttattgtgcagaaaaagctaaaattacagattcttctgaagggatacatagcagccgtttcaccaatgtccctcagtccatttgtccaggtccagaagtattcatgaggagctatgcgttagaagagagcacttgggctgggcatggtggctcacacctgtaatccagcattttgggaggccaaggtgggaggattgcttgagcccaggagtttgagaccagcctgggcaacacaatgcccccatctcttacaaaaaaaaaaacaaacctggatatggtggcgggtggtgtgcacctctggtccttgctacttgggaggctgaggtgggaagattgctgaagcctggaaggttgaggctgcagtgagctatgattgtgcccctgcactccagcctgggcaacagtgagaccctgtcaaacaaggaaagagaacacttgatctggaaaacaacaggccagagtcccagccaccttacttattagctttgggccctgggtcaagtcaagacatctatgtaagactcagttttagttttttcatctataaagtggggataaatttatctctctgtttattctgcttctcaggggtttgaagcccaaccagagttattttaatgtggaagctataaagaactataaaaatgctgggtgatattattttaaagtcctattaaaggagcgcagagatccttgcaggtggagaaatgtttcagtgccagtttgttctgatgacactgtatctcttaggaacatactggctctaacactatcaccgagggataaatcaccctggtttcttggaagtgagttataaccatctccaaccatcccggttgattgaacaggatccaggggtgttactcagggtttttccccactgtttagacaacagggactaacaaatgatttgaagggattagaagtgagattctgaccgagggttgacctgagcccagggaccaagccaggaatagaacccaagagtccaagagttctgcctctgagcctgcaattggaatgagactttctgcttcctttgtaatatttcatccaagtaaaggcttagatcttagcatctatgttttaaaagacccaaattttaagcagatgataggaaagtaagccataaaactgtgaaagagtactccttccagtaatccatctgaaaagtggccttacaggaaacattggctcttttttgtgtttatttgaacatgattttatttatagggaaccccccctccttatgttcttttagattaaaatacttccaagttcctctccttgttggagtgcgctggcattccaagcgacagccacctaactttcctctgaaatttccaggcaacccaatagttctcaggaaggcaggtgggggtggggagagaagagggcggaggactgcagagcctttggcctcaacatgagtgttgtggaccaatatcccccactgcatttgttcactgtacaagtatgtgtggtttggaactgaaataagaaaccttttccaaggcaacgttctgctggctcaggttgcatcttctggcctacgtgtattgggccacactttgtctgttcccaagtaaagtttatgaaaatggcacagatgcagccacacttgaggtgccactgaagctatgtgaagagcctgctacccttcaaacagaccaggcccaagcaaggtgccaagccatgtgagagtgcccagtccactgtgtaaatgtgacggcctttgatggtagtgtttgaaaagatacttagtagaaagttgcagagacccgggagcagccatttcacaaaagaaggcaaaaatacctttgagaagaaaggaatgtctgcctctgcactatgtatttgcttgtttgtttctccaaataccatctgttgcagactggggtgcatgacattttaggtaagtagcagatgaagatttatgaagctgggccctgaggtttcctctaaaatatttcttcaccttttaagtcaagacccaaaagtggggagagaagtaggagttggcagaacttgaaatatttaaactaatttagcaaagctcaggagtgttggagcttatctcgttatttaagttagataaggaggaaggggaatttgaaggataatgatagatcagtgtttaagaatacagccatcaggactgataatgttctggaatcccgggaccctcggattgtgcacgtagatgtaaattccatttgctctgagaacttttgaaaaagaaagtttttggttgatttcacagaaaagatttatggtgggcatatttgactttttcagtaaaaatagccccaaaacaccacccaaaatctgttaagacacttctcgtgaatgacctcttagatgtgaaatggaaatgggttttcttaaggaaaggccccttttgttaacaatgtttgcatgttacttatgactctccaggataaaaggactaagactcttttgggtcaccagagcctgaatgcagtcaggttggacaggtcagcaaaaagtctgcaaagaggccgggtgtggtggctcacgcctgtaatcccagcactttgggaggccgaggtgggcggatcacgaggtcaagagatcgagaccattctggccaacatgtcgaaaccctgtctctactaaaagtacaaaaattagctgggcgtggtggtgcgcgcctgtactcccagctacttgggaggctgaggcaggagaattgcttgaacccgggaggcggaggttgcagtgagccgagattgcgccactgcactccagcctggcgacagagcgagactccatctaaaaaaaaaaaaaaaatagtctgcaaagagaacttaggaaatgcttccattaactttttcatcctagctgggtaatactgcttttaattactctgctctgagagcagccatttcttatacttggtattacacataggacatcaaacagaattggcttgaattgagcctttagggaacttccaaaggtaaagattgagtaaagattcaaatgtttattaggatataccagtgttcatttttttcccactaatattccattcaaggcaggagactaggctgatatcccatgtatctagagtggatcaagtccaatatttctttcagagttcctgttccttaaaactgtaaatgggttttatattttattccatgtttggcttaataagaaaatatttttaattgctacctggtaaaattaacatttcagaaagatctgatatgttatcctgtggctcctgcctcatacttatctaggaagttccagcacgctccttccagatgagtccggtacgctgtagtagcatccatatagaggcatgtatatggtagaggtgaaaagctggaacttgtacctgtttgaccctaaggctctggttctaatctttgggcatatctgtcttttggcttggtgtaacatctgctgcttgggacagccattgtgttagttaacatgtcagtttcatcacgaaaaaggcattacatttcagtgaaactgaaaaattattgctatatccagctgaagggaagggactgtcaaatatctcctctgttgtccaaacatggcacagtagatatagtgacagtccctttatcttctactcacccttgcgtatatatttgtgaggtgagagccatatattctcacttcctgatcttgccaaaccaggtccttccagagaatgcttgaaggtagatgggtcattttctcattcctccctctacgtgagcaaccccagaagaacactaagacctgtgttgatgacattggatgtctcacttggctctgaaattaagctgatgaaattataggatcggatattttattttattttttttcaagacagagtcttgctctgtcgcccaggctggaatgcagtggcacaacctcggctcactgcatcctccacctcccgggttcaagcagttctcctgcctcagcctccaaagtagctgggatggcaggcgcacgccacctcgcccagctaattcttatatttttagtagagatggggtttcaccatgttggccaggccggtctcgaactcctgacctcatgatctgccgaccttggcctttcaaagtgttgggattacaggcgtgagccaccacacccagtcaggatcagatattttaaagaagcatcttaacagtccttcatgccttataagttaaaattcctctcacaggaacgtaagcagagaaatcttattttctgagacaggcttcttccctctcgctgaactctaaatactgtattcccctttcactcaaaggccccagacgatgccattctcattataacataacttatggaaagctcagatctattgttggaaaaaatgcaaagtgtgtgtgttcatgcacacacgtgtttgagaaaagcctttccatttctgaaatcccaagagtcatttttatgcaagattatctgttaggaaaaaacccacttttttggtcatggtacattataatcatttctagaaaggagagcgtctaatttttgccatttttggcatgcagagatgactgacttcatagaaaccacactatcctgcttccaaaagaaaaaaaaaaaacctactgaatttacatctgaatcaacatctcttcaaagtccagtccttgcatctcaaccagcaggtccttgtgcaaagaaaatgaatgggaagtgtgatttggggttattccatttactttctgatttggggttattccatttaaaaatgaaataatgttgccattatacatctgtagtcccttctgtgttcagtgaatttgtttttaaaactctaacgtgacacctaatattacatacataagataagacatttgagatttttggtttgaacttcaagaaaaaataaaacggtgtctatttctttttgagaaaaaatttgtattttgtgcattagagaaggttgaagagccatttgttatttgtggaactcctctgtaaaggcattggatttacttatttttagattttcatgactatcccatgcctcatgtttttcccttacagaatcatccacctttgcccaagataaaattgaaatctttaacaagaggacccaggtttgagttcagctcccctgctcccagagagctttagactgtaagataattctgagatacacacaggacatttggactagcagggacttaaagactcactgttgtattacagattatggctcggaagcactgagggaaggaaagataggtgtgggtgttataattcacccgtggttttcttgccctgatgtatttatctggtactcttttgccagtctccttctcaaagacattttcttgctaaatttcttactaacttgtcaaatggagggaaaataagattgaattagtaaaacattcttatcacaatatactctaaaagaggctgggcgcggtggctcacgcctgtaatcccaacactttgggaggctggggcgggtagatcatttgagctcacaagctcgagaccagcctgggcaacatagtgaaaccctgtctctataaaaatatacaaaaattacccgggtatggtggcacgcgcctgtggtcccagctactccagaggttgaggcaagaaaatcgcttgagcccaggaggtcaaggctgcagtgagctgagattgcaccactgcactccagcctgggtgatgggagtgaaaccctgtctcaaagaaaaaaaaaaaaacaaaaaacttttgttatattgggcttatataattcaaattaataatgttacttatctatatccttagtggatttactttaatacattgaggaaaccgctttctgattagcagagagaatttgtacatatgggttcttttagaacagagggtctcaaaatacggtctagggaccccctgcggaaccccagatccataacctaaaacctatttgtatatattcatgtacttatatatgaatttatagatataacaatttttataatagtattctctaatgagtatacagtggagttttccagaagctacacaatgtatgatattgtaacagattgactgtagaagcagataggtgaatacagctgttttccagttagcaagacttaagagatttacaaaaatgtgcaggtgccactctcctcaccttctgtgactctgcatacatgccaccagccaacaaacgtacctggttaatttttttgacaagctgctctagttgaaaatacagtgattgataatccatcatcttgctgataagtagcacatatcggcaatgatgggctaattcggactaaaccgtaggagccgctgtaatgcaatgcttccctttggcttcctgccaacagttgtcagccctcctggtttgctcctgacttttactgggtttctagaagtaacaattggaaatattttatcacatatcagaaagacctcttacaataatttacctaatttagttcttcaccttaacctaccatcccaataaattttaatttcggcagggtagtaagtgtagagcagattacttcaaagtgcagaatcttgtccaaaggctgcttggttgtgtttgcactgccctgactcttgcaggtactcgagaaggtgtatctgtttcagaattcacttgccaaaacctcaactttctcccctagcaaagttgctggagtaggataaacccacagtatttggataagctcctttgaactccttgtagaaagcagtttttatgaggcagttgttctgtgttaacaccagagacaattcctagcagatttccccaaacatacttcaaacatcgataatggcaggggtgacccaaactgtatcataaaatcccagggactgcaggagacttcaaaggggagacagagcaaaacctcacttctcgttatgaggagtatgggtcacaggaatcctggctagaatccatggtaacctcgcggagtaatgccaggatggacagaggccagggctcatcagttccctagactttactaattgaccccagcagcacagttagagtggtaataactggcacctgcccacctcctgaggtgttagaggccaaattaccacatgtgaagtgcttttctatcctttagtgagaagatgcaaaccttgaagtgtgtttctatttttgtttgaactatcgagggcccagttaattcagttgagccaattctgaccttgggatattcagatccatcacttagtatgtacaggcaaattgacagtagaaatttattgagtcttgaactcctactatatttcaggcatttaataagtattaaatactgggaatatttaaataattgaggacaaactgctctgaagaatcaccaagctgtttggtttgtgtgttaatattcttaagccactcttacgtgttcattaaagcaagtttccctatagttttcttgaagaactcattttttagtgatttgacttactctttattcttgaaaacaacaaaattgcatttgtgcatatggtatgtgttgaggggggtaattacaggcattttttccctcattaccgggtccgttacagctccttgaaaacaaatagttatagttttactaattgtttataaaattagctaatgatcctttgattttttagtttttttataccttagctgtatttaataaatatttagtatcttctgtgcaattaataagaacaatgggggccaggcatggtggctcaagcctgtaatcccaggactttgggaggctgaagtgggcagatcacctgaggccagagttcaagactagcctggccaacatgatgaaatcctgtctccactaaaaatacagaaatcagctgggcatagtggcacacgcctgtagtcccagctactcaggaggctgagacatgagaatcgcttgaacctaggaggcagaggttgcagtgagccgaaatcatgccactgcactccagcctgggtgacagagtaagactctgtctcaaaaaaagaagaagaacagtgtttaaaaacctgttatttttacctgaattattttgctacgacaaatttatctttcaaattagattttatcaaagtagatatgtattcacttttttaagttgaagtctttctaaatgtctaaaaccaaaacacagtaatctcctgccctacctttccctgattcctgctccctcagaggcaatcactttcaacactttgggctgtttcttcaatgtggaggtatttacctttatatttcataaataaaccaactgctatttcttgacatcatttgacttcatgttgttatacatacatgtttcctttccccatttttcagtacagttatatgatcctttttgaataacttagtattccatttttacgttattatgactgtgtaaatagtattcccagtgaagccccccacccaggtcactttgatgatgtttcctttttaaatgttgtgctttgtttttttctccttggagttagtaactgctctttcagtattgtctgctttgttttctatatgcacattcgtaatttattctcaaatgcttatttagtttccacatttttttaaccctgggcctagtaactcgtttttctttaaaaaagaaaaaaaaaattttatgttcctattgctaatttatccacaaacactcttctgtatgtgtacaaatgcactgagtaatttattggtttctaattaaattctccctcttgatgtcctctgctcccatctgactggttgttgtctagctatttttgtctctaagctatttttctatagtagtactatagcagtactattctgagtttctttcttccatttatttgttttggtctttttctttcatgaatagagacagtccccagagaatctggtgattcttgactatctgttctactcctctttaaagatgaggcactaaaaagccaattgggagctcttggtttgaggctgagggggccttactgtggaatgatcaagtggggacctgctgactctgggctcctgttgagaggagcaaaactgaatggggatgagagaggggacctgaagctctaactgcttcccatgcagccttttaaccaatcttcctgttttcacctcactccaggcctatctgtttctcctttatgctccaggccttcagagctacttgctgcctccatctttctgaaatgcagtggaggccaccatcctaattagctttctgctttgtggcttccactccctcaaggcttacatttcagcgccacgtgtccatctgcttttcagcttctaaaatattgttgacaccttctctttatccttttggatttgtgccatttgtatccctttgctttccctttagaggggtctctggactagatctgtcatgtttaatcagaagtcctataatttagacttttcactaatttgtgtttcctttcttggtgttctttcccctttacccccaactagtggctctgaattagtgtggttttatgaaacccatatccattcagccatggttctatgtattatctcatttaggcatcacagcagcttttgcacagcatctgctcaggcagtctgtggctcttctttccccgaaagattgagaatacatctggtgagaagccgttgccagtcccagcccctgctttgagtctggtattggtctttaatctctcattctgtgtgttgtaaagaaacaggttgtggaaggctcttgtcagatcccaggaacatgaaagaaatagcacaccctacggtagtgacatggccctgtcaccacccctcattgaaccataaaagctattcagaggggccagcagctggggagcgactgtacttagatcctgggtgctgatgggtgttttgtagtttccaagggaagttgctgaaagttttcttatcttgacactccaagggcaagaggtctttcttcaaagagaagcgcttgtttcagaaaaagatgtggaaaggacgtaaaatcacaggttcttccccagttctgaaaaagaaataggaaggggcaacgtggcagtcagtgtgaaaagaaaccacgcatttgcaggaagcaagaaggggttccgcagcactggctgcttccggcatctgcagtgcgagggtaaacaggcctactggggagtcggttggccctgggtttgagtcattgggctgctgcttggctgtgacctggaacaagtttttcccctcttaatctctctgagatgagattcctttgagtcatatgcctacctcggtgggtggttacgtggattaaattatatcatgtatataaagcactcagcctggcatgtggcatgcaggtagggctcaagaaatggtgtcagtgtgaatattctcccctgaatgttggaatgttgtgtgaaggtgaaacagggattgtgtccctagctcttacttaaattcaaccctgtccccgaattcttgctgaccacctgctagagtgtgaggactaggagttcatgtgcttggctgggcttttgtccttcccattctctttcttcacacaaaatgaacagttgaactcaggccaccaaacctggttgagttgctgggtggagggactctcctgggctctgagcctttgtgtgtgggaaccgcactggaaaaggtgtgcagaggccacgaacttgctctgaacccacttgtgaagagcaggtgaccccaaactattgttagtgtctgctgtaaatgatatgcctctgggttcgagcagagttcagccaaaagccccacatgacatggaaatctgtcctggagccaggtttgtcgggtaaaagttatgtagcaaatgtctccaaacattggcatctgttgtctgccgagactaggacaaccgagaatgatggagtgcttaaggaaattaggatggggcatgcgaccctgtaacagctgataaactgtttcaggccaccgtggctcatccagctcttttgataaacagctttaaaagcattacgtggtttggaaagcattcttcaaaaatggttatattttccagacgcatgacagtccactgttcagtattatttaagggttttaaattgtagaatcagattccttttcagtggggctcttggaactgtcgagggctgatctgtctgactcccaccaggacaatctcacaacaatattattatgtaggtcggggtcccctaggtctgttaaaaaaaaaaaagttcagggctaagcgtttaagaggaaaaactatttctttcatttctagctaagtctgatgggccctttcaaacactgctttcatcatgcaccttttatttcacgatttctgcataatgaaaatacaagatcgataactgtggattatcgtaatgccttgagcctttgaaaatgaacattttctagattataaatgttccctttgtaattcatttcaaacttcatcctcccatttgtcctaattcccgaaatttaactgttgccttttgagcctcctaggaaattctgggtatcctttaggcaagggaggtagctcttgggggaatagcattcaggccacaggcaattcatttgcgacttgggctcttcttagaacatatgataagtacaacgcactgtagtgacagattttttaaaaaccctattaaagcccaatatactaatgcagattttttttttttaagttttagagagattcatgggattttattctttttcccaaaggcagtggtggagctgacagagtagcatggagcctcgtcctgatgtattgtgcggaagtggcagcagttcacattcattcagtttgtcagcataggatcagttccttcttgactcaactctctgtgatcaaaataagctattggatgttccctttgggtactggaagcagcttggccccttggcaagagaacaggattgcaaatcacaagagcagagccctgactccagctctgatgctactgtgctttgtgaccttgtgcagacagctttatatccccatctcaggtcattctcccccatacaaagggggagagggtcatccttgccctggtcatgtctgcatggctgaggtgaataactagttgtgtaacttcctggaggagtggcacagaggaagctcccttcctagggctggctctgccatcagggaggaagctggatattagaatgaagaaaaagcccatgcagaatatatggcagcccgataatggattctaaaaataaaaaagcactaggttaatctgcagctgtagtgtacctaaagtattctttggcaggttgtggccctagcctaatccccagctggacttagcaccatttaagtgagttacatctcatccccgcaagggattgagtctgtagccaatttggccttgtcaccacttcagccctccctctgatttcacctttgggaaaactacaaagtggccccagacatacatagcaggcttgatcacatgggtggagtctgtcaggacagcatacatcaaataaaatgtccagggaacctgttgtaaataaaccacttcccgcatgctcagtcatcgtggaggtacttgaatgtttagtttcttttagctgatggccaagaaatcaatgtttaaaaaaaaaaaaacaaaaaacaaaaaaacaccttgacagaggcattttgtacaagaatggtgtgtgggtgtgaaaaagtaaattccaaaacatatttccttttagttcccaaacccatattagatgagtacttcttagccttggccacagtgctagagtaaatagcagtgtcacatagctcgtggaacaggcaaaccacagaatgtacaagagagaagcgtgcacaccagtgagtctgctatggcagctctctttgtcctggtttctacatctcatttgtaagcaacttgtgttcctgcattttcagagtttggccagtttatttacttagaattgcatgttcctggaatattgtcataaaagtgatcctgagatagaaaaagtcaacaggaagcaggggcattgagtttataagttctcagtctgtcttggcccatattaaagtctcattctcaggggtaggtccagctttccaaattttaatatatcagagactcctgatgcatctgggctcatgatgggccaaagtaggccttcaggagtcctcgtgttacacactcaacgcctaatggagactggattcatttacgtgtattaatgtaacctgcgtgatcatgtgagtgcaagtgctttgtagattgtcctgggagatgtggcatattatgactaaagacttaattgaaccctgaacatgtatatgaataactggagacagattgactggattacacatttttcttgaaaatttcctaaatttagcctacctctttgttgccttttatttcccagcttaagtggttctctataacactatattttaaacaaaccagaacaaatagtatacaaaagcatagacaagagggatataacaagagatggttttctgtgatccgtggcacctcctctctaccctgcctccaccaccaaaaggggctttaaattaagattcggaatggcaaattcacttaccagctccaaacacagtagacaaggaaaccttgtgaggaaaatccgagagtatatttacagtttctgttcagaaatacatagcttaacttcgaaggaggaagcgtgacttttcacctgcagatagaactagggtctgatttgaaacagaccactggcttcactgaaccccatcaaagaagtctgcttctgcccggaattggaaagtgccagtgggcatgtagttgctagtatgggatttctgtttttatttttaacaagcttgggcccaactcttagtatcaagatgggtgaagacaaaactgaccagaaaaacacgtatcaagtcagcagtggctcacccctcagaggccatttttcccacctgctcctcttatacctttggtttgtttttggttttggattttttctctatgttcctcctactctttctttctctattttgcttgggccttcgttagaagagttctagtaatcatttcagacttccaaaattcaacccagtagcctcattttacaggtggacccactaatacacaacagctcgatgtgacaaaccatagactcacagttaatcacttggagagcctggattcacctccgcgatgacctgcctttccagccctccagtggcgtcctctgtagtgagttgtaaatgtgccactctagaacattccaggaaagccctcctcttgggctaaactctaaaactaaaatgaagtcctgcccatgtgagctgcttgtttaacactttggatgctaatcagagcattaatgagaacacatggatagattcggcaggtctaatgcttgggaccttctcctatttgattccataagactaaatcccctataaacacttccctcctgtgcacacacacatgcattcacatacagcactcacgtatccctcccttatagccaaagaccgaaaaataaattttttttttctacattaaaaataagaccagctagtaaccagggttggcattcccatctcctgtggaacctggaaggactagcagatagctatagagatctgtctcctttttagtgtggttgtattaagggcaatcttgcctcccatggcaccccagaaaatccaggagttcaagtgggggtgcactgtaggaggactcagcagctgttttatggaaggttcgtcagggatcagactgaagattttgcttttgtgagaacaaagtgaaatgtgacattcaggagcagctcggggcctatatataggggcccagggcctgctgggatggggttttacacttgggctgtccttttgcccttcccctgaactcttttcacttcagtcatgagcaaacagtcagtgcctgaactaacaaccctgtagtcctccgaagcacggctggcttacagtaccgaacaaagggagggagtgccgcgtgggccggcccaggccgaggaatgcggcttcagggttctgctccataaatttaaccagcacgacgaaaaggagataatatgagccttcgtgatgatctgaaagggggaggttctgtgtcccattgattgcggtctggcccaatgccaggcccaagcctgaccgacagttgaaccatatcattaaggcgtgtaatacagctcgagtcttgtactgccgccaatgagtgcatatccacagggcaaaagtttataaagagtcgaggctgtcctgtttaaccctctcacactgcatgtaatagaaccagctgccattcagaacttgcccatctgaggtcataaaggaaagcctgcacgtttcttttcttcaaacagcttttcaggactggggagaggaagaaacgctgtctagagagggtcaaggcacggtgatgtttctctctggagaagcaaagcagtctgcctccctccccccggccagaaacgggacaccttagtgctttcttcagagtagctctctgtttgtggtataatgttgctggaggaaacagggctgacaccacaggaaacctgcctgtctccaaggaggccgcatcggtggcagaggtgggtcagatgccggccgtggagtgctcttgtcaagcttgggatgatgccgttttccttccccatcacctcgaaagctgttaatagccttgctttctggccttccacagctacgcccaggtgctaaaacagagcaggtggaaggccgccccacggagtggcctgtgagcccagagttctcactgtccgaggccggtggccccatgggaactctgtccattcaatagggagggcatgtagaaataggcacattgtcacagcaaggcctggagtggcctgggttcttacagtgggcactgcattgaggaaatgggcagacaaacaaggatttagcataagtatagtcagaaagaaagggctgcctgtgttcaaaggacaaaaggaagaaagtgggcgaaggggtagtttagtcctgtccatcagccagtcacgttctttggccaaactcgggacctgcctgtgctttgtccatggtgtccaggaagaaatctgtgtctgtcacttccagattgctgcttgtctgcaatggacaatgcctcttaggcagacacctgctcgggatgacagtgctgcagaaattgatccaaaacattgactagcttgcatggtatcgctgtcattagtattcagtcttcacaaccaccctatgaggtgggtgctatactttccccattgtacagatgggaaagttgaggcacacaggggatacgtaacttgtctaagatctcagaggtagtaaggaagggtaccagaatgtggaccctggccaactgaacacagagtacatgctcctaatctctgtgctgcttctgggccatctctcggtccctcacatcgaaagacctcatgatttcaatccaaagcatctgaccaagtgttaggtctacttcctttcgattcttggatatgaagggtaggagcttaatatctgcctatagcccagaagatttgtgcaaagaccctggttcacttggagaggaggtactataaaatttggaccccacaatgcgaatgaagggtatgtattgaattccctcagcccaccagcttaacacagagacagtgtgagggatatactatagctgggaagcttggaagggctcatgttcaagggcctctttgggccaaacagcagtgggcctgagcatggagagaccctggccttttagtgccagtgcctagagaagcaggtcactaagctttgtgcccaggagctgtgctgtccctggtccatccctgtgtaccccattccactcctgaaataatgaactactgcagccttccaagttcacagtgtgccagtttgtcacagaatagcagtgacacttctctgctgcaacccatctttgctctgccatgctgccaagaccatcttcaccaggcggtaacctgggaactccagctggtacacagtacaagaagcctccgcagtagactgtcccaggtgcatgtgctcagtatgtcatagccatctccttttggaggccagggagagcttctgtttgggtgccacggatcctggacagaagctttctagaggtaggagaagagactaaatggctggccaacccagagattgttggattgtgttatgattccatggtcaaagtgctttaaaaacctagaaattggctctggtagtgagtcccaggatggagctaacttacgatctggactccattacatgattgctaatcctgaagttcagcaaacgttggtactggctgacttttaatggagtacctgtttgagggttctcctcatcatgtatttaaggttaaattgtataaaggaattctgctgctcttttgaaattttctggttctgtttaaccatacctaaaaatgccatgaggtagccagatgattgactaactgggatttatggaaattcttatctgcaaaaatctcaagacaaagagggcactaactagaaggttcccagtgctttatgtaacatgcagaaggaagtctggtctcagcttcttggatctgagcaatcctttggaaagggagcaatgaagagcagtaactgaagactcatttcctgccttctgtgtgactcactctcctttgtcaacttcaagtttgccctaggcctgcttgcttctctccaccccaaggaacttggtctttggaagacacaggcacctgccctctctgtctgccttttgcccccaggtccagagggagaaacaaaccctcagttggaggaaagtctagagcacaggctttgtgttgctcagagaagcatgacaggaagtggtgctgttgcctctgcattggccgactcctggctgcacctgcttttcccagaggcacggggaggcccaggcaggggcccagggcctgctgctgatcagtttgtcctgcttgcaagtctgcatcccagtacccaacggggccaagtagaaaaggcacatagtgtagtgtgagccgtagctgtcaccagatgggtctttcccctccgtgcccaaccccttccctgacctgaaagggcctagcctctttccccactggcttccaccaagttctaacacattttatatatatcgatttccaggcttgtagaggcaagacctacagtccaggagttcaaatggattcagtgttgttggttcttgtttcctagaaggacaagtgctctgaaggtttggtgtcaactctgacccaaggggtgtatctgatttttatgaaggcacagaaatgcacctgaggtgaccccaagtccttctcttttattttttgatttcccaccacctggatcattaattctgctttcaagggggatggggaaaggagaacatttcaaagcaaagttgatttggtctctgaaccagcttgtcttctaggctgtagttcaccctgatgagaatcagaaaggacagtctgtaaaccccttcactctagtgactctgcagctggggagcctcaaaaccagttccagatgttctctctccctatattggccagaagggaatttcgggcaagcaaggaggcagagagcttttgcccattcattgagtacccctgtctgcaaactgtgtcttgcttcatggcactttagggagagtgctgagcacctgggtccatttgggaccagccagcccttcctgttcctcggttagaggcatgctgctccaagctggctggttactgcaagcaagagaagcccgccttcctgctgttcagggtcagaaagcaagaccgtgctggagaagtaagtcaggcaggctaggaaggagacctgcagatgacccttgggttaacaaagcaactttcacggccctgttcaccaccagctaggatagtacagggctttgcctcccaatcttgggagacgaggcatagatagtaatggtcaactgatggccctttactcttgagaaactccacccagcctccccttatccagaagaaagccattcctgactaagcctggccattctgacgccttctttcttagtctgcacccagcctgtgctgtatgcggtatatgatggtagaaatttgcactcttcatgctttgattttaaatgcatattagacattttggcatttgtgcctgaatgctctctgtatcatcttttttaaaacatagtttgattatgtaagttaaagaatgtacaaatgtaaacttctgaaaatacatacaatatatgatttcttagagtgtatggacactgctccagaggccttgcatgaattatctctttaatccttacaaaacgaatgtgatgggtactattattcccacttcaaagaagaaaataaaaaggacttattctccctgggcattgacaagcaaagagattaataatggtaaccccaccagacatctctatgggtatatatgtgtatatacactagtatacatatatgtatacatagtatacatatatgtatacatagtatacatatatatatactagtatatatatatgatttgacatgaatgggagtacatatgttgatgtctaatctttttcactccacaatggtgctagaacgtctttccattccaaaaatcatttttaacatttacataatattataatacaaatattccataagctacttaactagttccccattgatggatgtttttaatttgttgctgttgtaagcatcctctacatatatcccatcttacttgaataattctctccttaggctaaagtcctaaaactatgattgctggatttaagggtgtgtatattttctgctttgaaacacattgtgaattgccttctagggagttgaaacaatttgtactcccacccacagtgtgtgagaggactgactcctccagccgtgtaccagctctggctattcattcattcagaattcagtcaagaattacatgaagtagctgcagtgtgccagatactgtactcagaaccaggcattgttactcttttaagtctttgccaatctgaaagagtgagtatctgtgttactacttgcatttctttgagaattagaagcgttgaaacatcttttcgtgtttcagttggccatttggatttttcttcttttgtgaattacattgcgtattctttgcttcaatctttttaaacccgttaaggtcagaatttgtctttttagtgtgtggtttttttttaattcttatctagtgttggtctaacccttccaacagttgtcatttagccagtttgtcatccatgtaagtacatatctttcttccagatattaacaaagtttatatcagtctcttggtgaattccgttcctgtaagttagaatctgcatcatgactttataaaagaccatcactgtgcctacagttctttaggaatcgctttggcattaagaatgaggcttcagccaggcacggtggctcacgcctgtaatcccagcactttgggaggccgaggtgggcggatcacgaggtcaggagttcgagaccagcctgaccaacatggtgaaaccccgtctctactaaaaatacaaaaattacctgggtgtggtggcgcacccctgtaatcccagctactcaggaggctgaggcaggagaatcacttgaacccgggatgtggaggttgcagtgagccgagatggtgccactgcactccagctgggcaacagagtgggactccctctcaaaaaaaaaaaaataaaaataagaatgaggcttcagccagatgtttttggattatatgtggcgtggcctattacatggtttttatttttgtttcctcctatttcttagtatttctttccaccagttcctgttgtaaaacgtgaccagttggtactgatgctgtacatccttgtattagtaaaaatcctgctgtgcctggaggcagggacctgcttgggccaggccttcccaggaagcccgtcctaccctctgtagcatatagtgccggaccaccccagcgctcccacttacctccttcactctttcattgttgatacatgggctaggtttcctacagagtcacttcaaggatgtagatcttatcctcccaattggattgtgagtttgttgttattgccttttttggtattcctcaaggatgttcagaatacctcacatagtgatggactcagagtacctattaaagagattttcattaaaatcacaccattcagtaagttgaccaagtacatcaagagagtcagaaagacccaagatctagtttggctttgccaggcatagcttcctcatccataaaatgaaatactagtaagatacttccttatgtgaatcttgggaggctcggagtgtccagtacacattcagcactcagtcagtgcagctgtagagacatagcgtggaccttggtggcccagcagtctcaatcctggtttcttctgacctaagattggtgggaaagtacagataaaagctggttgaggaggtgttgatagcacagagtgtttttacggagtgtcctcggagggttacatgctcctttttgttgaatccgaatctttttttttttctaatatggagcctcataatcattcaaggactcagtgtgatgccacaggtttcaaacttgccagttcgtctcttatgttctgccaattttttaaaagtgggaatatgagtgcatgtgcacgtgtacacacacgtgtgtgtgtgtgtgtctttgtgtatgtaaaatgcttgggataaaaaaagatggatcaaattttgtctggcatggcatagcaactctcacctctagtatcctctaaacatttaaccaaatggactttaactggtttacttcaattctatttttattttcgtagtcatttaaatgtatggggagccaactctttcaaatgagacattttgtcattaaaacatgttatttagtttaaccgcatgggcccggcttcagcaacattgaggactgtgaagagggttctgagcggctgttctctcctgacctgaccgcagcagtgacccaccagcttgcaatgcacgcaaactgaaacaggcaggatggccagcccagggttgtctgcacggtggtcttggcatctgtaccttaggttgccagctcctggccctccttgcctgcatttggtggcccttggccctgccgtgtcatatggcacaagagcccttctggcccgcatcaccctgtgtactgattaggcaggaatcagcaaatccgttgagtgcatgtttaatgtgacacagatgtgggacatactacagatctttctgctttacaaattttcagctttttgcatttcatcagtgttgcttattatttacagaatgtaacttgagacatcagaacagattgtaatttttaaaaaggttgttgggggggtgggcccgcaggggatctgggagaaaaaatccagtagtgtggaatgttgtttgctgtccagaccaaacaaaccagtttgccaagggttgatggactatgacaatcagtccaattcatgttaacactgggggcacttaattaaaaggcagcttgacctccttatcaccaaataaagaataatcttttgttaccaggttgaccgtcgcagcaccaggcagaaatgtaccccttgtagaggcactgaagggtaccaccaagctgccagctcgtgtcctgcctccttcctgtccacagagaaaggcaccattgaacccagtccccactcagacatgtggatattcttgcctcatgcctgctgtggctttacacccaggcgctatggcaagaggcggaaaaaagaaatctcttcctttgcccaaaaatccaagatactcttgagggcattggaatgatgagccaggccagtttgacacaagttcaaggagaaggtaccatctcttgcttctagaggggcacatctggctagaggtggccctggcttctgagaaagctcagccataggttacatttaagggcaaacaatgaaaagcaccagctggtcgggaggaagatgaggaggagtgggtgattggttgcttctttcctgtgtctagttctaaagaacttaaaacttgggtccaaaataatgagagccgtgttgtaaaaatcatttgaagagagttctcctggggaatgtgagctagtgccgtgacctgatcccttggtcagatggttctgagctgtttaagtgctgagtgtcaactgtctacagggagccaggcccctgaggagcggccagggttccaagccccactgttcttttccttcctggaaaagtgcagacggtgcacgttccccggaggccaccaggcagctctccagttgccctctgggtgaacgtgacccaggtcggtaactttctagtgtcccccccacgttggaatgatcagcattcctgtactccaggggttcttgagttcttgagttgttaccaacgccctgcctttctctggctcagattcagaggaggagttccactgcggactgccgcttcttcaccctctgggcttcggaagcagcacctctggctcccctgcacccagtcctcagtcttgtggccctggtctgcccctttatcacatgtcttgagcaccctctcagcacacagcaccgttctgagcgctgaggtgcgaccatgcatagaagagacaagaatccctggttccgcatggcttccctcaacacctacgtttccaggccatggcttgggttcagaagaatcaccctccctggaagagatgagtgactggaaggagagcatgtcactggctcccctgagaccctcccaagagcctcagtttctccctctaccacctgaagtctaactgcagggcctgaaacagattctctttaaaaacccatgagtgtggtgactgcataggttttcattctcctgagttcttaatttccgtgtccctagcactttttgaagcatctgctcctgttgcccctttcttttcctcctcaccctcctccatagtctctgtttgatagtagaaggagatttaaaacctccaggctgagtgaacaggcggtcttgaaaaagcaaacaaatcgggtcaggcacggtggctcacgcctgtaatccccagcactttgggaggccgaggtgggcggatcacaaggtcaggagttcgagaccagcctggccaatatggtgaaaccccgtctctactaaaaatacaaaaaaattagccgggcatggtgccgtatacctgtaatcccagctacttgggaggctgaggcaggagaattgcttgaacccaggaggtggaggttgcagtgagccgagatcacaccactacactgcagcctgggcgacagagcgagattccatctcaaaaaaaaaaaaaaagcaaacaaatcacaaagcaggtcccctctgggggctggagcatcctcatatctgcttggctttggtcactgaaagaggccctgggggagggggcttcagggcttcccaggggagaggtgacagttaggacacacgcctcccccacttcagtcaaggcagcttcattgtcagcggttgtacgtactaagattgtgttacaaacttcatttgcagaaagtgttttacccctgaaatttttttttgaaagcgcctgctgtgagttttattaatggcacttttctaaaacttcattaatttcaattatgagaatttgatatctggtgtaattcattgagctgctagtttgatttgctctagctcgttttaaaaagctctgtcaggcaacaggatatggatgggagtgggtcaggtgagtgaaaacgttttaagcactcctttcttcagaaaacacctctgtacccacatggggtgtgctcctcaggagtcattcagacaggtccaggagaacttgtcccccagggtgctccgtccagatacaattttaaatactgcactttcgcattttggtattttcaatggacttgacacccaataattctgaataaaggtaggaaagagggagatgattaacttttacaagtacctactatgtgccaggcactatgctacacattcttcatattttatctcaacattatcaaccaagtaggtattaagttctcacctattgatgaggaatctgaggctaagaacaatctagtaacttcttcagtgtcacccagctaataagtgactgggatttcagcctgtgtttgtctttttccagtctatgtttgttcctttatactactttgttcttaaatttcatctcttctcttaaaagaggtcaactttgggagaaggtagataatatataaacattgaaagaaaaagattatataatcatttgccagaaataaatctgaaaatattgggctggacacggtggcccacacctgcaatcccagcactttcagaggctaaggcaggaaaatcatttgaaccaaaaaaaaaaaaaaaaaaaaaagtagtgaaaatgtatggtttattaatgtaatcagcttgttattattagcatgcgtacttaatagccacaaaataaagcttaccagagatggtgtatttcggtccttgtgaaatatcttgggattggcattagaggtgacaggttagcaaggaatttgataatggcttgagagattccaataagcactacactctctgactcagaatgttctacttagaacacaaagaaagcttacaattgtaaagcgccttgttcttccatgatgttgaaagttgcaaaccactttataggttgtctactattttgtaaaagcaaagcaaacccagaatgcatgcaaaaattatggcctttaaagaaatccaagccttttaggctccattcttactataacatgatctattttcttggaattctttataaagtaactctgcccctccccacccagccattaacaggtagtctcgcccctgaggcagttgactaagaaaaaaaatctggagtatttttgtcttagagtttaaatcccaataggtgtatctgttggcattagtcctaccagctgtcacagttgcagtgtcatggggtccccaaaacatgtgttaaattatgggaagccttgacccctataaacaagtcaggtgtgaatcccactgatgggagaaaacccagcccaggaaatgtcatccctgctgctggatgtcaaattgctaaaaacttaacaatatcaatataatttctaatgatttcttgaatcaacatctttcttacattttcaatggcaatagtacaacatgggattttatgtgtgttatgcatgtatgacttgagaactctagggagaggtaagtagaatgttaacaagaaagcaaaggggaaaggaaaatacttcagtttgaagcagtgagcctccccagtaggaaaactaagtacaagaggttggatgttacaccctagcccatcttagatcccagacacctcaactagggttcctcgtgtgcacccatggcactctaaataatacactaataaaaagaataggtagcattttatcgagtgcctattatgtgctagactctgttctaagcactgtacatgtattgacttatctactcctcacaacaacccatcattacccccactttatagatgagaaaaccatcgctccaagaagtcacataatttgcctgtggttacagttcgtaagtggtggagctgggattcaaacccactgggcaggctggctccagagccgatcctctcagccattatattatgctgcctactctagtgctccctgtctctcctactgcttccctgctgtgttcttgttgccatttctgttcatctcctccactgaattgctgtaagctccctggatacttaattcatcccagtcttcttcaggacctagtgctggcctctgcatatgatagtttgggaaaggttggttgaataggggactggaggaggcaggcacaaaccatttgcagggctctaagtaggctcgtttttctggctaccctagtttggatccttagtcagtaattccatttaagaaccaatctctactagcatagggtttctttctgcccaacctattttccatgtgtccaaaatccaaattgtcccaacctacggattgaatactatctttgagtgggttctagaaggtgtatttctctttctcttgaaaccttggggaagaatttctcatgtaaacagaggcaaactttagaaattttcatcctctaatagagtcttctctgattacagtttgcactgaaaggagtaaaatctgtttatggagaagaaatgcttttccacttcgtctttagaagtagatgcatgtggccaagaggagggagctacacgtcagaggtagttgcagcctatggcatgatgggagctacaggtccgagatagatgcagcccacagcatggtgggagctacagatctgagatagatgcagcccatggcatggtgggagctacaggtctgagatagatgcagcccacggcctggtgggagctacaggtccaagatagatgaagcccacggcatggtgggagctacaggtccgagatagatgcagcccacggcatggtgggagctacaggtccaagacagatgcagcccatggcatggtgggagctacaggtccaagacagatgcagcccacggcatggtgggcttcttgggcttgcagacattgtactgctgtggataccagagggtttttcaccaattcgtctactctactgcagacagtactatttagacagactgcggggtttctcttagagaaatgacaaatgtttgattaggccatttggtcaagaaccctggtatcttgtagctgttatcagtgaccagtattggaagaggtagtctggattgaccttcgttctcagtctaattgtgcacactcgagcacagtatatatcagtaagatacttgattaaaacaaaagccctggacacatacataaagtgaatgcaagcacaacccatcacacaacccttaaggaagatggcagccatcagttgaataaacattctatgatgctaacgtcacatgtgtgacatacactttctactcacttactgattgtttttgaacatcacttggctgatagacattggccatgacagacttctcaaccaaattaagctgtgtaggggtatgtgtatgtgtgcacagcatctgtcttaactaacagacctatgacatagttactcatcgtataagctacgaataattaatgcctggctaaatgttgactttcaggctgaaaggcaagatcaaccaagtggaattggctggatctccctgtgtcaccttgtttggatttactgttgattttttttttaaaagacatgagttgttactactctgatcattggttttgggcctccggtgtatatcagatagcaatggccagatgcaggcacactctgtattgattgccctcactggaaggatatctgcagtgtatcagccactgtatccacagccccttccctgggggaagagtcctccatgctgtacagcagactccctgacattttcatagagttcaaagctcaagttggtttggtgctgacattctggattagctggttgactggaaggactgcttctttctatacactgtgaaatttgtaaaccgcagcagctgagggcttaacatggccgacaagctccagctggcagcaattaaatataccgcagacctttggccaaacaaaggtttgtggaggcagagttgctgcatgtgcgctgaacagactcctaggttgagtgttggttcataagagatgctgtcgactaaggagaggtgagtgggtggattttggccacctcttgttcggtgatccattgtccccagaattattgtatcaagaccctgcccaagtagcagcaaaggtggtcagaggaaaggaacaaagccaccagggaggccgcaggcctaacagtggtgggcctgagtcgtttagacgttgatctgctgctgtagcaccaatggcaggatctgcagctactccacttttttaaatttattaatttatgtatttattgggtaccactatgctgtaggctataggctgaaaggagaagatgggaatgaaaaaacaataagaagacatttaatatccattcaagcagcaaagattcaagagtctagaccagtgctatccaaaatacaatttaaatttaaaattcagtcctttagttacactggccacatttcacatgctcagtagccacacgtggtcagtagctatgtattggacagtgctgtcctagacaataccaagtgttggatatagatcgctagggccccttaaatgcctcattggcaggaatgtaaaaatggttcagccacttcgaacgcagtttggattatcttgttaagtgaacgtttatatcttgtgagccagcaaattccccctagatagattctcaaagttcaccaggaaacacgtacaggaatgttcataatagcatcatttgtaatagcagaacctggaagaaacccatgtgccatcaacaggaagatggatatatcatgggatagtcatacaatggaatatgaacaaagcagagacatggtgaattaatcatggctacacacaaaagaatacctgaatcttagcaatgtgacagcgacatcctttttcaaaagcccaaaactaaacccaaagaacataacaagaatgtactggagcatcctttgaaatgtggtaaggctacataaaaaagaaaagcacaggaatgagaaacacaagattcagaacagcggctgccttagttaaaggaggaacagggatttggggtggcagaagaccaacttgtggtccacgattgagtgatggagtttttttttttttgctttcacagatgtttatttcaaataaataaagagagcccaatgatgagagtgggccttgaactgaggataataagcccagtcctaaagaccagttattaaaaaaaaaaaaaaaaaaggactggccgggtgcggtggctcacgcctgtaatgccagcactttgggaggccgaggcgggtggatcacgaggtcaggagaccatcgtggctaacacggtgaaaccccgtctctaataaaaatataaaaaaattagctgggcatggtggcgggcgcctctaatcccagctactcgggaggctgaggcaggagaatggcatgaacctgggaggcagagcttgcagtgagccaagattgcaccattgcactccagcctgggtgacagagcgagactccatctcaaaaaaaaaaaaaaaaaaagactagagtcctttccctccaggtgctcataggcttactggaacatacaggaaagtcacttaaaaatggacacactgtcactgagcatgaacaaatgtaggactgctgttacatggtcatactcgtttaaaaggcctacttgaacgtacagtgtcacatcaacagatgaagaaaacagcgtcgtcacacagtggcctgggctgaagaacttcactttaaactttttgctggcttacgaggtttgaaaacactagcttactgttagctttttacattattttagtaattctttaagattggaactaaatttgttcatatgcagtgacttcaaatactctccccctacccacagcctaccaacttggacctgagaaggtaaatttttagttgagttttagagaagaaagaagagtttttcaggcactgacattgatgaggtgatacaggagtggggggaaaattcctttaatccagctttctgcttctaggaagagtatgccttctggaagtccttgtattcataagactgtaacagaagatgtttccttttagggtaaaattgaactcatctgtcttttcttccatgttgatgtgaaaaattagccttgaatgccacagtgagctcccctagtcagcagtgttgagcactgaatccaaccttgcccttgatattatttgatcaaaagtcaagaaccctggaaatgggaagatagtttgtggcctgttgtgaagacagtcaagaaaagaaacataatgatagtcagtgtgtatcctcaggggagccactctgcttttgtattctctgatgttttggtgggtttgcagtttacaggttaaaaaataatgtattgggagtgggggtgaggttggatcactgaaacctgggtaaggctctgagggagtccactgagtcaggaaataactgtttacactagaaagctgtttgatcgtgtgagaagatcaacaaggtgagccctttactcccattctcaactattctggagctgtcatgagattaaatttttaagagctcgggtccagaaacaagccatctttcgttggcttctctggcttcctcggatccaccagaggcatttaggacttcagcaagttttctcctgcctggtagcatgttttccctcagctttgagtactaatgaaaatcctgcttcatgtaagggaaaggcctgtcatcagtgtccgcttcaggacactgccgtcatgtccctttctgtgttttgatcagtggggcagacagagacagccttgtcctttctgtcaggaagatggggttctagctgcttcatattttgcctcaatgttgattttgctttcagggctcaaaatccttagtcttcaaactctccaccaaagcttgcatactggccttcctgtttagctcaattaatggcccttataccgtctgccagccaccaggcactcactcgtttattcggcttatcctgactgctgctctaccataaaccagacactgttctccatcccaggaatgcagtgaatgaaacaaattccccctctcctggagcttccagtccacatgggagccaagcagtaaataacatgtttatccacctgggatggaaagcaaatgtgctttgagcagatgactgacttgatgtaacttaccttttttttttttttttttgagacagagtcttgctctgtcgcccaggctggagtgcagtggcaggatctcggctcactgcaagctccgcctcccaggttcatgccattctcctgcctcagcctcctgaatagctgggactacaggcgcccgccactcccccgcccaccccagctaattttttgtatttttagtagtatttttagtttcaccgtgttagccaggatgatcttgatctcctgaccctgtgatccatccgcctcggcctcccaaagtgctgggattacaggcgtgagccactgcgcccggccgatgtaacatcttttgaaagggccattctcattgccatgaggagagtggacaaggatggaaggaaagagaacaaattatgagactactgtaataatatattacaaatccagggatcctttgttagttatgatcgagatggagaaatagtcagatttgggatatatattgaatttgagcctgcaggcctcccagttgattggggaagatatgttgagacgagtctgaatcaaaccttacgttgaaagtgatgaggaagcagaccctgccatattcctcttggagagcctttgggcttctaccatgtagcctgacagagaggtcagcaggactgccctggggaaaggatactttattagcctgtgtaggcagttattggaatgacagcaagtgctttgctaggcaaggagataagaacagagctctgctacgtggagaggcacgccaagctccttcccccaaccccgctgcctgcagaggttaccagcatcctctcggcagcagtcgtccagcttctctcctgatgggttagcagcggcccctctaccgccctccccactttcgatcgatatttgggctctgagtagccaactgtaagcctgcgtcttgaaggaaaaattgagactggcggggtatgtgagtgtgtgatataaacacaatgggttttttactctttcccttagtgcagatcattgaaacttctataaagtctctgtaatacccttagagagtacaattaatagtactgaagacgtccttataactgaacttttgtaaaattattgctggatttttgtctttccagcacacattaaacctcaccaaggtatggggctgtccttcagatgtcacagcctgatgaactgagtgctgacctggctttgggagcacttttcagttatcccagctgtgcatggcccattgcatggcctgtgacaattttctggggttgtttctgtccatatttccaacctgacttgcccaccagggcactttctgcccttgtaagtaaatctctatgctgcttactgttagttcctgtttctgaagtgctgattcgatgtgtaaggcttctcctctcttttagatctgtctagagaggagtgttttgcttcagtgagctccaggaacaaataataagtacagcaagtacaaggccgaggacagacccagtgcactcttatcagtcatctgaaatatgcacagcctttccaagacaaatgtgcactcctgtttctaggaaaacaccagaaagtacttaccaattaccctgtatatgctgtgtggaaaaagacaacatcagcctaccctgaaagccataacaaagcagattcctccgggccgccgacagctgagtggcccgagttagagcctctgcagaatcccagcctgtggcctgggccaggtccaggtccaggtccaggtccaggtccaggtccaggtccagggggcattcttcccctcgcatgattaccacgtccctcaccctttgcccaaggaactgacctcatcttagaagaagtctcaagggttggtgtgttcttactaagtgcccaggattttcttccagacccatcacaaatccaaagatggctctcctgaagagaggcctaaaaaagagggtgcggcccagggggatctattatagtaataaccgcaggaacgagagccgccgctggtgggcagctcaccatccgccaggagcaggcttggcgggcactgttttatttggtcttcacagcagtcctctaaggtaggtgtcatcgtcctgtttcagagagaaaacggaaactgagggttaaggaaggtaaccaacttatccatgatcacatggccagaaaatggtagaggcaggattcaaagtcaaatgagggtctttaaccgctatttcatggtgtattcacaggcagtactgtaggttaattctgttcactaaatgtaaagtatgtctcgtattacagagtgcttttgtcttagtgagaaaggaaaatcattttaacctgcacacttaacctcttggctttatgtccatttacccatctaggactcaagcacagagggttcggaaaccgcgttgctgcacggggccccaggggctgcttccccgatattctgagagccaggcggaaggacaggagcagctcttcaaactcacagacaacatacaggacgaattgtaagttagagcatgggaaaccagccctgtgggtctactgagttgcctcttcttttgatcctgagaagtctccatctgatctgagttattttcatgactcttggaccttagatctggtcaaagaattccttgccccaaatgttttttagatttagatataactgatgctaaacagccttttactcaaagcagtggttctcaactgtgtgccatagcctggccttagtgttttgtttctagaaaatgacagtctctttctagttagttcaaagagagaagatcatgaataaaatgttctcaattttaaggtttttctcctgtaaaaatttcttaaagtttgatatcccatttttgccgcagaatgctagcaaaacaaaacagaaaaacaaatagcaaacaactaatagttggacattttggaaatgtatttttcgtaagattgcttcgttactctttaaatatggagccttatataccttgtcatatcttcagttagtgatattattcctagttgacacggtagagttaagtatttcactattttaggatattttgcagagatccttgtagcatgaaagtgctctataacctgaataggtgttagaaccaccagcccacagaaagcagttagttgtgtctgggagtagcaaaatactagattaatttcttctgatgcttatttgccatctcctttaaggtaaagcgagcgtgggggattctgagtgctgtgggtgtttttcggtgggtggaggaatgtctgaaatagacgtcaactgtcaggatagtcttcagagtcattgttagggacagtgttaagtagatctcatctcatagtttcatggtagtatttgaatggggatatcaaaagccaactccagaaggtatttgttgcttgccggatagaatggcatcttcctacatgtgccttgtgtgacccctgtggtgttattagaaggtctcttgaagatggagttgtactttcttgtttcgtctacttgggttgccattataaaatatgataggctgggcagcttaagcaacagaaatttgtcttctcacagttctaaaggctgagaggtccaggatcaaggcatcttctgattctgctgctgctgggggttctcttcctggcttgcagatagccctcttctcactgtgtccccacattgcagagagagagggggagctctctggtgtctcttataagggtactaatcctatcagctcagggccccaaccttatgacttaatttaactgtaattactttcttactccaaatggtcacattggggttagggcttccacatatgaattggcggggagggggtaactctgtccacagcaggtgttgctaataggttctgccgtttcagtccagtgcccagagtgcccatcagttcactccagaactgctccagttcattccttggggcagggatttggtaccatgactgctcttgatattgctttgtagatggaacttttagcctttggatggggggtctagagaccccccatccaaatttctcaggtctggcaggatgtggtgcagagtctactacaatggcagccctgtgaggctgggatttttgcctgttccattcaggaaagaatcctcagcacatagaacagtgcctggcatctaataggtacccagtacatatagccagatagctgcagttcagcatttgtgttcacatgcgtccattttccattcatttgggggttttttagtcacaggctaaatgagattataaattattgcatgttttcttttcactttcctccccaactcacctctattcaagtcgaactatctctggtcactgtgaaatttgtttgcaatagaagaaattgcgtggtacagccaacataggactgctcccagtgagatacacacattgaaaaacagagccagagagagctaaaaactggaatcgaaatgaaatcagtaaaatagctttcatgaaactcatgaaattcatatgaactaggaagagatattggcatgaatgaattttgactttaaagatgaaaaccatgtgtctccacccaagttgtgggttaaatcttgccaatgaatgctgaaggaggcacgtgaccacggccttcccaagtgtacaaggaagaagccatcagggagtgtgtcgcatgttcctctgaagtgtcctcagttgtcagcctgggtcttcgcggtggagtgaacattacactcatcactctgcaagaaaggagttttcaggaaaagcccacgagcgccaaattatacctctgacttttatcctagatttgtaattaaaaacatgtttaaagacctaattatttgcgtatttcccttcagagttaacccctttaaaggatctttaataccttgctctactgttctgactaaatgtttccacatttttttccagttaggctcactgtttcacttctggaaaatattgtgtaattatttcccgatggagtgaaaaccccacgaagtccccagtgccttggtgacttcaactttattctcccagatcgagttgcatttaattttgtcattctatttaattaattaatattaaaaagatagttaccaacgtatgatttctggtctggccagctgaaaagtcttcactttcaaattaatcatatattcctctgataagttgcacaattgtcattgcttcccatctttctcagttttggttttgaaacaggatctggattaagatgatgttaaagtaaaatttgtcctatatggtgaaattaatttttctttctaactcatgtctcatttgtagccagaaactcattttcttttttttaaggtacctattttatttctaatactgcatcacctataacggtgcacaccaggctggtgagcagtagggtggctcctgccttttaaaaaatgctcatgagcaacccacatgacctacgaagctgctctaatgtactgctttctggaattaagacaatttaaattgtacttttaaaatatagttttagaaagtaacatttatgggattttttaaatacagaaaagtataaaaaataaaagtaccctatgcatccaccagccagataagttgttcctcttttcaattttttgtagagatgaggtctcgccatgttgcccaggctggtccgaactcctggcctcaagtcatcctcccacctcagcctcccaaagagctatgaggccaaagtgggaggatcgcttgaggccgggagttcaagaccagcctgagcaacatggcaaaaccccatccatacaaaagttagccgggcatggtggcacacacctctatccccagctacttgggaagctgaggtgggaggatggtttgagcctgggaggtcaaggctgcagtgagctgagatcacgccactgcactccagcctgggtgacagagtgagaccctgtctcaaaaagatactcatatgcatggttagcaaatccaagagtatagaagaaaataaaatcaagagtaaaagtctcttttcttatctactttgtaaacatgctgtttacgatttttgtatcttgtctccttgagaaatttcacagagagagagcaatcaggaaaatttttgagcgcaccatataatattgattctaatagcatatcattataaatacaaaccttatagtaacatatgtagtctcaaggactatatatgtttcattccttctgaggaatggaatagaatttattagcttccatttcctaaaccaggaaataatgtactagtaactgttgacacttacagaattggccatttgttgatacacctctgaattaaaacttggatttggcagatggctcagctactctgataaagttaaaggtttgctaaatctttaaaagctaaatcaggagttctaagagaagttttcaactttcctactggtaacatgtgtccagcatccaaagttgcctgtgcactggcaaatttcttgccttaccctaatgccagtgtcattttctgagacagactaacgcatacatttattgaatcctactatgtgccagggtgagtaagaaatttcctctgtcctcagtgcgttcacagtttagcaggggaagcagacactgtattaccaacaacctataacatatattgctgttaaaatagaagtatgagcaacgtattatggaaccacagatgggaagtgattaatttatactggaaagccagggaaggcttcacagagaaggcgctggatgagtcgcctgaccttgcaggaggcggaggaatgtgccaaggagagaaggcgcctgggcagagcacagtgctgggcagatacacgggacagaagagctcacggcaggtctggggaatttggggtcagctttttgtagcagcagcacgtgtggaaagaaggagcagaggctggaagggtgggttcccaggcctgttgctgaaggctgaccttagtggtcatgccgaggagcttgcctctcctgtaggtgggagtgagattgtgaggaagaggatcccactcaaaattcgtcatgaaaaataaaaccttgacagcagcaggtagagagactgaaggcaggaagccagttaggaggcccgtgggatagtccaggtagaaggtggagaggcctgaacacagtggccgtaacgatgactagaagaggacagattggagaggcatttaggaggcagcatcagtggaaccctcaactgctaaattggaatctgagtgaggaggagggttgagagtggcttcgggctccttgcctgtctggttgatgaggctgggggtgctgaagagcaagggttggagaaggagcatctccccagtggacgagctgaggtcccctgaagagggcctggcactcagagcgacactgggcccagacatggagtcagggccataggtggacctggggtgggtaacgcctaggggtagaggagcctgttccaggagctctgagtcaggcttctgattttgaaatgactccagagggagtagaatcaggtatataaatgagttaatatcgaaaaaaaaaaaaaagagcaggaggaaaattaagtagagtggctgaaacagttacttggcagatttctccctgagagaagctggtcatgagtctgttttccatgtggccttctagagagacatctctctccaatctgctgatgagaggatgtgtggggaaaggaggggtcatcccccacaggtttggggtaactgggcacctgttctcaacagaagagctaccattaactgcggatctcttctgtgtggggcacgtagattagctcacaccatcacagtggccctgcagagtagacccatggggttctacacatcaggatggggaagctctgggcaaagtgagaggcggagacgactggcatcagggtggctggctcccctggcgaggctgcagtgtggcttgggaggacgttgtgacctgccccagaggaggcctgaggctgctgttgatgctaccatggctgctgttgttgagaatgccccgtggttcatggtttatggatgacattagtgatggtgcattctactaaggcggcactggctcctggcagattcacccactcttagcacctgtcatcttggaaaagggtgtaagctggtgctgcagccttcccttctctcagaagaaactttctgacactgagccccaagcccagagtatcctctttctctccttaaaggggagttaaaacttttttctttcttcttcttctttttttttttaatagagatggggtctcactatgtggcccaggatggtctcaaactcctgggctccagcgatcctcccacctcagcttcccaaagtgctgggattataggtgggagccaccatgctctgccctaagagttgaaacttttaaccgaggtttaagaatagtataaaaatcctattttttaaatagaatcaattatagtatctacagcaacctaaaatgtgtcaactgaatactgaggtgacttctctaggtctcagattggaaggataaagcttatctgatgctgtgtgtttctggctgcatttttttgctcccctttcctctcagttaatagcagatcagagaacagaaggagtttgctcagggccacctgagaccacggtggccttcttcccttgaggtttttccaacagtcactcattcgtggaccaaaagcaggccttgcgggaagcttgattctaagggcagtgaagacaggagagcctggggttgagactacaaagcagtgtgagcactcaaggaacctcaagtgaggcaaaggaaagcctgggagaactaggccagggaaggggaattacctgtggctttagggaaagggaacggaagaaggtgcagcttggcagaggggagggcggggagcgtgccgcgtttgccaggcttctcttaccaccctgagttttgctgcttctctcacagagtgacaagtttgatatgaggctccattagataaggggtctggtctggagctgtttaattattctttgatgtgtttggcagattttgtaaaaaaaagaaaaagaaaaaattaaaattaataataataacgatgatgatgcaacccaaagccctggccattgtgggatgcaggaaagcctcaggaggatgatggggacagagctgtggccacctggtccctggggtcactgcccagttccagctgtggcctcactctctcccttctccttcttcagccagacccttggctctgatctgcttttgatttgaaaggactttagaacatttcatgcacaatttccagaaatatgttattatcagtagcagcttcggggcatgcacagggtcctggacttacaggacagagatccgtgtggagtgacagcactgccttcctccacttacctttctgtatgaccatgaattccttgacctccgtgctcactttgtgaagaaaactggcagggattaccctctccatcagagagatgaaagagtctgagctaccaagaaagcaacggactcggccagagtcagccagcgggccgggctttcctgccagctcggcctgtgtttccttcgctgtgctctctacttttccggagggcgtcccagctcagagtcacccctcctccagaagtggttctggcctgatggaggacttgaaccatctggggcatcttggaaaagagtctgtttgaaagcctatagaagtgttccaggatggaaagcacactagtcatgtcggccactctggcctgggtgtgagagcatctgcccggatgggaagcccttggctgacatgtaaatgtcagctatgtcaagtgcccagggtggtggcgctgggggctgggggctgggggctgggcaatgaggtggaagtgcctgtgctgtgctcacctagaggaaggaacctcacatctcagttggatttttcatgcacattcctgctgtcatcccaatcatggtggccaactttggagtctccttggagagcctgtgacggcctcagtggctgtgcaccaggcccaccgatgctcaggggtgtaggctgcttccgggtctcatctcagatccccgccagttctggctggcgctgtgtcacctcttctctgtgtcaggatcatttttatccctctctgtctgtctttctgtctttccctgtgccctcctttcttccccggaccagctatttcagattccattcaactctgttcagtgatgctgccgctctcaatgcggttagagcgcaagatgtgagaacgtctgtgctgagtggcctaaacactgaaggctgcgggtctttctaatttcagcattgagactttacaagtccacattcttggcattgccaaccagttagaatagaacaataaatcccagtttttgtcatgggcgtctgtaattaaaatggcaactggaacaaggcagtcacttactgagcgctgatggggtggccaactctgtggggtgctcaggaagacacggggctgtgagatatggactccacttagagggctcacctcgtagtcagcaaagagacttatccaggacatgtggaaagaatgagtttgtgcttggccatgctttgggggccatcacaattaaatgctcaaaagtggaggaggggctggagtatgtgggggatgcttcacagagaagttagaacctgtgatccttgcggggagggggatgggatctagagaagttgggagagcaggtgtgcgtcctgcacggaccccaagtgagcgagggcccggcagcctgctcccctcgacaggcaggccacctcctgcccccaggcttctgcccccttcagaggacctgggaacaacgccgttctggacccaggtttcagaacacttccaggtggagcctggctctgagcaattcagtttgccagcaggagctcgactgccactccgtcgtcagcctttagtattcctgccactgtccatccttgtctgctgtccctggacactgcagccccattgtgaagggctgtcacaagatgcaggggaggcagccaggcccgggagaactgtcacactgttcccaaggttcactgctcttcattcagtggccagagaggtttgatgtgcataaatttccactttgaatgtgtgagctccatgatagaggaattcagttttgttggagtggccctaaagctcctgaagtaacaactagaagtttccaaaaggaagatgacagttttacctaagaaagcgttttctgactctttgagttttctgaacatgaagtggatgggggggtgccctgtccctggaggtgctgagcttagagagggaggaagcggatggggaggtgcaggtgttttaacgccaggctgtctcttcatggcgtgccatttggtgaacctgtttaattctgcttttcccccctcagctttcagcgcccccagctgcgtcttctcgccccttcatgtttccctctcctctgccaggcagtgaactttctcagctgctccttcagtttcacattgaaaggcatcgtgttttctgttttgtccaatagagtattgttacagttttctgtaagctttaagctatccaaaaatgctcacagaaaaacaacaaacacccacaagatagaatttcaggatttagaagtatttcccggcaagggggccgggattcgcactcaggccctggggccacagagcccgcagtgggcctccccctgatgctgggcgaagccccaggtgtcactcctgtgttcccgtctcgctttgcagcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtgagtgcctggctgttctcaggctcctgaggggcggggccagggcctcgatgcctctgccctgcttccccgtcctcagcaggaactcatttaggaggttgaggctgggcccttcccaggagtgctgcctctcagtcctgaacatgggaggggcccagggtatgttcacggggcgatgctgccctcccagctggcccatgggtgaccctgggaacattaactgcctcacaacgtttgtgcctcagttacccgtagatgtagtgagggtaacaatacttactctcgttggtgataaggaacagctaacacaacacacagggtttttctgctcccaaaatgggattcttcagtgcaccaaatcgaagaaagcactggagctcacgctggtttctccattgtttctccttaacagtggaaaccgtaacttttgttctagtagcatctagcatgctcaataattatttgtaaataaaagttatactttccctccaaaggggacaaggtattgttatgacaaggcttttaaataataaagctcctgcgaatagctaacgttcctagagggctggctgtcttgtgggttgtctgatcactgtgttgctgtcatcccctcctcactattggtcatagcaggtgattcattcaaggctacacagctgaccttgaggagccggggttcaaatccgagtggcttggcaccagagctggctgcagagcctcttgcggatctgtctctggccagtcggccctggaggcttgccatgacacccaggtgttagtcctgctcattctcacccggcatacccggattttgaagcttgcattcaagaatgatacattaatcaaaagggcctgcccacctctgctctctctatggatcggaaatagcgccagccttattgggcctctctcctccggagtcctttggcctccccctgctcatgaatgcatttgggcctgtttggacttgtgtaaggctcccgtggggtcattggcttaagttagagctggctgatgaagagggcgagcacctcaaagtgtgagtatttctccagatcccttcactgtagcaggtgggcagcctcgcccactatacttctgcccctttcaaagcaggtgggcagagaggtgtttgtggtaagaaagacctagaggcttttgttcgctgattcttcttccttcatcagccatcaccagaccttagatgtgaatcccccattcttgctcttggtcttacctctgcagatcagttatggccgtgggggggagttcccaaatgtcaggtgagtatgggttggctgtacagtcctggggaatgtttaaaaagaccggctgggcgcagtggctcatgcctgtaatcccagcactttgggaggccgaggcgggcggatcacgaggtcaggagttcgagaccatcctggctaacacggtgaaaccccatctctacttaaaaaaaaaaaaaaaaaaaaaaatcgttagctgtgcacatgcctgtagtcccagctactcgggaggctgaggcaggagaatcgcttgaacccgggaggcggaggttgcagtgaaccaagattgcgcctaggcgacagagactccgtctcaaaaaaaaaaaaaaaattgcagggacccaccccagacttgtgagtgcgagtgaagcaggagcagccctggccatcactgtttctttgacgtgtacatcccatcctgagatgcagctgggctgggagccgccacctgggtggatctgattcctggatttccccatcctggggacaggtgacccatcctgttctcctccttaggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctacaaccttgtcacatgtagctgagtctgggatgactcagtggatcagtggatgcgtggaaggttttggtgtttataactcatgacccaaatccttccaagacacaaatgaagctaatcttcttcccctccctttcctctcccacttcccctctgtgtctgtgtctgtgtgtgtgtgtgtgtgtgtgtgtgtgcgcgcgcgcgcgtgcatgcagagaggaaggaagggagctttagcacaagtagctacatagtgttcaaggatcagctttcttgaactccgaggcttggttgcctttgctgaactccaagttagtggattgcagaatggaaacttggcttttgcggcactgggtgagttttagtttgtgtgtgtcttgctggggggtggtgatgattgtctcagcactcacgcactgcacaagatggcagcaggatacagcactgcacaagatggcagctcctctgcagcttcctcctcagcctccctccttgcacccccacaggtttggcttgtggtttttgtcatcagtaacctactgcctgagatcatgatctcttaaaagatgagactctcggaagggttgattgtatgcgtcagtgagccttctatcaccttctggaacaaagtcacttgaaatctcttgatgagattaaggagtttagtgttactaagaaaatctgctttgggccgcagcagtgctgggtgttctcagacctgactgaggaagttagctgcgggctgccctgtgggctggtgcttcaggaggaatccagagaagtgttcagatgccccccttgggctcctttctaattttaatcagctctttaaatagctgcccatctcctgtgattgcacaaccaagcactttgacatttgcaccttaggagaggcagatgttaaaatggaatccaaagaccacctagggcggggctgggtgggagatgggagggccaactgcgagctgctccacttctcagctctcccctgccctgcagccctgggccagacaaggccagaaggtttcaggggcatttgacatcccctcctggttctcaccaggaaaacatccaaagctttggaggaaacaggccctgcccctggctccttaaatgccccgtctctttgtaaactgatattcagccagcaatgcctaagactttgttaagatcatttctactgcttttctttctgcttcaaacacacagttcgtctctgaggaaagtaaaataaatggaataagagtaaattgggtaaggagatatccaaagctacccagtcccttgacccagcacagttggccgacccgtgtcactccctggctgtcgctgcttctctgtgctcactgaagggtgagccaggccagtgcttccccagcccctgggcctggtcactacacagtggaaaacagacaagcggccccttccccaaatcccaagagtgtcttgctgcttggtgggtgctcatcgcaatgttctgaaggctccagggccactttgtttgtaagtatgatctgggcctcaaaataccatagtagctgcttgataaaattctaaaaatatctggttctctattatgtaaacactattacagtcaccagtgtgtgaagactcttgagtctggttctcatatcagagtcatcatttttcttcctgtggaataaaatgccttgtggacttcccaaacttgttcttttgttttcttctggtctcttggtgatccacagcttctagagctatcaccagtgacaaataccaaacatagtgtgatgttcacaataaaatgtggcctctgcccccaggcctggggaagcacccccacaccttaaccagtctcagcctcccaagagtaagtagtagtctccgcgctacactggctgctgatcagtccattctgaggttcctggtccaagccccagcaggacagacgtcacacttagggtttaggcagctgaagaagaaacagcaaaggaggccgggcatggtgactcatgcctgtaatcccagcactttgggaggctgaggcaggcggatcacaaggtcaggagattgagaccatcctggctaacatgatgaaacctcatctctaaccccgactatatcgcccctctctattccatccactccacctcaaaattaataaccttgtgtgtcgcccaaattttcaccacgttatataattatgtgtataactaaaactacaaaaaattagctgggcatggtggtgggcgcctgtagtcccagctacttgggaggctgaggcaggagaatcacttgaacccgggaggcggaggttgcagtgagccgagatcacaccgctgcactccagcctggcacaacagcctggcaactctgtctcaacaacaacaacaacaacaacaaaacagcaaaggaggctcagcaggatcatccagagatggagtgacaccaggagggtatggatcctagaagctgaggccagaaaggtttcaaagactaccgagggctgctactaagtcaggtgggattcggaccaacaattatcagtggacctagcaatgctgaagtcactagagacctttctaagagctgtttcaatggagcattggaggtgaaagccgggttggagtagattcaagaggaaaatggaaggagagaaataacaacagctctctacaggaatctggccataaatggagagaactgaccggaaattcaagagggcagggaaggaataagggagaagagggcctggcgggccaggaagatgggtggaggtgggggagcttgagattccattgattgctcctgatttctcacatcaggcaagaatgaatacagggcgggaagtgatgctgatttggagagagagaaggtgcacgtagtcatgtagggtaacgggaaagggaataggccacagaagcatggtatgtttgccgggcgacattaaggacccatttgacgttgatgaccgtgaatgtacagtggaatcgggcagcctggctgtattcttgtccggccacatgtagctgcacagcttcagtgttgtagaacaggcaaagaactggctttaatcaagaaatgttcccctcacctattcaagtacctcatccaccattgcccagttgaactggccaagagccaatcagaacaaaatgtcaacagaaatccaaaagcctagagaagggaggggctacgctttccaaaccaaagcacagcttctgaagactatgccccttccaagtgggagagacagtggaaggtgtggttaacaacccccacacgcgcacacaattagactcttttcaggggttcacagatgcagtgggacagtcagtgtttgacagtgaaccagccaggcactccagggcatggggatgtcattgacatagaaagggtatgtgtatgacgatcttccatttcctcagccgaattcagcaagccgtcttgcaggtattggttggctgcaaacacagctttcaccccagctctttagaccaagaatgtgatttctagcaccgtaagagatacttgatgtttgctgttcactggacactgcatcccaagaccctaataacagaaagtgcttcctgaaaacacacccaagcatgttcattattatttagaagtttggattaacctggaagagcacttcttcaggaaattggaagtgagattgcactcgcatctgcaagggtcttgaagatcatccaagttgtggctctctggctgagggcatgataaaagcaatcataaagaccaaagaaagggactgtaaacctagcgctttaggaagccaagccaggaggatcaagaccagcctgggcaacagagggagac

SEQ ID NO: 7330 - DNA, 4802 bp, Homo sapiens
agtttgctggaacattatcagatggcttacggaagacgatggacaatcggcatcagtcagagcgggagtacatcaggtaccatgcagccacaagtggtgaacaccttgtagccggcatccatggcctggctcatggtaagtcatgggtgacatcaggctctgctgctgctggtcctcagaggcgcctttgtatcaatctgattgcagctataaaaaaagaaaggtgggctgggcgcggtggctcatgcttgtaatcccagcattttgggaggcctaggagagtggatcatgaggtcaggagtttgagaccagcctggccaacacagtgaaaccccgcctctactaagaatacaaaaattaggccaggcacagtggctcaatcctgtaatcccagcattttgggaggtcgaggcgggtggatcatttgaggtcaggagtttgagaccagtctggccaacatggtggaaccccatctctatcaaaaatacgaaaattagacaggcgtggtggtacatgcctgtagtcccagctactcgggaggctgaggcaggagaattgctcgaaccctggaggcagaggttgcaatgagctgagatcgtgccactgcactccagcctggcaacagagcaagactccaattcaaaaaaaaaaaaaaaaaaaaaaagaaaaggctgacaacagaggaaatcctgtgttggcgtacctgatagccttccaagctctcttactttatcctccttgcagttgaaatacgacagccggtgagaactcctcattcgctttctgaatgttgtgcacattgcaattccttttcgttctctggcttctgttcccaaagtatcataaggtgtaatcaaccagacctgttcttagaattgtagctgctacttctcttagaattgtaacctctgccttctccttactgatcattccttccaaagaaatggaaatgaggaatttgtggccaggtttgtagcccaggtgttttttagttttacataaatgtgcattcactaaaattataaatttatttgcctaagagatgttggtgatggcatgaatgcatttggtctctgactttgaattcttttaatgctttaattctgagtcatttgccttttgttgcatttttcttaacaatttcttagtacggcatccaaggcccttggaactataaatccagccaattttccaaccaccatccttcagccatgctgcactttggccacacacagctatgtactgcttcccaggtgtgcttccaagtccttgctcacacatggtccttctgctctccctcctctgcctcatttccttgtctatcaaaatcctactcagcctgtaagtcccaactcaatacattttcccagctctattgtccctgttagagttaatgacagagcacagtctgggttgtgtatgtcaccagctgtgtacatctgatagattgagaatgtgaggaggggagaaggaccactttgcattcacctttctccttgtgtacctcacatgacacctggcacatagctcatgcatagtaaggcttagtaaattaaactctttgtaccagatccttaggaaccatccaaagctatcagagtcatatcaaacctgatcagttttaattatctgcatttgaaaaagatgaaggaatatagacagtgcaatattatatttctatttgtgcttagggcacgtttagatagaagtttttgttgatcagctttcctaatggtgagatttggatcaaaatgcgtttgcttttcgtaaggctgcccatccgtaaagggagctgtccctaaggagacgtcaggccagaagtgaaatttggctgaaagtgatttgtttatggattttaaaagttgactgttgggcaatcatttggggttaaggtttaatcattctttctcgtaatggtaatgacagtacattggtctcttagaagacttttaaaatgaatataaaatgctttgttatgtgtggtggcctttatctggccagcatccttgtgacgtggagagagcatggctctcctcactttctggatgaacacacaaatgtgctgagaaaatgcatgattggttcaaagttgcaaaatcacctcccatcaagaatcattcctataatatgtacagcctctccaggagccaatggcttcatccaaagaggatccactgagctctgggttatacgaaggcagtatcctagagtgagagtcttcccttaggatgaaaagacctttagaaggtgataagaaccagaatccactcaatccccttgatgtaagaaatgggaattgtgctcagttctctctgcaggccttgctggacccaggttcagtcatgttctgtctctcaggtcccagtctgaattcctgttctgtgtgtgctctgccaaaaactttgttcaaaagtttgggaaagggctgggtgcagtggctcaggacagtaagcccagcactttggaagacctagagggagaatcgcttgagcccaggagtttaaggctgcagcaagcggtaatcatgccactgcactcctgcctgggtgatagacggacaccctgtttctaaaaaaaaaaaaagtttgggaaagagatattgcctcactggagcaaatttacccagaatccaaaagaaatgttgtgaattgttagtacattctcacccaaggagtttcctttaccaatttgtctcactagagctgaagagtctagagagcttcctcacaccccactgtcagagggtaaacatcctgtgagtgtccctggcacaggtcctggagatgctccctagacgggctgcctcttcccttcagtgactgtgacctcttcagcctctgccagcttctggcctcttctaaggtgttttcagccattgctgtcaacttgcaaaatgtttggaatgcctttttgacctggattggtcttttgaactgactccattgagggtcccagccagctttcacagctttttggggtgctcttcatgaaggttttatataatcgccgataccgaatttcatcaaagcatgcagtagcttttaccttatttcaagcatccagtggggttggccagtcacccccatagtgttctttgaaaattgcaaatgtataccatcagctctccatatccacagattcagccaaccatggatggaaaatatttggggggaaaaaagatttcacgaagtgccagaaagcaaaatttgaatttgccacacgtttcaaatactgtattgactccacacaaatgaagtgatatgtgggcatcgtattagctacaataaataatctagaggtgatttaacgtatacaggacggtgtgtgtaggttatatgcaaacacctacagcacattatgtaagggacttgagcatcctaggattttggtatctgcaggggatcctggatcaatcccacatggatactaaggaacaactacatttagttatctctctctgccttagatatctttcttttcttttctttttttttttttttttgagacagtctcgctcggtcgccagactggagtgcaatgctgcgatctcggctcactgcaacctctgtctcctgggttcaagcaattctcctgccttagcctcccgagtagctgggactacaggcacgcatcaccacgcccagctaatttttgtatttttagtaaagatggggtttcaccatgttggccaggatggtctcgatctcttgacctcgtgatctgcccgccgcagcctcccaaagtgctgggattatgggcgtgagccactgcgcccagcctctgccttatatttcataggatgccatcatcttcaaactttccccgaaggcccaattttctagtctcctgttgatttaatcctctatctgtatcctctcctgatcgtccgtaggctgcccaagctctgggatcgaaaaattggccactgttaacctctcagcttttctctgatttttttttttttttttttttgaactggagcacactttacttctgactaacatgtaacatatatcctctgactctggacttaatgggcaaatctgcaggatcctcttctgtgagttggcctgtctgtggcctctctggcacagagattaatagaatggccttaagttatcattccataatcaaggggtttggctttaaatgcttttgcttttgtcctcgtcaggttacaacagcccttgtctttttcactaggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggtcagtggtgtgggaagaatggcttttgcagtttccagcctaggtctgctgcttctcctaatccatactgatgtgtttaattgtgcactttcttagttatagggtttttaattcaaatacttgtaactgaaatttctgatctgcctaatataaaaagatgaaaatgaggtacagaaacctggcatgaattttttcagataaatatatatatagcatattttatatatgctatatattttatatatgtatgtatatatagcatattatatataagtatgtataactatattatgttatttttctccattagagaggtcagaattaggattaaactgttagaagcttcttctgttcaccaagccaactggatccccacatgcctatgaagaaaactgtcagattg

SEQ ID NO: 7331 - DNA, 274 bp, Homo sapiens
ttttttttgagatggagtctcgctctgtcacccaggctggagtgcagtggcgcgatgtcggctcactgcaagctcagcctcccgggttcaggccgttctcctgcctcagcctcctgagtagctgggactacaggtacctgcaaccacgcccggccaattttttgtatttttagtagagacggggtttcactacgttagccaggatggtctcaatctcctgacctcgtgatccgcccgcctcagcctcccaaagtgctgggattacaggcgtgag

SEQ ID NO: 7332 - DNA, 425 bp, Homo sapiens
tccccactgttgttgttcaccatgtgggtctgttccttcttaattttccttccgcttgaaagtatcagccccaaccccataaagaaaagtgccaccccccatccccccagcaggtcagcagttctgctgtgggattgctgtctggccttgataccagctgagactggaaatcagggacagcccatatggttccaaaccccacagaacccaactgctttaacgtagctgtttgcttgaatggcctattttagcctcccttttccagagtgactaattggggattcttatcaacaaagggtataatgaatgttaagggcccagccaagctagactcgacttaagcccagaaggattttgctgctgcttggataatagattttccctgagtgaattagtacgcccttttagaatgcctagggcctggc

SEQ ID NO: 7333 - DNA, 16037 bp, Homo sapiens
cgcggcgagcgcagcagcagggccgggtcctgcgcctcgggggtcggcgtccaggctcggagcgcggcacggagacggcggcagcgctggactaggtggcaggtgagggcgtccccgcgcacggctggggtaggggacgggagtggcgagcttcaggtccaccggctgccaccgagtgatgggaccggaggacaggagaggtcgctcagccaagagccccggggaggcggtgccttctcggtggggtcagcaacggtctctggggggtgcctgggagcggcagccggtctccgccttggcggcccacagccaccgcggacgcctccctcccggatgtctcctcgctgcccttccctggccgaagccctcccctgcagcctcctccccacctgccggccctgtgttctcactgctcttctctgctctgggatccgcaggatgacgtctgtcctgcttcttcactgtcctttacagtcaccagtctcggccgggcgcagtggctcacgcctgtaatcccagcactttgggaggccaaggcggtcggatccttggagatcaggagttcgagaccagtctggcaaacgtggtgaaaaccggtctctactaaaaatacagaaattagccgggcatggtggcccacgcctgtaataatgtcagctatgtgctgaggcaggaaaatcacttcaactcgggaggcagaggttgcagtgagctgggattgcgccactgcactccagcctggcagacagagtgagacttcgtctcaaaacaaaaaaaagaaaaacacaaaaaaaccaccaccaacaacaacaaaaaaataaagccaccagtctcggagtttcaaatctgagcactcttatccatcttaattctttcaataattcagctaaacgaatggggtcctgagaatctgcagagccaggctcagcgctcgcctgcagagcctgcggtctgtggggaccaccagcaagatgaggaatcaccttcgggaggaagggtcgtgctggggagggtcgcgccggcggggtcaagagaacctcctccagggtgggaatcagagcctccgggccgcggtgtttgagggtgagtggaattaatgccgtgatggacatggggccttctaagggggaccaacagtgtttgtgaagagttgactttgggaggggttcaggatggccagaggtggaggctgtgacctcagtgagtctggatcaagggagggggcaggtgggtaagacaccgttttaacaaggtggctttgagcggccacctttgaggggcctaagggcccctgggagatttaggaggaaggacaagaggattaagacaccgctttctgaggtgccgtgtggctgtggcgtgggggtggctgggggagtgggttgtgttcattgtccaaggctctccagcgctttgcgtggcgttttggggagcacagatgaggtgtcccgacagtggggagtggctctagggagaccagaggctcgggagggggcctgggcattagaccaggcacagaatccgaagtgggaagaaatgtgggcgtagagggcaggccttggggatgggtgtgggggaggagggggagatggaaaggagtcagggaggtctcccaggctcacctggaggagtcagggtctcatttccaagtgcactgggaactgcagcctgggggtgggggttcatttggtttcaggcctgtggccaagagacccaccccctcacattcacactttggtctccagtggcttcacaggcaccacctccttgttctcgcctgttttactcctcaccttgggctgtttcttgcctttccattctggcgttctgcagggatcagatccttcctctcacgcacaatctacactcatggcttttgctgggagtaatgagtaaagctcccaaatagatgtttctgagttaggaagcacattaaaaacaaaacaaaacgaagcaaaaccacacaattgtccaagtcccactctgtgttcaagggtcacatgatgtgcagaagctggtgatgggcaggagctctgaatggagttactgggatgtcaggccgcgtgggcctggggcaggctggctgactgggagcagcctggctccaccccggctgtccaggacgcactcacttgcctctatggatgacagctccttgcctcacagctgtctgtctctgggtcagattcagcatctcagtgtcttttgtgtatcagctgaatgtcagggaggccacaggctggtgcccagttgaaaatctcacaaggactctttgtaaatgcatgcaagaataagaacagcattttcctcctcctccctgaccccattctcctcctcagatgggacgatctggtccttacggaaagaattggagttcactgcttccagctctgtgtgtgtgtgtgtgtgtgtgtgtgagagagcgagctctgcaggcgagccagttctgttgctattgctggtttgagctgctgccatcaccacacttagctaattaccttaacatttgcacttaatttttggccggagactaacagaaaataaatttttctccaatttaaaatacttacgaactttaagaagaaaacaaaaagtacgattccaaaattgccctgtagtaagtaggtcagtaacattcagggagtgtggaaactgcatttctctttattcttcccttccaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggtaagcttgcccgtccgccaggagcagggactggcctgggctgcgtgttctgtcaccagcttcacactcacactccagagccactgagaaaggagggcaggactggggcccgagtgtgcactggccgtttcagggaggcggggtccactggggaagaagtggggcagggcagggaggcaggaactctgctccaccgagatttatttgggggaaactttcctcggttaatcccttggaaaagaccatccaagctgtcttgtcctagcgcagaatctttctttagaaaatgacactgaaattatttgaaacataagttgcaaagaactacctcttttttggagcaagagactttgtaactaaactttcattggtaaggaaggttaatacctgtttcaagttgtttctgtaccaacagctcagggagggcatcaacagaaatttgcaagaaggattccagggcaagtgcttcattacagctgcacactgtgcaggtactgctcagctcagtctcaccaacattcagagaacctgtggaaatgattcaagatcagtgcttgtccccagacctttgtggaaaggagaggagacatacacgtgagatgaaaccgaaaagcgccatccctgagtgcaggccgctggacacgccttcatcatgggagttgtcctttgttcaatatgactgtctttttctttgatgacgcttttcaatagtgaattactcattttaataatttcccagctcattgtgtgaagaagggagggtttatgtgtaaaggctaccagccttaataataagcacagagaggctctctaaaagatatatatatttggaaatagggcattgcaatgaaaatacgcatgccatggcaagctatgtgcacattcagggaggtgaaataacactaagatttttaaaggaaaaagtaaagaggattacataattcctttgaaataattatttttggcaaaaagatcaataacgaaggtgatgtcagtgtgaggttggatggggagttcctgggtagatgtccttgcacaagtattttgttgtgtaaggctgtgatggcctttgtgcaagagcgtaggtttttagagtcctttgtgatagttgtgttatcaggcattcaagcgtgagaaccctctcttcatggccttccctgtctgtttgtcaaaggtttttggttttgtttttttaatattagtgactccattttgattctgaagttccttatgctgaaatctgtatgatctttttctatgttttaggctcactgataaacccttatagaaagcttttttgagagcaccaaaattgtctgggtaccttcttaggtgtgagactgagctctctccatggctccagtgttcaactggatgcttgtgagacaccaaacatactgagtacacgttgctacctgtaacatgcagggaagcgttaatggcagcagaaatattttaaagaattatttatttttccttcattatataactggtaaaagtccactataaaaatttttaaaaaataaaagtagaagggaggaaaaaatccctatgaatccatcaaacagagacaaccacccttgataatgtaaagcatcttcctccagtcctatttctttttttttttttcgagacagagtcttgctctgtcgcccaggctggagtgcagtggtgcgatctcagcttactgcaagctccaccccccgagttcacaccattcttccacctcagcctcccgagtagctgggactacaggtgcccgcccccacgcccagctaatttttatttttagtagagacagggtttcactgtgttagtcaggatggtctcgatcacctgacctcgtgatccacccgccttggcctcccaaagtgctgggattacaggcgtgagccactgcgcccggccctatttcctgattttcacttgacattttgtactttggtgattatatggtatctttacttttataaatgatttttcagctaatgtgaggattcggtgagacagtccatgtaaagcaagtgctcaacatgtgttggctatgaatagtaatagtggtgtcacagcctcaggtgaaattggtcttagcttttggttctgttctatttgacagggtttctcatcaacagtctatgagctgtctaaagtaaatttagtagcttcctcttttttctatgttatagaacagtgtgtattgcatgagaaatagaaattgcttgaatattagaaaaaaaaatccctcaaaagatcatctaagcctttttagaagtaattctctctctccctcttattttttttttgttcattcattgtgactgatagattctgttttttgtttgttttgtttgttttgttttgttttttgagatagagtctctgctctgtcacccaggctggagtgcagtggtgctatctcagctcactacgacctccaactcccgagttcaagttcacgtgattctcctgcctcagcctcccgagtagctgggattacaggcacatgtcaccatgcctggctagtattcatatttttgactggcatttggtaacttataatctgtactttactgaaaataattatatagagtttttgttttaacattccctttgtttatattgctgtaacctctttttcacatataactttactttggggtgctttttcttacatgtggtgggtggctgtctgttttgtatgtatgtgtgttttcttttaaagaaccagctcttggattcattgatcattttgtgtttgtcccaaaattccttgggagtttttctgtatcttttctaacataatgattttaaagttttagcattttattactttcttggtaatattgaaaacaatgctatgttttaacttatctttggccaaactctttggtctaatatatatcacccatattttgattattttctaaatcatatgtcatatacttatttagaagaatttgtttgtttgtttgttttttgagaaggagtcttgctctgttgcccaggctggagtgcagtggtatgaccttggctcactgcaacttccgcctcctgggttcaagtgattctcctgcctcagcctcccaagtagctgggattaccagcaagcatcaccacacccggctaattttcgtatttttagtagagacaggatttcgccatcttggccaggctggtcttgaactcctgacctcaagtgatctgcccgcctcggccccccaaagtgctgggattacaggcatgagccactgtgcccagcctagaagaatattttaaatatttgtttagaagaggattttttgtgttttttttttttttttgacatggtcttgctctgtctcctaggctggagtgcagcagcttgatcatagctcactgcagcctcaaagtcctgggctccagcaatcctcccatctcagccttccaagtagctgggaccacaggcacacaccatcatgcccagctaagtggagatgggatcttgcaatgttgcccaggctagcctcaaactcttgggctcaaacaatcctcctgccttggcctccaaaagtgctgggattataggcatgagccactgtgcctggcctagaaaagtattttaatttttactttgaagagttaattatttagaaaagtgttttcagtaatattttgtaggtgattttcattttgttggcattttatttataatgctgattttttgttactacattgaagttagagaatatgatctatataattctgtatttcagaatgtattgggatgttgagacttttcttatggcccaatatgtgtgatatattttgaaatatttaatatacacacatgtagtccctatagggtacaattttaataactgtgttattgtcttattaatcacattgctcatgtaatatccttgtttccttttgaggattctgatgattgtatttccgtctatttttccatgcattttttctgcttttaactttttaactgcatctttttttttcactataaattttagaggtaattttcccaccacttagggtacatttatattttccttttgatgcaagattttatcacaacctcttttctgagcttttctcacccttgtcattttttgtgtgttactgatctttaaacaagcgagatccattcaggcagaatggctacatcttttactcgcctgttttctgtcccctctctctcctctccccagccatcaaagagctatcttgataacttttaaaattatctttcacaacaggcactgtctttaaacacagaggaagacattcatcgggctttccagtcgcttctcactgaagtgaacaaggctggcacacagtacctgctgagaacggccaacaggctctttggagagaaaacttgtcagttcctctcagtaagttgaatcaatagaacaataaaagttgcattcaacatacctggtgatatagagtctgggagaaagaccctagagaaattgagaaatttatgttaaccaatttaaaaaaattgcactatttttttttctaagatggggtctcactacgttgcccaggctggtcttaaactcctggtctcaagtgatcctcctgcctgttgggattacagatgtgagccaccacgcccagcctaaacttctttttttttttaaagactgcaattctataattataccttgcattagtattgcaaaagtagtctctacttttcttgaaaggtaaaattgaaaggtaaaattctcaagttcatttctggttattcagggttcaatacatacctattcacaaactctgatattttaacatatcttcatatgatcacttttaaagagttatgtatattctttttattaaaaaaagataacatatttagaatttttggaagtttgctgacatttgtatttagcaatgcagcctcactgaacatttttctctccaaagacgtttaaggaatcctgtcttcaattctaccatgctgagctgaaggagctttcctttatcagagctgcagaagagtccaggaaacacatcaacacctgggtctcaaaaaagaccgaaggtcagaatgacaagttattgcaccttcctcccaacccgtcctcctcctgcggctcttcctattcctccttcccgcctcttatatcctctctcctcctcctctccctcctatccctcctccctctcctcacccacctccacctttccactccgccccctctaatttcacgggtgtttcagatggtcagagtagtgttgactggcagggcctcctggcatactgaaccttgatggactcataaaggttctgatcagacattcaggttttcagcaacagagatttacttttgtctattctcccaggaccagagtagctgatacaaatgtcaaaagagggccagccacggtggctctcgcctgtaatcccagcaatttataaggccgaagtggacatatcacttgaggtcaggagttcgagaccagcatgaccaacatgggtggacccccccccgcccaacatatttactaaaaatacaaaaattagccaggtgtggtggcccatgcctgtaatcccagctgcttgggaggctgagacatgagaatcacttgaacctgggaggcagaagttgtagtgagctgagatcatgccactgaactccagcctgtctcaaaaacaaaaaccaaacaaaaaacacaaatgtcaaaagaatctcaggccaggtttccagtttaataacttgcattaaaatatactctccctggcctgtaacattcacatgtcaggtgactccattgtctctgcgagaaggagattggtggacagatcttgcctgaggtatacacttgggctgcctcttcctaggttctgggggacctccatcaccattacctttacctgctaaggtcactcctgacttttcatgtcttccacttaagctcctttagtttgacttgataagcctacatttgattggttaactgccgaccctctctcagggctgatcagttccacagactgaaaataccctccatttggggttgaaccttattcatctacatttcagaaagtgacgtgttccagtctaggcctccaagaccaatgatggtctgatgaaccattcagactcctctgcgccaattatgcttagtaccaccaggaacatttccatttctgtgaataaatgagacggtaaagaatgggagacgttcttcgcttaaagtctcagcagttgtttcccgcattcctgcttggagtatttaccacggatgctctcttcaggcagtgggttagcagggatgccctcagttcattgaaacagtaccacttgatctccagggaaagaaggggtgatctttgtttgcccacatcctcttttccagggatgcctagtgctttgttgaggggattcagcaggaatatctcctccaaaagcttctggaaactccccatgtgcccaatgtcagctcttcccgctttgagccgtccattctggttgcttctgacatgtccatgtatagtcacagaatgttagaactgggtgtgatcatgaagggttggatcaaacactccaattaaccatgtgagacaaacaccccttcagcctatcacatttcctgctggtcttgttctccaacctggtgtaatttttctactttgtaccaacctgctttcctcgagtgacttaggtatctttcaccatcctcaacttggtggatgttctcaaggtgtcagtaatcatgaataccactcatatgtgctgtttttatttctctacataacaacccaaactcagcaaagttgaaaacagaagtttgcttctcaactaatgatccaggatcatccaatgcatcaggttcttataaaaagcaactgaatgtagtctctacttttcttgaaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggtgggggaagctttttaaaatcctgctagtttgatgaagaagttgaatggaaagatttaactttgtaaaagtgtaagtgacataagcgtaagccaaaaggaatttgaaacttaaagtatttctgaatgaatttcttaactcagtagaaaaaaacggaaggagtaaaagatatttgctgcatatatatattatatatacgtatatataatatatatatatatatgtagtgttttatcactgctcttaactgcctttgataatttctcataaaccattgctgccacctagttttggaaactaaagatcttcctataagcccaatttacttggctagaaagcaaaaaaaaaaaaaaaaaagtgttaaggtagtgtgatatgtgggagtgagaggcagtatagggcagggtagagggagagaaggtgaaaacatgtgtctttaattagttatttttaaaattaaagtaagttttatttgaattgttaactaattatcattaattcagtattacaggcttttaatattaaaacttcatgacaaagaccttagttttgacattgaagtaaaacttaattaaggcaggcattagaataatttgccaaatcttccagcccctaaaaagatactattttaatgtaattaaaaaacaaaagcaggtaaccctcctgcattttttgtaaggtgtactttaacttaaaaaaattagttctctagttgcaaagggtgggaggaggagaattctaaccctggttttagaactattttaatttttataataaatgatctgtatcaattttttaaagtattacgttaataaatgtaatactttgctgagcttctatgtgcttatgcctcttctgtattttaaaaaagttatttcattagagtatcagaattgaaaagattgggttaaaatacattactacatatgtaggtcgttactctttctgagagagtgtatccatttatactccctgtcatgctgttgtggaactataagtttcatcccactttatgattttttttctcatatgttgggttggataaataggaaaaacaatacacatttttttctaattaaatcaaaacaaatttgtatttaatttcatttgattatattgctttcttagatctatttgctgagcacaatttaaatgagaaacatctttctcctctggaaaatgtagggtatcacattttattttgcagaagaaaacctttcccagggtggtactgtgtctgcttgcaatgaagataggaaggaactggttgactttttttttttttttttttttttttttttttagtgttaactggggcatgaatgtggcggtttccatcacaggtgctgaaaacactcttggaggcaactgcagctcttttgaaagttttaattgcgtctttcaataatccttcccccaggaggagcaaaggccagtgcagatgatgtatcaggaggccacgtttaagctcgcccacgtgggcgaggtgcgcgcgcagctgctggagctgccctacgccaggaaggagctgagcctgctggtgctgctgcctgacgacggcgtggagctcagcacggtaagacccgggctgcgggaagaacccagggacacctttgcgggcagaactcgagtgccacttccacctctcatattcaccttctgagttggcgatgcggcagacgcacactgtgcaggcacttggcgttgggatcgaacttttgttcaaggctgacttttcccaatattgtctgcgtgatctgccaaactacacatctcagtcctctgttttttcatcgctagaaggagtgggcggcggttaaaatgccttttaaaataaatcaggtaggaggaagcttataaaaatcctgctagtttgatgaatggcagacttttaactctaaaagcataaatgactgctcggggttattgcctcctagagttatgatgaggataaaatgtgggtaattcaggtaacaagcttaccacattgcctggcaactagtaaatgctctacaaatgtgatccattattacaatcatcattcttagcattatgcttttaaagtctaggaacctgaaatagagaatgaggaagtcttaactttgacctaacaaggctgggagggggcatccagggaggtgtgaagtccagttctcagagggtgggaccagaggcagcctctgagggcacatccaggcactcggcttcctttcagcatggatctccagggtgagagagtcaaccatggcaaatggcaggcagtgggaccccatgacttaagaggtctgtgtgcgcagcagccattggctctccctctgcccaccttcctgaaactatgctccggaaactatgcagaatctctctggggcagataatcctctggtaacctctctgctccggaaactatgcagaatctcacctgggacagataatcctgttggagtggctcacactgagagccctttcgtttccaatccttttctttactagcaatggtttgttgtctttaaaaagactatgtttgaaaaaaaaacacagtcgcctgggcattgacacttgtcacaatacaagatgtctctggagttgttggataaggagaggacagccacagccttcctgcctctgactgcttggtgtctctcccccttgtcaaggaagtggcacatgggacataggacaagtaagagtgctcacaagcttctggcagatgaaggggccactgatcctatgtgaacaaacaacacctacgtgcaaggggaggaagggaactgtgagtgcctgtgcgcttgtacatgtgcactgaagtcggaatcttaaagtctaattctggtctttcaggtggaaaaaagtctcacttttgagaaactcacagcctggaccaagccagactgtatgaagagtactgaggttgaagttctccttccaaaatttaaactacaagaggattatgacatggaatctgtgcttcggcatttgggaattgttgatgccttccaacagggcaaggctgacttgtcggcaatgtcagcggagagagacctgtgtctgtccaagttcgtgcacaagagttttgtggaggtgaatgaagaaggcaccgaggcagcggcagcgtcgagctgctttgtagttgcagagtgctgcatggaatctggccccaggttctgtgctgaccaccctttccttttcttcatcaggcacaacagagccaacagcattctgttctgtggcaggttctcatcgccataaagggtgcacttaccgtgcactcggccatttccctcttcctgtgtccccagatccccactacagctccaagaggatgggcctagaaagccaagtgcaaagatgagggcagattctttacctgtctgccctcatgatttgccagcatgaattcatgatgctccacactcgcttatgctacttaatcagaatcttgagaaaatagaccataatgattccctgttgtattaaaattgcagtccaaatcccataggatggcaagcaaagttcttctagaattccacatgcaattcactctggcgaccctgtgctttcctgacactgcgaatacattccttaacccgctgcctcagtggtaataaatggtgctagatattgctactattttatagatttcctggtgcttagccttataaaaaaggttgtaaaatgtacatttatattttatcttttttttttttttttttctgagacgcagtctggctctctgtcgcccaggctggagtgcagtggctcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtgtcgatctcctgacctcgtgatccacccgcctcggcctcccaaagtgctgggattacaggcttgagccaccgcgcccggctatattttatcttttatctttttctttgacatttaccaatcaccaagcatgcaccaaacactgctttaggcactggggacacaaaggggacagagccatcctcctttgacacctggtcttcagttctgtgcccaacgtatatagttttgacaatgaccaggttggactgtttaatgtctttcaacttaccacgtaatcctcttgtagggatcacatctttctttatgatattgtatttctctacctctaacagtaaaaattccattcaacccttaaagctcacttcaaattcttctttgagaagtttttcctttctccgcaaccagatgtacatatttgaactctctttgtacttggagggcacttctttcgtggtagttcttttatttttattaatctctgtatccttagatagtcctccaacaaccaaaggttgggactctgtcttacatatctgggtgcccctcatagtgcagtaataagtaagttgattatatacgagctatgtaacttatattttttaatggttggatatcactgagtttttttttttaagaatttttttattgaggtaaacttcacataacataaaattaactattttaaagtgagaagttcagtgccacttagtattgttaacaatgttgcataaccaccacctttatttaaagttccaaaaaaaatgttctcctctaaaaggaaaccccatcccattaagcagatactctccattccttccttcctccagcccccagcaaccaccaatctgctttctgtctctatggatttatctattcttgctattttatataaattgaattgtatgagaccttttgtgtctggcttctttcacttagtacaagtttttgagatttatttacatagtagcatgtatcaacacttcatttttatggccaaataaaattgtattatgtgtttatagcacaatttatttatccactcattcattgatggactttgggttgtttctgacttttggctattgggaatagtgctgctatgaatgtttgtgtacctgtatttgtttgaatgcctattttgcattctcttgggtatatatctaggagtggaactgctgggtcatatgttaattctatgtttagctttttgaggaacagacaaactgttttccacagcagttgaaccattccacattcccaccagcaatgtatgagaattccaatttctgtccacttcctcaccaacacttattattttccttttcctttttttaaaaaaaataagttatggccatcttagtgggtgtgaagtggtatctcattgtgttttttatttgcatttcctatgtaatgagctagaaactaaagtacaaactagatgggacatccagtccctttgatagataatgctgagtaaaaaatgagatgaaagacatttgtttgtttttagaacacgagtgacagtttgttaaaaagctttagaggaggaatgaaaacaaagtgaagtacacttagaaaagggccaagtggacatcttggatgtcaagtgcctagttcagtatcttttttttttttttttttttttttgagacagtgcctcactctgtcacccaggctggagtgtagtggcatgatctgggctcactgcaacctcctcctcctggattcaagcaattctcttgcttcagcctcccaagtagctgagactacaagcacccaccatcacacccagctaattttgtatttttcagtagagacggggtttcgccacattggccgtgttggtcttgaactcctggcctcaagcgatccgcctacctcagcctcccaaagtgctaggattacaggcataagccactgagcccagccctagttcagtatcttttatgtaaattacaaacatctgcaacattatgtatcatatgcagatacttattgcatttcttttattagtggtgaaagtgttctatgcatttattggctcttgaatttcctcatctatgaattgtcattcatacacctacttttctgcttcgtttttacatatgtctttgcctattaaagatattatccctctgttttatattttctctcattcttgtattgccttttaaattttgttatgatgtttcattaataaacagtgttttgttttcctctataatcaaa

SEQ ID NO: 7334 - DNA, 16107 bp, Homo sapiens
cgcggcgagcgcagcagcagggccgggtcctgcgcctcgggggtcggcgtccaggctcggagcgcggcacggagacggcggcagcgctggactaggtggcaggtgagggcgtccccgcgcacggctggggtaggggacgggagtggcgagcttcaggtccaccggctgccaccgagtgatgggaccggaggacaggagaggtcgctcagccaagagccccggggaggcggtgccttctcggtggggtcagcaacggtctctggggggtgcctgggagcggcagccggtctccgccttggcggcccacagccaccgcggacgcctccctcccggatgtctcctcgctgcccttccctggccgaagccctcccctgcagcctcctccccacctgccggccctgtgttctcactgctcttctctgctctgggatccgcaggatgacgtctgtcctgcttcttcactgtcctttacagtcaccagtctcggccgggcgcagtggctcacgcctgtaatcccagcactttgggaggccaaggcggtcggatccttggagatcaggagttcgagaccagtctggcaaacgtggtgaaaaccggtctctactaaaaatacagaaattagccgggcatggtggcccacgcctgtaataatgtcagctatgtgctgaggcaggaaaatcacttcaactcgggaggcagaggttgcagtgagctgggattgcgccactgcactccagcctggcagacagagtgagacttcgtctcaaaacaaaaaaaagaaaaacacaaaaaaaccaccaccaacaacaacaaaaaaataaagccaccagtctcggagtttcaaatctgagcactcttatccatcttaattctttcaataattcagctaaacgaatggggtcctgagaatctgcagagccaggctcagcgctcgcctgcagagcctgcggtctgtggggaccaccagcaagatgaggaatcaccttcgggaggaagggtcgtgctggggagggtcgcgccggcggggtcaagagaacctcctccagggtgggaatcagagcctccgggccgcggtgtttgagggtgagtggaattaatgccgtgatggacatggggccttctaagggggaccaacagtgtttgtgaagagttgactttgggaggggttcaggatggccagaggtggaggctgtgacctcagtgaggctggatcaagggagggggcaggtgggtaagacaccgttttaacaaggtggctttgagcggccacctttgaggggcctaagggcccctgggagatttaggaggaaggacaagaggattaagacaccgctttctgaggtgccgtgtggctgtggcgtgggggtggctgggggagtgggttgtgttcattgtccaaggctctccagcgctttgcgtggcgttttggggagcacagatgaggtgtcccgacagtggggagtggctctagggagaccagaggctcgggagggggcctgggcattagaccaggcacagaatccgaagtgggaagaaatgtgggcgtagagggcaggccttggggatgggtgtgggggaggagggggagatggaaaggagtcagggaggtctcccaggctcacctggaggagtcagggtctcatttccaagtgcactgggaactgcagcctgggggtgggggttcatttggtttcaggcctgtggccaagagacccaccccctcacattcacactttggtctccagtggcttcacaggcaccacctccttgttctcgcctgttttactcctcaccttgggctgtttcttgcctttccattctggcgttctgcagggatcagatccttcctctcacgcacaatctacactcatggcttttgctgggagtaatgagtaaagctcccaaatagatgtttctgagttaggaagcacattaaaaacaaaacaaaacgaagcaaaaccacacaattgtccaagtcccactctgtgttcaagggtcacatgatgtgcagaagctggtgatgggcaggagctctgaatggagttactgggatgtcaggccgcgtgggcctggggcaggctggctgactgggagcagcctggctccaccccggctgtccaggacgcactcacttgcctctatggatgacagctccttgcctcacagctgtctgtctctgggtcagattcagcatctcagtgtcttttgtgtatcagctgaatgtcagggaggccacaggctggtgcccagttgaaaatctcacaaggactctttgtaaatgcatgcaagaataagaacagcattttcctcctcctccctgaccccattctcctcctcagatgggacgatctggtccttacggaaagaattggagttcactgcttccagctctgtgtgtgtgtgtgtgtgtgtgtgtgtgtgtgtgtgtgtgtgtgagagagagcgagctctgcaggcgagccagttctgttgctattgctggtttgagctgctgccatcaccacacttagctaattaccttaacatttgcacttaatttttggccggagactaacagaaaataaatttttctccaatttaaaatacttacgaactttaagaagaaaacaaaaagtacgattccaaaattgccctgtagtaagtaggtcagtaacattcagggagtgtggaaactgcatttctctttattcttcccttccaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggtaagcttgcccgtccgccaggagcagggactggcctgggctgcgtgttctgtcaccagcttcacactcacactccagagccactgagaaaggagggcaggactggggcccgagtgtgcactggccgtttcagggaggcggggtccactggggaagaagtggggcagggcagggaggcaggaactctgctccaccgagatttatttgggggaaactttcctcggttaatcccttggaaaagaccatccaagctgtcttgtcctagcgcagaatctttctttagaaaatgacactgaaattatttgaaacataagttgcaaagaactacctcttttttggagcaagagactttgtaactaaactttcattggtaaggaaggttaatacctgtttcaagttgtttctgtaccaacagctcagggagggcatcaacagaaatttgcaagaaggattccagggcaagtgcttcattacagctgcacactgtgcaggtactgctcagctcagtctcaccaacattcagagaacctgtggaaatgattcaagatcagtgcttgtccccagacctttgtggaaaggagaggagacatacacgtgagatgaaaccgaaaagcgccatccctgagtgcaggccgctggacacgccttcatcatgggagttgtcctttgttcaatatgactgtctttttctttgatgacgcttttcaatagtgaattactcattttaataatttcccagctcattgtgtgaagaagggagggtttatgtgtaaaggctaccagccttaataataagcacagagaggctctctaaaagatatatatatttggaaatagggcattgcaatgaaaatacgcatgccatggcaagctatgtgcacattcagggaggtgaaataacactaagatttttaaaggaaaaagtaaagaggattacataattcctttgaaataattatttttggcaaaaagatcaataacgaaggtgatgtcagtgtgaggttggatggggagttcctgggtagatgtccttgcacaagtattttgttgtgtaaggctgtgatggcctttgtgcaagagcgtaggtttttagagtcctttgtgatagttgtgttatcaggcattcaagcgtgagaaccctctcttcatggccttccctgtctgtttgtcaaaggtttttggttttgtttttttaatattagtgactccattttgattctgaagttccttatgctgaaatctgtatgatctttttctatgttttaggctcactgataaacccttatagaaagcttttttgagagcaccaaaattgtctgggtaccttcttaggtgtgagactgagctctctccatggctccagtgttcaactggatgcttgtgagacaccaaacatactgagtacacgttgctacctgtaacatgcagggaagcgttaatggcagcagaaatattttaaagaattatttatttttccttcattatataactggtaaaagtccactataaaaatttttaaaaaataaaagtagaagggaggaaaaaatccctatgaatccatcaaacagagacaaccacccttgataatgtaaagcatcttcctccagtcctatttctttttttttttttcgagacagagtcttgctctgtcgcccaggctggagtgcagtggtgcgatctcagcttactgcaagctccaccccccgagttcacaccattcttccacctcagcctcccgagtagctgggactacaggtgcccgcccccacgcccagctaatttttatttttagtagagacagggtttcactgtgttagtcaggatggtctcgatcacctgacctcgtgatccacccgccttggcctcccaaagtgctgggattacaggcgtgagccactgcgcccggccctatttcctgattttcacttgacattttgtactttggtgattatatggtatctttacttttataaatgatttttcagctaatgtgaggattcggtgagacagtccatgtaaagcaagtgctcaacatgtgttggctatgaatagtaatagtggtgtcacagcctcaggtgaaactggtcttagcttttggttctgttctatttgacagggtttctcatcaacagtctatgagctgtctaaagtaaatttagtagcttcctcttttttctatgttatagaacagtgtgtattgcatgagaaatagaaattgcttgaatattagaaaaaaaaatccctcaaaagatcatctaagcctttttagaagtaattctctctctccctcttattttttttttgttcattcattgtgactgatagattctgttttttgtttgttttgtttgttttgttttgttttttgagatagagtatctgctctgtcacccaggctggagtgcagtggtgctatctcagctcactacgacctccaactcccgagttcaagttcacgtgattctcctgcctcagcctcccgagtagctgggattacaggcacatgtcaccatgcctggctagtattcatatttttgactggcatttggtaacttataatctgtactttactgaaaataattatatagagtttttgttttaacattccctttgtttatattgctgtaacctctttttcacatataactttactttggggtgctttttcttacatgtggtgggtggctgtctgttttgtatgtatgtgtgttttcttttaaagaaccagctcttggattcattgatcattttgtgtttgtcccaaaattccttgggagtttttctgtatcttttctaacataatgattttaaagttttagcattttattactttcttggtaatattgaaaacaatgctatgttttaacttatctttggccaaactctttggtctaatatatatcacccatattttgattattttctaaatcatatgtcatatacttatttagaagaatttgtttgtttgtttgttttttgagaaggagtcttgctctgttgcccaggctggagtgcagtggtatgaccttggctcactgcaacttccgcctcctgggttcaagtgattctcctgcctcagcctcccaagtagctgggattaccagcaagcatcaccacacccggctaattttcgtatttttagtagagacaggatttcgccatcttggccaggctggtcttgaactcctgacctcaagtgatctgcccgcctcggccccccaaagtgctgggattacaggcatgagccactgtgcccagcctagaagaatattttaaatatttgtttagaagaggattttttgtgttttttttttttttttgacatggtcttgctctgtctcctaggctggagtgcagcagcttgatcatagctcactgcagcctcaaagtcctgggctccagcaatcctcccatctcagccttccaagtagctgggaccacaggcacacaccatcatgcccagctaagtggagatgggatcttgcaatgttgcccaggctagcctcaaactcttgggctcaaacaatcctcctgccttggcctccaaaagtgctgggattataggcatgagccactgtgcctggcctagaaaagtattttaatttttactttgaagagttaattatttagaaaagtgttttcagtaatattttgtaggtgattttcattttgttggcattttatttataatgctgattttttgttactacattgaagttagagaatatgatctatataattctgtatttcagaatgtattgggatgttgagacttttcttatggcccaatatgtgtgatatattttgaaatatttaatatacacacatgtagtccctatagggtacaattttaataactgtgttattgtcttattaatcacattgctcatgtaatatccttgtttccttttgaggattctgatgattgtatttccgtctatttttccatgcattttttctgcttttaactttttaactgcatctttttttttcactataaattttagaggtaattttcccaccacttagggtacatttatattttccttttgatgcaagattttatcacaacctcttttctgagcttttctcacccttgtcattttttgtgtgttactgatctttaaacaagcgagatccattcaggcagaatggctacatcttttactcgcctgttttctgtcccctctctctcctctccccagccatcaaagagctatcttgataacttttaaaattatctttcacaacaggcactgtctttaaacacagaggaagacattcatcgggctttccagtcgcttctcactgaagtgaacaaggctggcacacagtacctgctgagaacggccaacaggctctttggagagaaaacttgtcagttcctctcagtaagttgaatcaatagaacaataaaagttgcattcaacatacctggtgatatagagtctgggagaaagaccctagagaaattgagaaatttatgttaaccaatttaaaaaaattgcactatttttttttctaagatggggtctcactacgttgcccaggctggtcttaaactcctggtctcaagtgatcctcctgcctgttgggattacagatgtgagccaccacgcccagcctaaacttctttttttttttaaagactgcaattctataattataccttgcattagtattgcaaaagtagtctctacttttcttgaaaggtaaaattgaaaggtaaaattctcaagttcatttctggttattcagggttcaatacatacctattcacaaactctgatattttaacatatcttcatatgatcacttttaaagagttatgtatattctttttattaaaaaaagataacatatttagaatttttggaagtttgctgacatttgtatttagcaatgcagcctcactgaacatttttctctccaaagacgtttaaggaatcctgtcttcaattctaccatgctgagctgaaggagctttcctttatcagagctgcagaagagtccaggaaacacatcaacacctgggtctcaaaaaagaccgaaggtcagaatgacaagttattgcaccttcctcccaacccgtcctcctcctgcggctcttcctattcctccttcccgcctcttatatcctctctcctcctcctctccctcctatccctcctccctctcctcacccacctccacctctccactccgccccctctaatttcacgggtgtttcagatggtcagagtagtgttgactggcagggcctcctggcatactgaaccttgatggactcataaaggttctgatcagacattcaggttttcagcaacagagatttacttttgtctattctcccaggaccagagtagctgatacaaatgtcaaaagagggccagccacggtggctctcgcctgtaatcccagcaatttagaaggccgaagtggacatatcacttgaggtcaggagttcgagaccagcctgaccaacatggtgggaccccccccccccaacatctctactaaaaatacaaaaattagccaggtgtggtggcccatgcctgtaatcccagctgcttgggaggctgagacatgagaatcacttgaacctgggaggcagaagttgtagtgagctgagatcatgccactgaactccagcctgtctcaaaaacaaaaaacaaacaaaaaaacaaatgtcaaaagaatctcaggccaggtttccagtttaataacttgcattaaaatatactctccctggcctgtaacattcacatgtcaggtgactccattgtctctgcgagaaggagattggtggacagatcttgcctgaggtatacacttgggctgcctcttcctaggttctgggggacctccatcaccattacctttacctgctaaggtcactcctgacttttcatgtcttccacttaagctcctttagtttgacttgataagcctacatttgattggttaactgccgaccctctctcagggctgatcagttccacagactgaaaataccctccatttggggttgaaccttattcatctacatttcagaaagtgacgtgttccagtctaggcctccaagaccaatgatggtctgatgaaccattcagactcctctgcgccaattatgcttagtaccaccaggaacatttccatttctgtgaataaatgagacggtaaagaatgggagacgttcttcgcttaaagtctcagcagttgtttcccgcattcctgcttggagtatttaccacggatgctctcttcaggcagtgggttagcagggatgccctcagttcattgaaacagtaccacttgatctccagggaaagaaggggtgatctttgtttgcccacatcctcttttccagggatgcctagtgctttgttgaggggattcagcaggaatatctcctccaaaagcttctggaaactccccatgtgcccaatgtcagctcttcccgctttgagccgtccattctggttgcttctgacatgtccatgtatagtcacagaatgttagaactgggtgtgatcatgaagggttggatcaaacactccaattaaccatgtgagacaaacaccccttcagcctatcacatttcctgctggtcttgttctccaacctggtgtaatttttctactttgtaccaacctgctttcctcgagtgacttaggtatctttcaccatcctcaacttggtggatgttctcaaggtgtcagtaatcatgaataccactcatatgtgctgtttttatttctctacataacaacccaaactcagcaaagttgaaaacagaagtttgcttctcaactaatgatccaggatcatccaatgcatcaggttcttataaaaagcaactgaatgtagtctctacttttcttgaaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggtgggggaagctttttaaaatcctgctagtttgatgaagaagttgaatggaaagatttaactttgtaaaagtgtaagtgacataagcgtaagccaaaaggaatttgaaacttaaagtatttctgaatgaatttcttaactcagtagaaaaaaacggaaggagtaaaagatatttgctgcatatatatattatatatacgtatatataatatatatatattatatatacgtatatatatatattatatatatatacgtatatataatatatatatatatatgtagtgttttatcactgctcttaactgcctttgataatttctcataaaccattgctgccacctagttttggaaactaaagatcttcctataagcccaatttacttggctagaaagcaaaaaaaaaaaaaaaaagtgttaaggtagtgtgatatgtgggagtgagaggcagtatagggcagggtagagggagagaaggtgaaaacatgtgtctttaattagttatttttaaaattaaagtaagttttgatttgaattgttaactaattatcattaattcagtatttacagctttttaatattaaaacttcatgacaaagaccttagttttgacattgaagtaaaacttaattaaggcaggcattagaataatttgccaaatcttccagcccctaaaaagatactattttaatgcaattaaaaaacaaaagcaggtaaccctcctgcattttttgtaaggtgtactttaacttaaaaaaattagttctctagttgcaaagggtgggaggaggagaattctaaccctggttttagaactattttaatttttataataaatgatctgtatcaattttttaaagtattacattaataaatgtaatactttgctgagcttctatgtgcttatgcctcttctgtattttaaaaaagttatttcattagagtatcagaattgaaaagattgggttaaaatacattactacatatgtaggtcgttactctttctgagagagtgtatccatttatactccctgtcatgctgttgtggaactataagtttcatcccactttatgattttttttctcatatgttgggttggataaataggaaaaacaatacacatttttttctaattaaatcaaaacaaatttgtatttaatttcatttgattatattgctttcttagatctatttgctgagcacaatttaaatgagaaacatctttctcctctggaaaatgtagggtatcacattttattttgcagaagaaaacctttcccagggtggtactgtgtctgcttgcaatgaagataggaaggaactggttgactttttttttttttttttttttttttagtgttaactggggcatgaatgtggcggtttccatcacaggtgctgaaaacactcttggaggcaactgcagctcttttgaaagttttaattgcgtctttcaataatccttcccccaggaggagcaaaggccagtgcagatgatgtatcaggaggccacgtttaagctcgcccacgtgggcgaggtgcgcgcgcagctgctggagctgccctacgccaggaaggagctgagcctgctggtgctgctgcctgacgacggcgtggagctcagcacggtaagacccgggctgcgggaagaacccagggacacctttgcgggcagaactcgagtgccacttccacctctcatattcaccttctgagttggcgatgcggcagacgcacactgtgcaggcacttggcgttgggatcgaacttttgttcaaggctgacttttcccaatattgtctgcgtgatctgccaaactacacatctcagtcctctgttttttcatcgctagaaggagtgggcggcggttaaaatgccttttaaaataaatcaggtaggaggaagcttataaaaatcctgctagtttgatgaatggcagacttttaactctaaaagcataaatgactgctcggggttattgcctcctagagttatgatgaggataaaatgtgggtaattcaggtaacaagcttaccacattgcctggcaactagtaaatgctctacaaatgtgatccattattacaatcatcattcttagcattatgcttttaaagtctaggaacctgaaatagagaatgaggaagtcttaactttgacctaacaaggctgggagggggcatccagggaggtgtgaagtccagttctcagagggtgggaccagaggcagcctctgagggcacatccaggcactcggcttcctttcagcatggatctccagggtgagagagtcaaccatggcaaatggcaggcagtgggaccccatgacttaagaggtctgtgtgcgcagcagccattggctctccctctgcccaccttcctgaaactatgctccggaaactatgcagaatctctctggggcagataatcctctggtaacctctctgctccggaaactatgcagaatctcacctgggacagataatcctgttggagtggctcacactgagagccctttcgtttccaatccttttctttactagcaatggtttgttgtctttaaaaagactatgtttgaaaaaaaaacacagtcgcctgggcattgacacttgtcacaatacaagatgtctctggagttgttggataaggagaggacagccacagccttcctgcctctgagtgcttggtgtctctcccccttgtcaaggaagtggcacatgggacataggacaagtaagagtgctcacaagcttctggcagatgaaggggccactgatcctatgtgaacaaacaacacctacgtgcaaggggaggaagggaactgtgagtgcctgtgcgcttgtacatgtgcactgaagtcggaatcttaaagtctaattctggtctttcaggtggaaaaaagtctcacttttgagaaactcacagcctggaccaagccagactgtatgaagagtactgaggttgaagttctccttccaaaatttaaactacaagaggattatgacatggaatctgtgcttcggcatttgggaattgttgatgccttccaacagggcaaggctgacttgtcggcaatgtcagcggagagagacctgtgtctgtccaagttcgtgcacaagagttttgtggaggtgaatgaagaaggcaccgaggcagcggcagcgtcgagctgctttgtagttgcagagtgctgcatggaatctggccccaggttctgtgctgaccaccctttccttttcttcatcaggcacaacagagccaacagcattctgttctgtggcaggttctcatcgccataaagggtgcacttaccgtgcactcggccatttccctcttcctgtgtccccagatccccactacagctccaagaggatgggcctagaaagccaagtgcaaagatgagggcagattccttacctgtctgccctcatgatttgccagcatgaattcatgatgctccacactcgcttatgctacttaatcagaatcttgagaaaatagaccataatgattccctgttgtattaaaattgcagtcccaatcccataggatggcaagcaaagttcttctagaattccacatgcaattcactctggcgaccctgtgctttcctgacactgcgaatacattccttaacccgctgcctcagtggtaataaatggtgctagatattgctactattttatagatttcctggtgcttagccttataaaaaaggttgtaaaatgtacatttatattttatcttttttttttttttttttctgagacgcagtctggctctctgtcgcccaggctggagtgcagtggctcgatctctgctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtgtcgatctcctgacctcgtgatccacccgcctcagcctcccaaagtgctgggattacaggcttgagccaccgcgcccggctatattttatcttttatctttttctttgacatttaccaatcaccaagcatgcaccaaacactgctttaggcactggggacacaaaggggacagagccatcctcctttgacacctggtcttcagttctgtgcccaacgtatatagttttgacaatgaccaggttggactgtttaatgtctttcaacttaccacgtaatcctcttgtagggatcacatctttctttatgatattgtatttctctacctctaacagtaaaaattccattcaacccttaaagctcacttcaaattcttctttgagaagtttttcctttctccgcaaccagatgtacatatttgaactctctttgtacttggagggcacttctttcgtggtagttcttttatttttattaatctctgtatccttagatagtcctccaacaaccaaaggttgggactctgtcttacatatctgggtgcccctcatagtgcagtaataagtaagttgattatatacgagctatgtaacttatattttttaatggttggatatcactgagtttttttttttaagaatttttttattgaggtaaacttcacataacataaaattaactattttaaagtgagaagttcagtgccacttagtattgttaacaatgttgcataaccaccacctttatttaaagttccaaaaaaaatgttctcctctaaaaggaaaccccatcccattaagcagatactctccattccttccttcctccagcccccagcaaccaccaatctgctttctgtctctatggttttatctattcttgctattttatataaatcgaattgtatgagaccttttgtgtctggcttctttcacttagtacaagtttttgagatttatttacatagtagcatgtatcaacacttcatttttatggccaaataaaattgtattatgtgtttatagcacaatttatttatccactcattcattgatggactttgggttgtttctgacttttggctattgggaatagtgctgctatgaatgtttgtgtacctgtatttgtttgaatgcctattttgcattctcttgggtatatatctaggagtggaactgctgggtcatatgttaattctatgtttagctttttgaggaacagacaaactgttttccacagcagttgaaccattccacattcccaccagcaatgtatgagaattccaatttctgtccacttcctcaccaacacttattattttccttttcctttttttaaaaaaaataagttatggccatcttagtgggtgtgaagtggtatctcattgtgttttttatttgcatttcctatgtaatgagctagaaactaaagtacaaactagatgggacatccagtccctttgatagataatgctgagtaaaaaatgagatgaaagacatttgtttgtttttagaacatgagtgacagtttgttaaaaagctttagaggaggaatgaaaacaaagtgaagtacacttagaaaagggccaagtggacatcttggatgtcaagtgcctagttcagtatcttttttttttttttttttttttttgagacagtgcctcactctgtcacccaggctggagtgtagtggcatgatctgggctcactgcaacctcctcctcctggattcaagcaattctcttgcttcagcctcccaagtagctgagactacaagcacccaccaccacacccggctaattttgtatttttcagtagagacggggtttcgccacattggccgtgttggtcttgaactcctggcctcaagcaatccgcctacctcagcctcccaaagtgctaggattacaggcataagccactgagcccagccctagttcagtatcttttatgtaaattataaacatctgcaacattatgtatcatatgcagatacttattgcatttcttttattagtggtgaaagtgttctatgcatttattggctcttgaatttcctcatctatgaattgtcattcacacacctacttttctgcttcgtttttacatatgtctttgcctattaaagatattatccctctgttttatattttctctcattcttgtattgccttttaaattttgttatgatgtttcattaataaacagtgttttgttttcctctataatcaaa

SEQ ID NO: 7335 - DNA, 466 bp, Homo sapiens
taaacctcttctctttgtgaattacccagcctcatgtatgtggtttttttttttatagcaacacaaatgaaccaagacacagagggcacaatcatgacagaaattcttgttccgctctctgttttaatttagaggttgataatatccagtattggtgagcatacgagaaaacaggcatccttaccttgtgtgtgggaatgtggattaagggtttttggaaggaagtgggcagccttttcattttaaatggacattctttttgggccagcatctcacttttagatgtctgatctacataagtatttgcatacatgcttagatatgctaaggttttccctgtagtattttcaaaggcatttttgcagggtaatttaaaaaatcgtggtaaagaaaaacaaaatttaccatcttaagcatttctaagtgtacagttagcattgttgaatagcaaaaaaggaaagaaaaa

SEQ ID NO: 7336 - DNA, 466 bp, Homo sapiens; identical to SEQ ID NO: 7335

SEQ ID NO: 7337 - DNA, 1669 bp, Homo sapiens
gcggctccctctctccctctggcccagtcccttccgcttgtgtccgggaagctgtgggcggtgatttaacatgactcacttgggggcataggcgctatgaagttcagtggctgggtgccaggtggcgccaatgacaccctttttctcagagcccgggctgaatggacacctccctcaaagccttccagacccagggttacggccgttcccagagacatgttcccgtgctgctgggcacacctgcagaggggagggaaggtcctgtgtttgctggtgctgctcgtcctctcacttcctaccgagcatcatgttgcaaacaaatgaccttggcaccaccgttttgcaaattgtcctttcttgggctttactttttggtctatgtgagcaaaatgaactgaagtcaaggtacgactcccaataacctgctgtgggatgagagggcttttgtcatttatgcagtctgattagttatccacgcccagagctacactttctcgatgcttctcagctctgactctcacagggccagggagaaatttttgtgccccctaaatcatgtagttggatacaaaacattccctggaggcctaccattctcaaatccccgtgcagggctctgtggggtgcaacatgaaactcgctctaactccctacgtggaggacagacagacccatcctaactccaaagccagacacaagggacaaaggtaccaaaaaggtgcaaggtgcaagaatggacgacgctggtcttccaatttgctggaatatctgtgcggctagaatggtgtcttgttcagcatatatcagcatcttgcccttgctctgtcctgcctggccacaaaggacactcagacaacaccggcctcataaatgctgcctggagaaaagcctagctaggtacggagggtcagggtatttcagaaaagagaaactgcttcagccaatgctcatgagatttaccagggaatagcaaacaagtctagtgcaagccagggttgggggagtgggagggtgattagcagagatcaatctagaaaggaggtcaaggttctgtaggtggggaaagagggtgcttgtgtattaaaacttgttttccagcagtttggagatttctcaaagaactaaaaatagaactaccattcatcccagcaatcccattactaggtatatactcaaaggaaaacaaattgttctatcaaaaagacacctgtactcctatgtttatcgcagcactattcacaatagcaaagacatggagtaaacccaggtgcccatcaacggtgaactggataaagaaaatgtagtacatatgctaccatggaatactacgcagctgtaaagaggaaagaaatcatgacctttgcaacaacatggatacagctggaggccattatgctaagtgaattaatgcagaaacagaaaactaaatatcacatgttcttatttgtaagcagaagctaaatattgggtgcacacaggcacaaagatgggagcaataaacactggggattccacaaagggagcaggcagagggaagggttgaaaaactacctatcaggtcctctgtgcactacttgtgagacagaatcattagaagcccaaacctcagcatcacacaatatacttatataacaaacctgcacattgacccctgaacctaaaattaaaa

SEQ ID NO: 7338 - DNA, 21010 bp, Homo sapiens
cggaagtggaaacggaaacctttttagggagtccaaggtacagtcgccgcgtgcggagcttgttactggttacttggtaagctggtgtgaggggaacctgggagggtcagctccggtcctgggtcgggaggggtgggggccagaggattcagggccggaggttctggtgggggcccagtgggcgggacccgaggacggaggggccgggaggccgagaggggcggggtcgcggcggggcctgagggacggaggccgggatacttgggaaaggatccgccggccttgaactcccgcctccgccgcccctaggcctcatggcggtccgagcttcgttcgagaacaactgtgagatcggctgctttgccaagctcaccaacacctactgtctggtagcgatcggaggctcagagaacttctacaggtgcggcgggagccccggggcttacggtggcggggaggcgtgcgcaggagtcaagagctccggcagtgggagggtgccggcccctctgccccgccaccaccgagtccatgtccctacagtgtgttcgagggcgagctctccgataccatccccgtggtgcacgcgtctatcgccggctgccgcatcatcgggcgcatgtgtgtgggtaaggcaggtggaggacgccgagggagggagtggtctccaagcaccattaattacacccccggagggaacccggagtgacctagggattcccagggtatcatctgttatctctgggcactatagaatctctcaggccaagcgtcaggagatcggggcaaccctctagcaaaggctgctggataatagtaataacaaataatgtaaagtgctttcactcctgttctcattccttcgtcacaaagacactagaaggtaggagttactggcctaacttgactgatgaggaagttgagacttgacctaagtgactcagtaagttccacacctagttcctagtgttggagaaggatttttctcttttttttttttttttgaggccagatttttgctctttcgcccaggctggagtgcagtggcaagatcacagctgtctgcatcctcaacttcttaggctcaagtgatcctcccacctcagcctaccaggtagctagggccacaggcacgtgccaccacacctggctaatttttacatttttggtagagacgcggcctccctgtgttgcccagcctggccttgatctcctgggctcaagtgatcttcttaccttggtctcttaaagtgttgggattataggcgagagccactatacccagccgaggatttgtatctcatctctccctgccactgactgggcaaggtgctttctctttctaagcatccatttctgtctctgtaaagattagctaagatatgcggtcttcctgctcagttacgttggaatcttaaattccctttaccacatctctaccctaccttcctacctgtcagcactgttaattctggtcgttggtcctttcctttttattattattattatttttttttgagatggagttttcgctcttgttgcccaggctggagtgcaatggcacgatcttggctcactgcaacactctcttcaagtgattctcctgcctcagcctcccaagtagctgggattacaggcgcatcccgccacacccggctaatttttttgtatttttagtagagatggagtttcaccatgttggccaggctggtcttgaactcctgacctcaggtgatcctcccacctcggcctcccaaagtgctgggattacaggcgtgagccactgcgcccggccggtcctttcattaagctggatctgtcttccattactgctgcccattgtttcttagttctgctcattgaggtcacttttagaagtctgtttattttatttttttacttttactttaatttttaaaaatcttaagcctgcttgggaggtcgaggcaggtggatcacctgaggtcagcagttcgagactaacctgaccaacatggagaaaccccgtctctactaaaaatacagaaattagccgggtgtggtggcgcatacctataatcccagctacttgggaggctgaggcgggagaattgcttgaaccctggaggtggagctcaccctgcggtgagctgagattgtgccattgcatttcagcctgggcaataagagtgaaactgtgtctcaaaaaaaaacaaaaaacaaaaaacaacaacaacaaaaacttaagcctagtgacctcaaagtattttcctattcagttaaaatactctgatctctaaccatgcccttaggacttgaagcaagttctgacaacaagggagattttagcttagtccttgtgtattttatgatgggagtgacctggaattcagaaattgattggcgtgtatttgtagattgttcattcttgttgctgtatggtgtgttttgtgtaagtatatcacaacgtattcatccattccatcgacagtgcatttgggcagttttcactttggtctgttaggaatagtgctgctggccgggcatggtggctcacgcctgtaatcccagcactctgggaggccgaggcgggcggatcacgaggtcgggagatcgagaccatcctggttaacacggtgaaaccccgtgtctactaaaaatacaaaaaaattagccaggtgtggtggcgggtgcctgtagtcccagctacttgggaggttgaggcaggagaatggtgtgaaccggggaggtagaacttgcagtgagccgagattgtgccactgcactccagcctgggcaacagaacaagactccgtctcaaaaaaaaaaaaaaaagtaatagtgctgctatgtttttttagtgaacacatgtacatatttctactgggtatatgatacctaagagtggcatggcagagtcacaggttatgtgactatttagtagtagttgcagatgatgccagataattatctaaagtgattgaccaacttacactcctgtctcagtatgagagttcagttgctccatatatctttgccaacacttggaattgatgacttgtaaaaattttagtcattctggctgggggcagtggctcacacctgtaatcgtagcactttgggaggtcgaggtgggcggatcacctgaggttaggagttcgagaccagcctggccaacatagtgagaccccatctctacaaaatcacaaaaagttagccaggtgtggtggcacgcacttgtaattccagctactcaggaggccgaagcaggagaatcacctgaacccaggatgcagaagttgcagtgagctgagatcgcaccactgcgctccagcctgggtgacagagtgagactctgccttaaaaaataataatctagccattctgctatgtgtgtagtgttagctcagttttttttgtttttttgttttttttttttggagacggagtttcgctctgtcacccaggttggagtgcagtggcgcgatctcggctcactgcaagctccgcctcccgggttcacgccattctcctgcctcagcctcccgagtagctgggactacaggcgcccgccaccacgcctggctaattttttgtatttttagtagagacggggtttcaccgtgttagccaggatgatctcgatctcgatctcctgaccttgtgatctgcccacctcagcctcccaaagtgctgggattacaggcgtgagccaacacgcccggcagctcagtttttaagtagcaaaatatacagctaatgccaagagctcagcttccctcccagttggtgatggtgaagtaggcaggatttattgggattcctgggtggtctctggcctgccctgggtgttttccagatcagtgggttggagggctgggctctgggcctaaagctttcctgggaaagctgattgggctgggctgagtggtatcctcagcccctagggctcagcaggcatcttgtgtattcaccctctaatttgggtttctccagggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggtgaggcagcccaacttgacccaagagtcacagggccatcctagtcagtggttagccactgttctttcccaacaggcagcaattaggggtctctcctgtggtttttctatatgggctcttgagtttcaggtactcattggaatagtgataacagaggccttatcaagtgtcagaaagaagctggggagggtatgaatccttcatgattggggagattgaaccatccagtcctgcatcctgggccaggataggtgattgactgttgaacttttgactgtgggtgagaggggaaagaagtgatattgagaccagcctccagctgttcagggcatgcatgaatattaggggcttcacagctgcccttgactctgctctaagctgtacttcctcctttctctgggtgaggctttcatatgaggtacagaggagaaatgaggggctcagggagccaaggcctggatgcttctgggcatggagaaccttggttctggggctgtaagttctgagccctgaacacaatatctttgattgacaggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggtaagcattcctgtcctctgaaccccgtctcccgaggcagatccttttgcctagtgtttgggagtctgggtcattacctgccacagtttgggactggggctgcaggtcagggaggagcagggtttggggagagtcttcattgaggagggagagaatttggtgccgtgactcacattgagcccatcccttggcaggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacaggtacctggggcctctcctttcttctgctcagggttgggggttaacttgcattttgagagtatggggaaaagatgtcatctagaatgggagcctaccagtttgttctggtagcttctcgagtgtgagagcatatctgtacactgctgagcagataagagccagcatattcaaaaaatatttcttgagcatctgctaatcctcatctttgtggtttttcagggctaggatactagagcagtagctgcttgagcagcttgtcagagctggtcccgggatgagggctgaggcaggcacctcacttgagagtgaggtgggctctgtgaaacagctactgaccgtgcgctttcctttctcttcagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccgggccattctgaatgtgatgtttggggccctcagcctgtgtacaatccctgcactctccagttgttccagcattctgggaagatagggtgggatgaacacaacacacacccaacccagttcaccacctccacacacgccattcccttctcctctaccatcaggatgtgaggcttcatcctggggcaagaaacactctccactacagttctccttttttcttttttctttttgaggcagtgtctccctctgtcacccaggctggagtgttgtgacgcaaggatggctcactgtagccttgacctgttgggctcaagcgatcctctcgcctcgtttatttttttgtagaaacgaagtcactgtgttgcccaggctggtttatactcctgaactcaagcgacccaccgcctcggcctcccaaagtgttgggattacaggcgtgagccacggcgcccggtctagttctcacagttttcacccgacttctgcgccggtcttctctggccttgaaaggcagagagtccgttccgattttcccctgagctgggcaagtcccctgtgagagctctggggcatctggcttcggggcattctttgactaaggtggatggaggttgcaggtcttttcctgggtgggcgtggggcggggcagcgggttcccagcgtcctcctggcctgggcgtcttggaggctgttgggatgcattccgtccccttgcgcggggcggggccttgaggcgctggggcgggattggcgggggacggtcgcggagccccgccccgaagcacagggtcgagtcccttctttccgctccaacgcacggagggtgaggtcggtacgcggtggtggcgtcacggcgccagctcctcccgacgccgaggtgggttccgggagacccgcgggtctggctgcgagaggtgagggcagagccggggcggggccctagcggggtgtcccggcgacccagaccttaaagggcttctcttcttgcagaccatgggggctcagctaagcggcggccgcggcgccccggagcctgcgcaaacccagccccagccccagccccagcctgcggcgccggagggcccggaacagccccggcatccgccccagccccagccccagccccagccccagccccagcccgagcccagcccgtgggggccgctggacgacgtgcgcttcctcatcgcctgcacttcctggtactgacggcgtcctccgcaggatgtcgcccgtctgtccgccgtcccctgtggttcttgcctgccttgtctcctctccccacgtccctgcgtctcttacaccccctcccacccgaggctccccagagatagcagagaattcgaagaggtcgccggggactggaaagaagtcccggcagggccgccttcgcagtctacaccccagcctgcttcccagcctacacccagacccagctcagaccttcgtgaccaccccatccctttctccggctggctgggtcgggggcatccctctctgtcgctggcttccagaggcaggacaggcctcctggtaagcccgcaaagttgctgacctcctgacttcgtctgccttttattaatatctgtattgctgataaccgtgctcttgactatgtgtcccaggtcatgtcccaggtcatggagaagcccgtgccacagtgaccctccccatactcctgggggggctgctctccatcctggatcgtaaggaggcatcatcaggctgtgttcctggaaccccaataaccctgggcccccagggccagcctgttgtagagggaggctatctgaccgccggtctggcagaggagatgggtgggcagctcccagacaccccaaaggacccggttctcttcccagagcgtcctaaggttactcttggaacctgatctttgttccctcatcccagggaaatgacacactctgtatttctgttttatttagaaatgatttaaaaaacattatacaaaggctgatcagtttaaaatgtgactgacactgaaatgctgtgatgtcccccaggctgaggggaagctaggctctggggcccccagtgctttgcccctctgtctgccctgtcctggggtgatggacaaacagatgaccacaggcaggagaatctgagattggaagcctctaggctgagccctctgggcctggccccacatccctcacctctgcagcctgggctgcctgcctccatctcctgttcattctcagctggcctgccaggagccaatggggagcctggcgggaggcgggggtgcctagagctttcaagaagtgagagcaccaacctgaggagtggacagggaccaggaagtgggggaagggaggccaggaagaggtggatacaggagacacttctcatctcatctcagaccctagaggggtccacagatggggacacaagacccagccagcccactggatggcccgggcaagtaacaacctctctgtgcttcatctgagggcacggtgagagttaccgtcggcctcccagggcctaacacgagtttcatgtgagtggacaggtgtgagctaataaagtgctttgcaaagtataaaacactgtacaaacctatgaatcactaatatctccgcagttgttccctgcctgtcccagggagcctgcccttggccaaaatgagaaaaaacaaggatgatgacaggggacacagcggacccacatgggcacctctgggacaagagattttgcttgagacagctcccagggcagcaggagtccctgtctgtgctacagggtaagccgaccccaatcccagagaccacagggtcgggggcaaggcccatgcaggctcagtgagcaggggtggcatccgagacccggccagcacgctggagactgcctgacacctttttggctttggcagagagccagtgggcattgatgaacccattggccttgtctagggctcctcagtgacaagcagggctgcctccgccgtactgtggagcaaggcaggccaagccctaggaactcctgctggagacagtgaagggcgggccagtgaaggtcaaaaagggagccccctcagcttggggctgctaccggtaggggtgtccttctaagagcagtgtgggaagatgggcccagtgagcgaggtcagcaagggccaagctctgggaaaacactgcttccagccgagagattgagtcggcctcagagtagctggagtcggcctcagagtagtgggggcactgagcacttcagacgccctggtccccttccgaaggactcccaggctctgccagtgttggccctgcagccatctctgcctcacctaactggtgaggctgagctccaggctgcaagtgacagactggagcaaagctggggacagtgacaatagaggggagtggaggacggtcacaaactcggatcttcctccagaaatggggtcagcttctgccccagctctgtagccataggagcagagctcagctactggggtgtctgggcgctagagtggccttagcagcaccttggtccttgtcgcctgggggagggccgctatgctggcctcatcaccaagacagtcacctctagttcacctaaagcctcaagcagcctttgcaaaatgggacagtagtgacaggacatttaaatattcacgatgtgacagctgggtccttgtcagacccagctgggccacagccctgcctgcagcatgtgaccctaaatcctgggtctccgaagagaccctgacaagtggagcaggtttcctgagggatctgccgtctgccagcagggaaacccaggcttgttgctcactgtgtcagaagcaggggtcctgtagccttggaggacagtggggtgggggtagggggacatctgaccagcaggtgttggcaaaaggggaccaggactggtggtatctcccggatgggggatgagagctagtgctggcttcccacagagggtgctgggttccagccaggagtggagctgtggtacctcatggacaccacaggatgccgtgaccacaggggctcctcctggcatggtccctgcctccggatggagcctggcctattcccttaagtagggagtagtttgcccaggacagaaggctggcagctgggtgccagacacccaccctggggcacagcccccataattccctgccccacgctcagcctaggccaatgcacccaccacttcagctgtacgaccccagcctagggccctgctggccctggtgagcactggccagagctgcccctcagaccctggtgaggaagggcctggctggccagaccaagtggatagagagggctctgggctgctcacacccattcctggactggccgcttatagtaggtgacaggctgagggcctgtcttgttcttgaactggaagatggtgtagaccagcaccaggatgcagagggacaggatgcaggggatgaccacggccacggcgttcacggagcccggcacatcgttgatggtcaccatgatgtccacgtcgtcctggggcagccgccgctccttccgccgctccacctccttctggttgcagcccatccagtcacgcaggatgttgcgcgggtagcctggctccacgctcagtttctggttgtcaaacttccagtagtcccggcccttgtagaaataggtgtaatctgcagaaatacagcccagcatcaccactcccagacacttccggcacctgctctggggcagtgtgaaaaggagggcacaggcactgtggcaagggaggcaaggtgggcacacctggaggtttggggtgcagtgcttggctgagtcatggagtaagaagctgcagagggggacacccgggacctggagtggtccgcctgtcatctacgggtgctaggaaaccagaggggcttcagggagaactgggacatggttcactttgtgctgcccagacaggaccccttgcacgcaagcctgggtcacagctctgtcacactgtgcgcacaggtcccccttgccccgctcatgtgggctccattaagcctcagcctggctcctgcttgagccaagggaggcagggagcaagatttcaccttgtgttgacagcaagacctctctgcaattatggatttttttggcttggcacacatcacttcacaacacagatgcaggacctttgggagccttctgggagagaggctgggcagccctgccaatcactccctgggcaaccaccccagggctcgagcaacagcctgagcggcccagccagtgggcaaagcagcttgcttaggccgtcctcattggctggcttcccaccgtggctagggctttcattggtctcggtccttgatgtcacctgtctctgaggctccccaaaaagggagatcttgtgcgtaaagcatcaggtatacaagacagccaacaaatagcagctgtggccattggctttctcagcagtgaagcctcctcagagactccttcccagccatctctaacacggccccctctagctcgttgctctctcccagcatttatttcctttttttttttttttaagacaaggtctcactccattgcctaggctggagtacagtggtgcagttgtaactcactgcagcctcaaactcctggtcttaagcaatcctctggcctcagcctcccaagtagctgggactacaggcacatgtcaccacgcccagctaatttttgtattttttttttgtagagatgaatctcactatgttactcaggctggtctcgaactcctggcctcaagtgatcctcccacctcagcctcccaaagtgctgggagtctttcccttatagcgtctgttgccatcttgctttatgcccctagacttggacgtctgcaagtcctgttgactgctacgtccccagctcccaccacacaagctgtctattattatggagtgagtgaatgaatcctgtcaatccacataaactgaaacccatgatgatgacaatgatgatgacgatagcagctaaaatatacagcatggatggtgtgctaggcattatttctaagtatgctacataatttgtcttctttaatcctcacaaaaccattatataaaggtaggtactgttattatcattttataaatgagaaaacagaaaacttattaaagatttgctcagattcatagtgagtggtactatggtggttacgaacccagccagtccagctctagagtctgtgtttttgaccatatcaatggagatctatttaacaaacactcctggaggcccactctgcatctggccaggctagcagctcctcctgagaagctcctaggctggtggggagacaggctgagtgtctgatggcagtcgtgggggctggtggccagcatggcttctaggaggagttcaggaaacataaaaagtttctctcttgatgcagtggctcacacttgtaatcccagggctttgggaggctgaggtgggaggattgcttgaggccaggagtttgagaccagcctggccaacatagtgaaaccctgttgctacaaaaaaatgtaaattagccaggcacagtggcatgtgcctataatcccaactactcgggaggctgatgaggcaggaggatcatttgagactaggaggttgaggctgcagtgagctatgatcatgccacagcattccagcctaggcgacagagtgagaccttatctcttagaatttaaaaaaaaattttttttgaaggttttctttccatcttcttgccctcgagccctgtgaaaaagtggctttgaaacatgcatgcccatcattgcttttcagattgggtaactcaaggcgtccctggagtacactgaggataagtgtttgagaaatgctgtctgaaggaatgaagtcagtctatgacaacgtctctctgccgtgaatcattcctgcagatgaaaaagtgtgacttggcagctggtaagtgaattaatggaccacgtgaacatgggtagatatgaggcagttgtctgccaccaggtgttttttcaaacctggacgcccatgggcactgagtatgcccgtgggcactggtgaggaccacataaaaccggctccccatgcccaccctggcccggcccttacgtacatccttccttgctgatgaaggctccttggggagcctgtgggatgcccttccacacggtgatgggcttagggtagccagggtccgtggcccgccgctcctcgctgtagcgccagtaccgctcgcctttgaaaaagtaggtcttgcccacaggttcccagcgcagagctgtgtcaatgccttcacggggcaaacagctgcccagctcccccaggctgtgggggtacccaggctccaccgtcacctccttaaacacccaatacttgtcacctgtggccaagaggagcccaggatcagcttccccagtcactcagtgccgtttgcccatcttcagggtgtcaggtgaaaacagtctgatgccctcagccccttggcccagttagagttgggaagggcacgaagcctgaggccagtcacagatcctggacaacttgcctctgctgcctgggctccgagtcccaccctcttttgttcatgtgacttgctcctctctcctctctggtgatctcagccacttacatgactttgcatatgcactaccactccccaaacctgctaccagtgacacccgactctgaggctctcccactggacctgagcagcagagccagaaaccctgacctccctcggcctaccggcagctctgcattggctggctccccagagctcctcatctgcaccacagaggggctccctcctcatcaccttctgcctcccaggtccccaacagggagtcctagcctcactgttgaccctctctttccttctcctctcagtattcagccacttcttttttttaagatggagtttggctcttgttgcccaggctggagtgcaatggtgtgatctcagctcaccacaacctccacttcctgggttcaagcgattctcctgcctcagcctcctgagtagctaggattacaggcacgtgccaccatgcttggctagtttttgtaattttagtagagacgtggtttcaccatgttggtcaggctggtctcaaactcctgacctcaggtgatctgccagccttggcctcccaaagtgctgggatttcgggcgtgagccactgcgcctggccgagtattcagccacttctgaggccctctgactctcctggcagctgtcccctgcccttcagctgcacggctcctccctcatttgggcctcatgagtggcgcgctccagaaccacctcagaaatggctgccctgcccctgccatgtctgtcacctcctgccctctggctctctgctgctcggaaacattccatgaatttccagccttggcctaatggatcaagaccacattctggcctggcagccagggctcttcaggatttgcctccaaatgacctttctgggccatttctcacagctttccaaggcggggcctccgtggccatcaggtgggccttctaagccctgtggccgtccgtacacatcccagccctgctcctttattcagccgttgtccctctggaatgccttccttgcttctcactatctgtatctcacccatctgaggtctggcccgagtcaagataactgtcatgaaacaacctagcacagtgctgggtacagggtgggcaccttagctccctcccacaccctcccccgacctccccagcttgagtgacctcttccctctgggttcttacagaactgacccgatggcctcccatgaggtactgggtggtcttcaattgcttgtcccacactctacttcatgtggacgaagctggtcaccccaccaatctcggcacatacagattctcagtctcactttctgacttgatttgtcagaggtcagtgtctccgttagactagaggggccctctgaggacatctgcctcccaccccgcctcttccagtttagatgggaaaaaggaggtcccaagaccttgggcagggaactgtcccacagcacagtctacattacctttgaagaagacaaatctcccatcggccctttcataggctgcgtcgatgcgggcaggcaggcccttccagaactgctcgatctgcatggggtagccctcctgcactcggttattgcgcagacgccagaaccagcgatcctgggaggaagcgggagagggggagagaggtgtgtcaggccctgcctccgaacccagtgattgcagctgtggggcttaggtcccaacagcccagccctccaccgagactgtccattagctgcttctgacttttaaagccctgggaggaagacaggatgctcctgtaactgtcttcaattcagcctcctgctgactcttgctgctgggtggacaatgagacaaacagcagacaggcctggtgtggaaaaggaggtgtgagggagccggaaaggatgatgttggggcctggagtggccacatgggggcagtggagcgtcactgacatcagccagactggtcctcgggacagtgggaggctggggtggtcactgagcctgggccgagcgccctccatgaggctggctccatccagcagggccaggatcatggaagccaagtcatgggaattccctcgagacctgggcatgaattcacattcctccatttatagctgcatgacctaggcctcacctgcaagtgcaggtaataatggagaatcagatgagagattctaggcaaaatgcccagaccagtacggggcacacagtccatgttgagtaaatggcagctaaatagtccgagtccagtaaaaacgcctcttgtaactggtgcctcagtcttgggctggtacacaagcagtctaggcaaggcctgtagcctccaggcctcagttttctttctttttttttttttttagatggagtctcgctctgtcacccaggctggagtgcagtggcgcaatctcggctcactgcaagctccgcctcccaggttcatgctattctcctgcctcagcctcctgagtagctgggactacaggcgcccgccaccacacccggctaattttttatatttttagtagagatggggtttcaccatgttagccaggatggtcttgatctcctgaccttatgatccgccctccttggcctcccaaagtgttgggattgcaaggcgtgagccactgcgcccagcctccaggcctcagttttcttatgtgtaaatggggatgataaaacccggacctgcctatgaacggttcagttggatcaaagtagaatgagtgcagaagaagaagcatgatttgtaaaagatggtacaaaagctagtattttaaaaggtgttttacaaagcactttcacatccaggtttttgaccttattttgactttcatgtctctgttaagttgatctgagatatacggagtcttaagaaaggccaggtgacttgcctagagccactcagtgagaagccagactggggctgactcacgctgcccgattcctgcgcagtgctcagtgcgtgctgggagaactccacaaggggagcgaggcagcctctttcaccatcctgtgtgatggagccaccctgcccagatccccttcagagaagggcttgttgccccagtggccagcagtgtggccagcaggcagttttcaactgtcagcccctttggggatgttccctgcttcagagagctctcctcagtcactggatgcccttcctcatccagtgattgaatgaggtaggggttataatgttccagatattttggacccaacgtaggctgagtgacaggccaccgtagccccagagctccctgcgggggtggctgaggctgccatgggcctctgttgccacttaacctctccctcttccctgtcctgcttccttctccccctcacaaatgttgattctgaaagtactctctaatcgaaatcctgcattccagaccccacctcagagttcactccccgagagcccaacctgcaacacgtcaagcagactgccaccctgtcagtccatggctgatggaggacagatgacaagatataccctgggctgctgccagtagcagcccctcaagccttggtagggtctggagtcagactcagccaccactgacctagcccctactccaagttgaccatcttcagagccgggtactcactggatcttcacacactctttgttagaggaatgactcccccaggtttcggatggagaaactgaggtcccaagaagggtggtcacagaccagaagccagcttccagcactttctcccagcattaaccccaggggaggtgagggatcacccatctttccccctccctcttgggaacagttgattcacccagcagcactaggaagagaccccatgccctggccactgggctagctcctgtccaggccccattgtaatcgaatcccaaatcaggagccttccccagctccatgatgtcggggaggaggaggaaaggtcaggggccagctgggtggtgccaatccattggccctaccttaaagacaaacatctcgccccggaagagggccactgtgttgaagttgccgtcacagatgttgggtttggtgcctggtgtggatggccggtccccgaggggcggccgagggggcctgggctggcgctcgtgtttcctctccgatggtgagtggatcctgcggacggggagtgtagggagtggccttgtgggctccagaggctcggctgggggtcctggagagaggagctgcatcttagagagggggcagccgtttcccgcctcccattgccagtctcagcatcacccaggcagctctgagacaagtctgtcccagttcagcctcctgttccctctccccagtttaactcccccagtctttgagaaaatggatgaaaatagccattagaatgggactctcatctttccatccccgaatctggtatcttctcttttctctctcctgttacagagcaatcatgtccttccttagggtcagcgctcttccttaggccataccctctttgcccccttcacacgcactggccccacttcctcacccccttcatttattctctttcccaccccagtgcagcttctacccgtcacccactccaactgctctgccaagatcatccaatggttacttgactcagactttaataagcacatgcatcatctggggatgttgctaaaatgcagatgagggctcagagggcctggggtggggcctgagagtttgcattccttcacactctcaggtgatgctgatgctgctggtctgaagactacattttgagcagcaagattcatagaaacactttcctggaaacactctcttggttgtcctcctgcctcatgggctgttctttctcagtctcctttgctggctgcgtgtcctcatctgccctactctagaggctggcgtgcccttgggtcctcttctcttccgtctctacattttcatccttaggtcagtgcttcttcacttgggctgcatattaggatcacctttgggagcttttcaaactggatgttcaggaagcaccaggccagctctccaacttttttttttttttttttttttttgagaaggagtctcgctccgtcccccatgctggagtgcagtggcgtgatctaagctcactgcaacctctgcctcccaggttcaagtgattctcctgcctcatcctcccaagtagctgggactacaggcacgtaccaccacacccaggtgattttttttttttttttttttttttttagcagagatggggtttcaccatgttgaccaggctggtcttgaactcctgacctcaagtgatccacccaccttggcctcccaaagtgctgggattacaggcgtgagccaccacgcccaatacccaactattaataaaaccaaatctctagagctgagggctgggtgtctgtgtttttttattagaatcccaaggtaattccaaagggcagccaagttgagaatcactgctctaggtggtctcatccaggctcatggctttacagacctgcatcagagctgtccagtagagtgttctgtgatgatggaaatggtccatatctgcatcgttcactacagtagcccctagccacagccacatatggctactgaggtcttaagatgaatgactagttcttagtgtgactgagacccactaaagaactataactgaaatgataattttaatatatttttgggggggtagagacaggggtctcactttgttgcccaggctggtcttgaactcctggcctcaagcaatcctcccacctcggcctcccaaagcgctaggattacaggtttgagccaccgcgcccggcctaataaatataaatttaaatttcattactatgaaatttaatactagtttatttaatagtagtttatttaatacatactagtgtatgactagtggttactgtattgaacaacaaagatcccaaataagtattccagcctagattttttttttttttgagacggagtctcactctgtcgcctaggctggagtgcagtggtgtgatctcagctcactgcaacctccgcctcccgggttcaagtgattctcctgcctcagcctcccaagtagctgggattataggcgtgcaccaccatgccaggctaattttttgtatttttagtagagacagggttttgccatgttggccaggctagacttgaactcctgacctcaggtaatcgcccgcctcggcctccagcctagaattttgagctgcagactggtggaccctattgcttcacaattacaaaagctggaaaccctgggggcatccttgaccctccctccttcctctcaccccatgtctgatctgtcagcagatcctgttgttctacctttggaatagcttctgggacccacagcccccacctggtctctgctgctttacttgtggaggtcctgcctgtcctccagggctctggctgggtcatctcctccagagggagccctccttctgtgctccgtagcctgtgggctgtgggtgcctgtgctgtcttgacaagcatttgctcaagtaaactggtctccctagctcacctgacttgaccagaacaagaacctcacataccagtgtgaacagaactgggagagaggtgtgtaggaggcctttcatatcttacctagatagcagtagcttctcatctttcaccttttctttctttttttttttttttttttttttttttttttgagacggagtctcgccctgttgcccaggctggagtgcagtggtgcgatctcagctcactgcaacctctgcctcctgggttcaagtgattctcctgcctcagcctcccaagtagctgagatttcacttgcccaccaccacacctggctaatttttttgtttgtttgttttaatatttttggtagagatggggtttcaccatgttggccagactggtctcaaactcctgacctcaagtgacctgcctgcctcagcctcccaaagtgctgggatttcaggcaagagccaccacgcctggccctcgttttttctttttaaagaacaaagctctggttatagtccccatcacgctgtatcaccgttactcctgcagatgtgtgaacctgcctggctagaggtggaatctatgggagcactcagtcaccatctggtgtgggagggagggagagaagcatgaagggacggggaagagtgtggaaggggaggggtaaaggagagggaatgggtggccctcacctcacttttgtccctctcagttacagctcagaccctcccctaggtttcccaggtgtgccaggggaagccttgccctctggccaggcaaagccattggaagtctgtaaaggtcacacacagagaaacagcagcagtgctgatgatagcaacgtccccctccctcgtcccctgccccatgacaggtaggcagtcacagcccagccccgaggaaggagcagtcccccctctccctgccacacaccatagatcttctggatgccctggagatcgtcctggggcagcttgaagttgtgcgtctccatgtactggtagaagggcgccatgatggcgctggggtcgctggagtgctccagtcccagcgcgtggcccagctcatgcacagccaccaggaagaggtcgttccc

SEQ ID NO: 7339 - DNA, 21024 bp, Homo sapiens
cggaagtggaaacggaaacctttttagggagtccaaggtacagtcgccgcgtgcggagcttgttactggttacttggtaagctggtgtgaggggaacctgggagggtcagctccggtcctgggtcgggaggggtgggggccagaggattcagggccggaggttctggtgggggcccagtgggcgggacccgaggacggaggggccgggaggccgagaggggcggggtcgcggcggggcctgagggacggaggccgggatacttgggaaaggatccgccggccttgaactcccgcctccgccgcccctaggcctcatggcggtccgagcttcgttcgagaacaactgtgagatcggctgctttgccaagctcaccaacacctactgtctggtagcgatcggaggctcagagaacttctacaggtgcggcgggagccccggggcttacggtggcggggaggcgtgcgcaggagtcaagagctccggcagtgggagggtgccggcccctctgccccgccaccaccgagtccatgtccctacagtgtgttcgagggcgagctctccgataccatccccgtggtgcacgcgtctatcgccggctgccgcatcatcgggcgcatgtgtgtgggtaaggcaggtggaggacgccgagggagggagtggtctccaagcaccattaattacacccccggagggaacccggagtgacctagggattcccagggtatcatctgttatctctgggcactatagaatctctcaggccaagcgtcaggagatcggggcaaccctctagcaaaggctgctggataatagtaataacaaataatgtaaagtgctttcactcctgttctcattccttcgtcacaaagacactagaaggtaggagttactggcctaacttgactgatgaggaagttgagacttgacctaagtgactcagtaagttccacacctagttcctagtgttggagaaggatttttctcttttttttttttttttgaggccagatttttgctctttcgcccaggctggagtgcagtggcaagatcacagctgtctgcatcctcaacttcttaggctcaagtgatcctcccacctcagcctaccaggtagctagggccacaggcacgtgccaccacacctggctaatttttacatttttggtagagacgcggcctccctgtgttgcccagcctggccttgatctcctgggctcaagtgatcttcttaccttggtctcttaaagtgttgggattataggcgagagccactatacccagccgaggatttgtatctcatctctccctgccactgactgggcaaggtgctttctctttctaagcatccatttctgtctctgtaaagattagctaagatatgcggtcttcctgctcagttacgttggaatcttaaattccctttaccacatctctaccctaccttcctacctgtcagcactgttaattctggtcgttggtcctttcctttttattattattattatttttttttgagatggagttttcgctcttgttgcccaggctggagtgcaatggcacgatcttggctcactgcaacactctcttcaagtgattctcctgcctcagcctcccaagtagctgggattacaggcgcatcccgccacacccggctaatttttttgtatttttagtagagatggagtttcaccatgttggccaggctggtcttgaactcctgacctcaggtgatcctcccacctcggcctcccaaagtgctgggattacaggcgtgagccactgcgcccggccggtcctttcattaagctggatctgtcttccattactgctgcccattgtttcttagttctgctcattgaggtcacttttagaagtctgtttattttatttttttacttttactttaatttttaaaaatcttaagcctgcttgggaggtcgaggcaggtggatcacctgaggtcagcagttcgagactaacctgaccaacatggagaaaccccgtctctactaaaaatacagaaattagccgggtgtggtggcgcatacctataatcccagctacttgggaggctgaggcgggagaattgcttgaaccctggaggtggagctcaccctgcggtgagctgagattgtgccattgcatttcagcctgggcaataagagtgaaactgtgtctcaaaaaaaaacaaaaaacaaaaaacaacaacaacaaaaacttaagcctagtgacctcaaagtattttcctattcagttaaaatactctgatctctaaccatgcccttaggacttgaagcaagttctgacaacaagggagattttagcttagtccttgtgtattttatgatgggagtgacctggaattcagaaattgattggcgtgtatttgtagattgttcattcttgttgctgtatggtgtgttttgtgtaagtatatcacaacgtattcatccattccatcgacagtgcatttgggcagttttcactttggtctgttaggaatagtgctgctggccgggcatggtggctcacgcctgtaatcccagcactctgggaggccgaggcgggcggatcacgaggtcgggagatcgagaccatcctggttaacacggtgaaaccccgtgtctactaaaaatacaaaaaaattagccaggtgtggtggcgggtgcctgtagtcccagctacttgggaggttgaggcaggagaatggtgtgaaccggggaggtagaacttgcagtgagccgagattgtgccactgcactccagcctgggcaacagaacaagactccgtctcaaaaaaaaaaaaaaaagtaatagtgctgctatgtttttttagtgaacacatgtacatatttctactgggtatatgatacctaagagtggcatggcagagtcacaggttatgtgactatttagtagtagttgcagatgatgccagataattatctaaagtgattgaccaacttacactcctgtctcagtatgagagttcagttgctccatatatctttgccaacacttggaattgatgacttgtaaaaattttagtcattctggctgggggcagtggctcacacctgtaatcgtagcactttgggaggtcgaggtgggcggatcacctgaggttaggagttcgagaccagcctggccaacatagtgagaccccatctctacaaaatcacaaaaagttagccaggtgtggtggcacgcacttgtaattccagctactcaggaggccgaagcaggagaatcacctgaacccaggatgcagaagttgcagtgagctgagatcgcaccactgcgctccagcctgggtgacagagtgagactctgccttaaaaaataataatctagccattctgctatgtgtgtagtgttagctcagttttttttgtttttttgttttttttttttggagacggagtttcgctctgtcacccaggttggagtgcagtggcgcgatctcggctcactgcaagctccgcctcccgggttcacgccattctcctgcctcagcctcccgagtagctgggactacaggcgcccgccaccacgcctggctaattttttgtatttttagtagagacggggtttcaccgtgttagccaggatgatctcgatctcgatctcctgaccttgtgatctgcccacctcagcctcccaaagtgctgggattacaggcgtgagccaacacgcccggcagctcagtttttaagtagcaaaatatacagctaatgccaagagctcagcttccctcccagttggtgatggtgaagtaggcaggatttattgggattcctgggtggtctctggcctgccctgggtgttttccagatcagtgggttggagggctgggctctgggcctaaagctttcctgggaaagctgattgggctgggctgagtggtatcctcagcccctagggctcagcaggcatcttgtgtattcaccctctaatttgggtttctccagggaacaggcacggtctcctggtacccaacaataccaccgaccaggagctgcaacacattcgcaacagcctcccagacacagtgcagattaggcgggtggaggagcggctctcagccttgggcaatgtcaccacctgcaatgactacgtggccttggtccacccagacttggacagggtgaggcagcccaacttgacccaagagtcacagggccatcctagtcagtggttagccactgttctttcccaacaggcagcaattaggggtctctcctgtggtttttctatatgggctcttgagtttcaggtactcattggaatagtgataacagaggccttatcaagtgtcagaaagaagctggggagggtatgaatccttcatgattggggagattgaaccatccagtcctgcatcctgggccaggataggtgattgactgttgaacttttgactgtgggtgagaggggaaagaagtgatattgagaccagcctccagctgttcagggcatgcatgaatattaggggcttcacagctgcccttgactctgctctaagctgtacttcctcctttctctgggtgaggctttcatatgaggtacagaggagaaatgaggggctcagggagccaaggcctggatgcttctgggcatggagaaccttggttctggggctgtaagttctgagccctgaacacaatatctttgattgacaggagacagaagaaattctggcagatgtgctcaaggtggaagtcttcagacagacagtggccgaccaggtgctagtaggaagctactgtgtcttcagcaatcagggagggctggtgcatcccaagacttcaattgaagaccaggatgagctgtcctctcttcttcaagtcccccttgtggtaagcattcctgtcctctgaaccccgtctcccgaggcagatcctttcgcctagtgtttgggagtctgggtcattacctgccacagtttgggactggggctgcaggtcagggaggagcagggtttggggagagtcttcattgaggagggagagaatttggtgccgtgactcacattgagcccatcccttggcaggcggggactgtgaaccgaggcagtgaggtgattgctgctgggatggtggtgaatgactggtgtgccttctgtggcctggacacaaccagcacagagctgtcagtggtggagagtgtcttcaagctgaatgaagcccagcctagcaccattgccaccagcatgcgggattccctcattgacaggtacctggggcctctcctttcttctgctcagggttgggggttaacttgcattttgagagtatggggaaaagatgtcatctagaatgggagcctaccagtttgttctggtagcttctcgagtgtgagagcatatctgtacactgctgagcagataagagccagcatattcaaaaaatatttcttgagcatctgctaatcctcatctttgtggtttttcagggctaggatactagagcagtagctgcttgagcagcttgtcagagctggtcccgggatgagggctgaggcaggcacctcacttgagagtgaggtgggctctgtgaaacagctactgaccgtgcgctttcctttctcttcagcctcacctgagtcaccttccaagttgttccatgggctcctggctctggactgtggccaaccttctccacattccgcccaatctgtaccggatgctggcagggaggtggcagagagctcactgggactgaggggctgggcacccaacccttttccacctgtgcttatcgcctggatctatcattactgcaaaaacctgctctgttgtgctggctggcaggccctgtggctgctggctgagggttctgctgtcctgtgccaccccattaaagtgcagttccctccgggccattctgaatgtgatgtttggggccctcagcctgtgtacaatccctgcactctccagttgttccagcattctgggaagatagggtgggatgaacacaacacacacccaacccagttcaccacctccacacacgccattcccttctcctctaccatcaggatgtgaggcttcatcctggggcaagaaacactctccactacagttctccttttttcttttttctttttgaggcagtgtctccctctgtcacccaggctggagtgttgtgacgcaaggatggctcactgtagccttgacctgttgggctcaagcgatcctctcgcctcgtttatttttttgtagaaacgaagtcactgtgttgcccaggctggtttatactcctgaactcaagcgacccaccgcctcggcctcccaaagtgttgggattacaggcgtgagccacggcgcccggtctagttctcacagttttcacccgacttctgcgccggtcttctctggccttgaaaggcagagagtccgttccgattttcccctgagctgggcaagtcccctgtgagagctctggggcatctggcttcggggcattctttgactaaggtggatggaggttgcaggtcttttcctgggtgggcgtggggcggggcagcgggttcccagcgtcctcctggcctgggcgtcttggaggctgttggggtgcattccgtccccttgcgcggggcggggccttgaggcgctggggcgggattggcgggggacggtcgcggagccccgccccgaagcacagggtcgagtcccttctttccgctccaacgcacggagggtgaggttggtacgcggtggtggcgtcacggcgccagctcctcccgacgccgaggtgggttccgggagacccgcgggtctggctgcgagaggtgagggcagagccggggcggggccctagcggggtgtcccggcgacccagaccttaaagggcttctcttcttgcagaccatgggggctcagctaagcggcggccgcggcgccccggagcctgcgcaaacccagccccagccccagccccagcctgcggcgccggagggcccggaacagccccggcatccgccccagccccagccccagccccagccccagccccagccccagcccagcccgagcccagcccgtgggggccgctggacgacgtgcgcttcctcatcgcctgcacttcctggtactgacggcgtcctccgcaggatgtcgcccgtctgtccgccgtcccctgtggttcttgcctgccttgtctcctctccccacgtccctgcgtctcttacaccccctcccacccgaggctccccagagatagcagagaattcgaagaggtcgccggggactggaaagaagtcccggcagggccgccttcgcagtctacaccccagcctgcttcccagcctacacccagacccagctcagaccttcgtgaccaccccatccctttctccggctggctgggtcgggggcatccctctctgtcgctggcttccagaggcaggacaggcctcctggtaagcccgcaaagttgctgacctcctgacttcgtctgccttttattaatatctgtattgctgataaccgtgctcttgactatgtgtcccaggtcatgtcccaggtcatggagaagcccgtgccacagtgaccctccccatactcctgggggggctgctctccatcctggatcgtaaggaggcatcatcaggctgtgttcctggaaccccaataaccctgggcccccagggccagcctgttgtagagggaggctatctgaccgccggtctggcagaggagatgggtgggcagctcccagacaccccaaaggacccggttctcttcccagagcgtcctaaggttactcttggaacctgatctttgttccctcatcccagggaaatgacacactctgtatttctgttttatttagaaatgatttaaaaaacattatacaaaggctgatcagtttaaaatgtgactgacactgaaatgctgtgatgtcccccaggctgaggggaagctaggctctggggcccccagtgctttgcccctctgtctgccctgtcctggggtgatggacaaacagatgaccacaggcaggagaatctgagattggaagcctctaggctgagccctctgggcctggccccacatccctcacctctgcagcctgggctgcctgcctccatctcctgttcattctcagctggcctgccaggagccaatggggagcctggcgggaggcgggggtgcctagagctttcaagaagtgagagcaccaacctgaggagtggacagggaccaggaagtgggggaagggaggccaggaagaggtggatacaggagacacttctcatctcatctcagaccctagaggggtccacagatggggacacaagacccagccagcccactggatggcccgggcaagtaacaacctctctgtgcttcatctgagggcacggtgagagttaccgtcggcctcccagggcctaacacgagtttcatgtgagtggacaggtgtgagctaataaagtgctttgcaaagtataaaacactgtacaaacctatgaatcactaatatctccgcagttgttccctgcctgtcccagggagcctgcccttggccaaaatgagaaaaaacaaggatgatgacaggggacacagcggacccacatgggcacctctgggacaagagattttgcttgagacagctcccagggcagcaggagtccctgtctgtgctacagggtaagccgaccccaatcccagagaccacagggtcgggggcaaggcccatgcaggctcagtgagcaggggtggcatccgagacccggccagcacgctggagactgcctgacacctttttggctttggcagagagccagtgggcattgatgaacccattggccttgtctagggctcctcagtgacaagcagggctgcctccgccgtactgtggagcaaggcaggccaagccctaggaactcctgctggagacagtgaagggcgggccagtgaaggtcaaaaagggagccccctcagcttggggctgctaccggtaggggtgtccttctaagagcagtgtgggaagatgggcccagtgagcgaggtcagcaagggccaagctctgggaaaacactgcttccagccgagagattgagtcggcctcagagtagctggagtcggcctcagagtagtgggggcactgagcacttcagacgccctggtccccttccgaaggactcccaggctctgccagtgttggccctgcagccatctctgcctcacctaactggtgaggctgagctccaggctgcaagtgacagactggagcaaagctggggacagtgacaatagaggggagtggaggacggtcacaaactcggatcttcctccagaaatggggtcagcttctgccccagctctgtagccataggagcagagctcagctactggggtgtctgggcgctagagtggccttagcagcaccttggtccttgtcgcctgggggagggccgctatgctggcctcatcaccaagacagtcacctctagttcacctaaagcctcaagcagcctttgcaaaatgggacagtagtgacaggacatttaaatattcacgatgtgacagctgggtccttgtcagacccagctgggccacagccctgcctgcagcatgtgaccctaaatcctgggtctccgaagagaccctgacaagtggagcaggtttcctgagggatctgccgtctgccagcagggaaacccaggcttgttgctcactgtgtcagaagcaggggtcctgtagccttggaggacagtggggtgggggtagggggacatctgaccagcaggtgttggcaaaaggggaccaggactggtggtatctcccggatgggggatgagagctagtgctggcttcccacagagggtgctgggttccagccaggagtggagctgtggtacctcatggacaccacaggatgccgtgaccacaggggctcctcctggcatggtccctgcctccggatggagcctggcctattcccttaagtagggagtagtttgcccaggacagaaggctggcagctgggtgccagacacccaccctggggcacagcccccataattccctgccccacgctcagcctaggccaatgcacccaccacttcagctgtacgaccccagcctagggccctgctggccctggtgagcactggccagagctgcccctcagaccctggtgaggaagggcctggctggccagaccaagtggatagagagggctctgggctgctcacacccattcctggactggccgcttatagtaggtgacaggctgagggcctgtcttgttcttgaactggaagatggtgtagaccagcaccaggatgcagagggacaggatgcaggggatgaccacggccacggcgttcacggagcccggcacatcgttgatggtcaccatgatgtccacgtcgtcctggggcagccgccgctccttccgccgctccacctccttctggttgcagcccatccagtcacgcaggatgttgcgcgggtagcctggctccacgctcagtttctggttgtcaaacttccagtagtcccggcccttgtagaaataggtgtaatctgcagaaatacagcccagcatcaccactcccagacacttccggcacctgctctggggcagtgtgaaaaggagggcacaggcactgtggcaagggaggcaaggtgggcacacctggaggtttggggtgcagtgcttggctgagtcatggagtaagaagctgcagagggggacacccgggacctggagtggtccgcctgtcatcctacgggtgctaggaaaccagaggggcttcagggagaactgggacatggttcactttgtgctgcccagacaggaccccttgcacgcaagcctgggtcacagctctgtcacactgtgcgcacaggtcccccttgccccgctcatgtgggctccattaagcctcagcctggctcctgcttgagccaagggaggcagggagcaagatttcaccttgtgttgacagcaagacctctctgcaattatggatttttttggcttggcacacatcacttcacaacacagatgcaggacctttgggagccttctgggagagaggctgggcagccctgccaatcactccctgggcaaccaccccagggctcgagcaacagcctgagcggcccagccagtgggcaaagcagcttgcttaggccgtcctcattggctggcttcccaccgtggctagggctttcattggtctcggtccttgatgtcacctgtctctgaggctccccaaaaagggagatcttgtgcgtaaagcatcaggtatacaagacagccaacaaatagcagctgtggccattggctttctcagcagtgaagcctcctcagagactccttcccagccatctctaacacggccccctctagctcgttgctctctcccagcatttatttcctttttttttttttttaagacaaggtctcactccattgcctaggctggagtacagtggtgcagttgtaactcactgcagcctcaaactcctggtcttaagcaatcctctggcctcagcctcccaagtagctgggactacaggcacatgtcaccacgcccagctaatttttgtattttttttttgtagagatggaatctcactatgttactcaggctggtctcgaactcctggcctcaagtgatcctcccacctcagcctcccaaagtgctgggagtctttcccttatagcgtctgttgccatcttgctttatgcccctagacttggacgtctgcaagtcctgttgactgctacgtccccagctcccaccacacaagctgtctattattatggagtgagtgaatgaatcctgtcaatccacataaactgaaacccatgatgatgacaatgatgatgacgatagcagctaaaatatacagcatggatggtgtgctaggcattatttctaagtatgctacataatttgtcttctttaatcctcacaaaaccattatataaaggtaggtactgttattatcattttataaatgagaaaacagaaaacttattaaagatttgctcagattcatagtgagtggtactatggtggttacgaacccagccagtccagctctagagtctgtgtttttgaccatatcaatggagatctatttaacaaacactcctggaggcccactctgcatctggccaggctagcagctcctcctgagaagctcctaggctggtggggagacaggctgagtgtctgatggcagtcgtgggggctggtggccagcatggcttctaggaggagttcaggaaacataaaaagtttctctcttgatgcagtggctcacacttgtaatcccagggctttgggaggctgaggtgggaggattgcttgaggccaggagtttgagaccagcctggccaacatagtgaaaccctgttgctacaaaaaaatgtaaattagccaggcacagtggcatgtgcctataatcccaactactcgggaggctgatgaggcaggaggatcatttgagactaggaggttgaggctgcagtgagctatgatcatgccacagcattccagcctaggcgacagagtgagaccttatctcttagaatttaaaaaaaaattttttttgaaggttttctttccatcttcttgccctcgagccctgtgaaaaagtggctttgaaacatgcatgcccatcattgcttttcagattgggtaactcaaggcgtccctggagtacactgaggataagtgtttgagaaatgctgtctgaaggaatgaagtcagtctatgacaacgtctctctgccgtgaatcattcctgcagatgaaaaagtgtgacttggcagctggtaagtgaattaatggaccacgtgaacatgggtagatatgaggcagttgtctgccaccaggtgttttttcaaacctggacgcccatgggcactgagtatgcccgtgggcactggtgaggaccacataaaaccggctccccatgcccaccctggcccggcccttacgtacatccttccttgctgatgaaggctccttggggagcctgtgggatgcccttccacacggtgatgggcttagggtagccagggtccgtggcccgccgctcctcgctgtagcgccagtaccgctcgcctttgaaaaagtaggtcttgcccacaggttcccagcgcagagctgtgtcaatgccttcacggggcaaacagctgcccagctcccccaggctgtgggggtacccaggctccaccgtcacctccttaaacacccaatacttgtcacctgtggccaagaggagcccaggatcagcttccccagtcactcagtgccgtttgcccatcttcagggtgtcaggtgaaaacagtctgatgccctcagccccttggcccagttagagttgggaagggcacgaagcctgaggccagtcacagatcctggacaacttgcctctgctgcctgggctccgagtcccaccctcttttgttcatgtgacttgctcctctctcctctctggtgatctcagccacttacatgactttgcatatgcactaccactccccaaacctgctaccagtgacacccgactctgaggctctcccactggacctgagcagcagagccagaaaccctgacctccctcggcctaccggcagctctgcattggctggctccccagagctcctcatctgcaccacagaggggctccctcctcatcaccttctgcctcccaggtccccaacagggagtcctagcctcactgttgaccctctctttccttctcctctcagtattcagccacttcttttttttaagatggagtttggctcttgttgcccaggctggagtgcaatggtgtgatctcagctcaccacaacctccacttcctgggttcaagcgattctcctgcctcagcctcctgagtagctaggattacaggcacgtgccaccatgcttggctagtttttgtaattttagtagagacgtggtttcaccatgttggtcaggctggtctcaaactcctgacctcaggtgatctgccagccttggcctcccaaagtgctgggatttcgggcgtgagccactgcgcctggccgagtattcagccacttctgaggccctctgactctcctggcagctgtcccctgcccttcagctgcacggctcctccctcatttgggcctcatgagtggcgcgctccagaaccacctcagaaatggctgccctgcccctgccatgtctgtcacctcctgccctctggctctctgctgctcggaaacattccatgaatttccagccttggcctaatggatcaagaccacattctggcctggcagccagggctcttcaggatttgcctccaaatgacctttctgggccatttctcacagctttccaaggcggggcctccgtggccatcaggtgggccttctaagccctgtggccgtccgtacacatcccagccctgctcctttattcagccgttgtccctctggaatgccttccttgcttctcactatctgtatctcacccatctgaggtctggcccgagtcaagataactgtcatgaaacaacctagcacagtgctgggtacagggtgggcaccttagctccctcccacaccctcccccgacctccccagcttgagtgacctcttccctctgggttcttacagaactgacccgatggcctcccatgaggtactgggtggtcttcaattgcttgtcccacactctacttcatgtggacgaagctggtcaccccaccaatctcggcacatacagattctcagtctcactttctgacttgatttgtcagaggtcagtgtctccgttagactagaggggccctctgaggacatctgcctcccaccccgcctcttccagtttagatgggaaaaaggaggtcccaagaccttgggcagggaactgtcccacagcacagtctacattacctttgaagaagacaaatctcccatcggccctttcataggctgcgtcgatgcgggcaggcaggcccttccagaactgctcgatctgcatggggtagccctcctgcactcggttattgcgcagacgccagaaccagcgatcctgggaggaagcgggagagggggagagaggtgtgtcaggccctgcctccgaacccagtgattgcagctgtggggcttaggtcccaacagcccagccctccaccgagactgtccattagctgcttctgacttttaaagccctgggaggaagacaggatgctcctgtaactgtcttcaattcagcctcctgctgactcttgctgctgggtggacaatgagacaaacagcagacaggcctggtgtggaaaaggaggtgtgagggagccggaaaggatgatgttggggcctggagtggccacatgggggcagtggagcgtcactaacatcagccagactggtcctcgggacagtgggaggctggggtggtcactgagcctgggccgagcgccctccatgaggctggctccatccagcagggccaggatcatggaagccaagtcatgggaattccctcgagacctgggcatgaattcacattcctccatttatagctgcatgacctaggcctcacctgcaagtgcaggtaataatggagaatcagatgagagattctaggcaaaatgcccagaccagtacggggcacacagtccatgttgagtaaatggcagctaaatagtccgagtccagtaaaaacgcctcttgtaactggtgcctcagtcttgggctggtacacaagcagtctaggcaaggcctgtagcctccaggcctcagttttctttctttttttttttttttagatggagtctcgctctgtcacccaggctggagtgcagtggcgcaatctcggctcactgcaagctccgcctcccaggttcatgctattctcctgcctcagcctcctgagtagctgggactacaggcgcccgccaccacacccggctaattttttatatttttagtagagatggggtttcaccatgttagccaggatggtcttgatctcctgaccttatgatccgccctccttggcctcccaaagtgttgggattgcaaggcgtgagccactgcgcccagcctccaggcctcagttttcttatgtgtaaatggggatgataaaacccggacctgcctatgaacggttcagttggatcaaagtagaatgagtgcagaagaagaagcatgatttgtaaaagatggtacaaaagctagtattttaaaaggtgttttacaaagcactttcacatccaggtttttgaccttattttgactttcatgtctctgttaagttgatctgagatatacggagtcttaagaaaggccaggtgacttgcctagagccactcagtgagaagccagactggggctgactcacgctgcccgattcctgcgcagtgctcagtgcgtgctgggagaactccacaaggggagcgaggcagcctctttcaccatcctgtgtgatggagccaccctgcccagatccccttcagagaagggcttgttgccccagtggccagcagtgtggccagcaggcagttttcaactgtcagcccctttggggatgttccctgcttcagagagctctcctcagtcactggatgcccttcctcatccagtgattgaatgaggtaggggttataatgttccagatattttggacccaacgtaggctgagtgacaggccaccgtagccccagagctccctgcgggggtggctgaggctgccatgggcctctgttgccacttaacctctccctcttccctgtcctgcttccttctccccctcacaaatgttgattctgaaagtactctctaatcgaaatcctgcattccagaccccacctcagagttcactccccgagagcccaacctgcaacacgtcaagcagactgccaccctgtcagtccatggctgatggaggacagatgacaagatataccctgggctgctgccagtagcagcccctcaagccttggtagggtctggagtcagactcagccgccactgacctagcccctactccaagttgaccatcttcagagccgggtactcactggatcttcacacactctttgttagaggaatgactcccccaggtttcggatggagaaactgaggtcccaagaagggtggtcacagaccagaagccagcttccagcactttctcccagcgttaaccccaggggaggtgagggatcacccatctttccccctccctcttgggaacagttgattcacccagcagcactaggaagagaccccatgccctggccactgggctagctcctgtccaggccccattgtaatcgaatcccaaatcaggagccttccccagctccatgatgtcggggaggaggaggaaaggtcaggggccagctgggtggtgccaatccattggccctaccttaaagacaaacatctcgccccggaagagggccactgtgttgaagttgccgtcacagatgttgggtttggtgcctggtgtggatggccggtccccgaggggcggccgagggggcctgggctggcgctcgtgtttcctctccgatggtgagtggatcctgcggacggggagtgtagggagtggccttgtgggctccagaggctcggctgggggtcctggagagaggagctgcatcttagagagggggcagccgtttcccgcctcccattgccagtctcagcatcacccaggcagctctgagacaagtctgtcccagttcagcctcctgttccctctccccagtttaactcccccagtctttgagaaaatggatgaaaatagccattagaatgggactctcatctttccatccccgaatctggtatcttctcttttctctctcctgttacagagcaatcatgtccttccttagggtcagcgctcttccttaggccataccctctttgcccccttcacacgcactggccccacttcctcacccccttcatttattctctttcccaccccagtgcagcttctacccgtcacccactccaactgctctgccaagatcatccaatggttacttgactcagactttaataagcacatgcatcatctggggatgttgctaaaatgcagatgagggctcagagggcctggggtggggcctgagagtttgcattccttcacactctcaggtgatgctgatgctgctggtctgaagactacattttgagcagcaagattcatagaaacactttcctggaaacactctcttggttgtcctcctgcctcatgggctgttctttctcagtctcctttgctggctgcgtgtcctcatctgccctactctagaggctggcgtgcccttgggtcctcttctcttccgtctctacattttcatccttaggtcagtgcttcttcacttgggctgcatattaggatcacctttgggagcttttcaaactggatgttcaggaagcaccaggccagctctccaacttttttttttttttttttttttttgagaaggagtctcgctccgtcccccatgctggagtgcagtggcgtgatctaagctcactgcaacctctgcctcccaggttcaagtgattctcctgcctcatcctcccaagtagctgggactacaggcacgtaccaccacacccaggtgatttttttttttttttttttttttttttttagcagagatggggtttcaccatgttgaccaggctggtcttgaactcctgacctcaagtgatccacccaccttggcctcccaaagtgctgggattacaggcgtgagccaccacgcccaatacccaactattaataaaaccaaatctctagagctgagggctgggtgtctgtgtttttttattagaatcccaaggtaattccaaagggcagccaagttgagaatcactgctctaggtggtctcatccaggctcatggctttacagacctgcatcagagctgtccagtagagtgttctgtgatgatggaaatggtccatatctgcatcgttcactacagtagcccctagccacagccacatatggctactgaggtcttaagatgaatgactagttcttagtgtgactgagacccactaaagaactataactgaaatgataattttaatatatttttgggggggtagagacaggggtctcactttgttgcccaggctggtcttgaactcctggcctcaagcaatcctcccacctcggcctcccaaagcgctaggattacaggtttgagccaccgcgcccggcctaataaatataaatttaaatttcattactatgaaatttaatactagtttatttaatagtagtttatttaatacatactagtgtatgactagtggttactgtattgaacaacaaagatcccaaataagtattccagcctagattttttttttttttgagacggagtctcactctgtcgcctaggctggagtgcagtggtgtgatctcagctcactgcaacctccgcctcccgggttcaagtgattctcctgcctcagcctcccaagtagctgggattataggcgtgcaccaccatgccaggctaattttttgtatttttagtagagacagggttttgccatgttggccaggctagacttgaactcctgacctcaggtaatcgcccgcctcggcctccagcctagaattttgagctgcagactggtggaccctattgcttcacaattacaaaagctggaaaccctgggggcatccttgaccctccctccttcctctcaccccatgtctgatctgtcagcagatcctgttgttctacctttggaatagcttctgggacccacagcccccacctggtctctgctgctttacttgtggaggtcctgcctgtcctccagggctctggctgggtcatctcctccagagggagccctccttctgtgctccgtagcctgtgggctgtgggtgcctgtgctgtcttgacaagcatttgctcaagtaaactggtctccctagctcacctgacttgaccagaacaagaacctcacataccagtgtgaacagaactgggagagaggtgtgtaggaggcctttcatatcttacctagatagcagtagcttctcatctttcaccttttctttctttttttttttttttttttttttttttttgagacggagtctcgccctgttgcccaggctggagtgcagtggtgcgatctcagctcactgcaacctctgcctcctgggttcaagtgattctcctgcctcagcctcccaagtagctgagatttcacttgcccaccaccacacctggctaatttttttgtttgtttgttttaatatttttggtagagatggggtttcaccatgttggccagactggtctcaaactcctgacctcaagtgacctgcctgcctcagcctcccaaagtgctgggatttcaggcaagagccaccacgcctggccctcgttttttctttttaaagaacaaagctctggttatagtccccatcacgctgtatcaccgttactcctgcagatgtgtgaacctgcctggctagaggtggaatctatgggagcactcagtcaccatctggtgtgggagggagggagagaagcatgaagggacggggaagagtgtggaaggggaggggtaaaggagagggaatgggtggccctcacctcacttttgtccctctcagttacagctcagaccctcccctaggtttcccaggtgtgccaggggaagccttgccctctggccaggcaaagccattggaagtctgtaaaggtcacacacagagaaacagcagcagtgctgatgatagcaacgtccccctccctcgtcccctgccccatgacaggtaggcagtcacagcccagccccgaggaaggagcagtcccccctctccctgccacacaccatagatcttctggatgccctggagatcgtcctggggcagcttgaagttgtgcgtctccatgtactggtagaagggcgccatgatggcgctggggtcgctggagtgctccagtcccagcgcgtggcccagctcatgcacagccaccaggaagaggtcgttccc

SEQ ID NO: 7340 - DNA, 437 bp, Homo sapiens
ggctctgggtgctttaagaatgtctgggagggtcgagcagggattctgaggagagaggggtcatttaaacctggaggaagatgttcagggaaagcttcacaaaggtgaagttgaagctcagtcttgaaggatcagaagttagtcaggagaacggattcagggggcaggagaggaagggtgggggtggcattcctggcggatggaatgcaataaacacagtccagagacaggcagtttcattccacctggctctggaacaaagcaggaggggagggccggagagagatgaggtcagccaggctggaaagcagggcgcttaatgccatacaaaggaatttggatcagcttcttggctagtggggggtttaagtaggagtgggggtggtgatacaattaaatcactctggctgcagttgagggaggattagagggaacaa

SEQ ID NO: 7341 - DNA, 854 bp, Homo sapiens
ccaggccctgaaggatggggaggttttggacagagggaggagagagttagaaaaatttttggtagagagaatcaggtgaaagagatgccctaaagaggactgagtgggtctgaggtgaatgagtgaggaagagcagagtatgtggatacccggaaacacacacacacacacatcatcattatcatcatcatcattgtcgtcgtcatcatcttgctgagtcatcatcatcatcatcatcattgtcgtcgtcatcatcttgctgagtgtctcttgaagtacaggctgtgacaggttgtgggccattttcctgaactcaccacttacccgggatagtaaacatgatacacatcaataaaggcagactttattgtgaatcacagcgcctggtgtatcctgaactttgaggagttatgggagggacacgttgggggaatgggaagggcaccattcaggccaattatggggaaacccctggaggagggtgaatgccgaaggaggaattgggggagtccaggggctccaagttaccactgtgacattttgagagaacccggggcttttgcagattctacaaaatgtgggccaagttcatcctgtccaagtgtgcagcagggcccttggcccccatcactatcctggggacagaagttggctgctgagtgagtgatagaggccgtgcgagaggcacatcgtggaagccaaccagcacccacatccttgcccaccctggacccctttccagccttttcctgagcccctgcttcctcagtcctcccctctctccagcacctgcagcctggctgcctttccgtctctggctgcgctctttctccagcctcggtctggccgcactt

SEQ ID NO: 7342 - DNA, 437 bp, Homo sapiens; identical to SEQ ID NO: 7340

SEQ ID NO: 7343 - DNA, 854 bp, Homo sapiens; identical to SEQ ID NO: 7341

SEQ ID NO: 7344 - DNA, 670 bp, Homo sapiens
tcggcacagtgacagaggcacccagggctcagcaagctcatggcccagcttgttggactcagagggcagaagaatcacattctaaacatgataaggtatagccagcaggaggcagattcccagattgattctccagagccttgtaggtcccaagggtgcctatgacaccaatgggaatctgaaccaacacagacagcacagtcttcttaggagaccctagtgcagcagcgctggcctcctcctgagcgtgcacgcttatatggcttctgagctggccaggctacttcatgcatttggtttaatgggtcctcgtaaggcaggagaatcttcttgaacttggagttgggtctgtggtccattggtcagtactttgttcagaggcactgagggtgggaaggctcatggagctggattctgctgctgggaagctgggtgggccttgtttgtgggcctcaggttcaggactgaatgagagtcctcttgttgcgagttgagggtgtactctgggcatgccatgccctttttttgtactaagagggtagaaaagcaaagaccagactagttggcaaattggaacccaactacccagtttatttatttcttaggcgtagaaggaataatttagggggaactgaagagccaacctaaaggaaaaaaataaaataaaggg

SEQ ID NO: 7345 - DNA, 670 bp, Homo sapiens; identical to SEQ ID NO: 7344

SEQ ID NO: 7346 - DNA, 24413 bp, Homo sapiens
ccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgtgagtgcggcggggcggggcggggcgggcgggcgggcgggacgggccggggaagcgggagccctggcccttgccgctcctcgctgctgtcggcagccacttcccgggcgagactgcgcccccggagcacccccggccggagccgtctcgcgtgccgggaggatcggactctttccgtcacccgtttgcacctctgcagctgtcaggagcgggtcaggtgcgaaaagcggtgcggaggtggcgctcataggttacaggggtcagggtctggggctggccgtggtcttcagttaccgccgagcgtgcgggatccttctgcgcttgccgcctccacgtggcacaggccaaggcgtggccagatgggtagatgggtttgttgggtggttgctagcagtttccacgtaacaagggaagcgtatttgagagttacttgattctaacgagactagcagatttgcacttcttgttggaagacgttagcatttgcacggcgaggtctgtgaagccacaggccaggccgtgctgctcagcttgagtaaacccctgacccaaggccctcagggtgtgagcactgactgcaccttccctaagctcgggtctcttcccccagccttcctttcccctgtggctttaacgatttgtagcacgatgcagttcaaatggctaggagtctggaacgtagaaggtgctgaattcattgaaagaatacagtggttctcaactcttgtttaagccggggttctttctatttatttatatattgagacacagtatcgccctgtcgccgaggctggagtgcagtggtgcgatttcggctccctgcaacctccgcctccgattctcctgccgcagcctctcgagtagctgggattacagccgcgcagcaccacgcccggctaattttttttgtatctttagtagagacgggtttcaccatgttggccagggtgctctccaactcctgacctcgtgatccgcccgccttgtcctcctgaagtgttgggattacaggcctgagccacagcgcccagacagaagggattccttttttttttttttttttttttttgagatgagtctcgctctgtcgcccaggctggagtgcagtgacgtgatctccactcactgcaagctccgcctcccgtgttcacaccattctcctgcctcagcctcccgaatagctgggagtacaggcgcccgccaccacgcccggctaattttgtagagatggggtttcaccgtgttagccaggatggtctcgatctcctgacctcgtgattaattttttgtatttttagtagagacggggtttcactgtattagccagggtggtctcgatctcctgacctcgtggtccacccgcctcggcctcccaaagtgctgggattacaggcgtgagccaccgcatgccacctttttttttttaagatgatgtcttgctctttggccaggctggagtgcaatggcgccatcttgtctcactgcaaaccgcaacgccctggttcaaagaattctgctgcctcagcctcccaagtagctgggattacaggcacgcgccaccacgcccagctaatttttgtatttttagtagagacgtggtttcaccaccttggccagggtggtcttgaccacctgaccccgtgatccacccgcctcgacctcccaaagtgatgagattacagtcctgagccaccgcaccctgccagcaggggttcctttttagaaagaagatcatttagggaatccctggtgtgaagcagatataaacagagtttccctgtttaaggagggatggcctggtggtacttgtggttccatcctgtgcccttccccggggtgctggggaacatcctgagctgaggtttctggccccggctgggtctcataaccccagagggacattcaggtttgggcccaggcccaggctaacatggatagtcctagctgggcaccaccgacagtgcgtgttctgttttgaagagatggggtcttgctttgtcgcccagtctggccttgacctcctgggtaaaagccgtccaaccgtctcagcctcctgaggagaggggactgcaggcttgctcggtaatttttcttttttcttttctttttttctttttttttttgacggagtctcgctgtcgcccaggctggagtgcagtggcgtgatcacggctcactgcaagctccgcctcctgggtacacgccattctcctgcctcagcctcccgagtagctgggactacaagtgcccgccgccacgcccggctaattttttgtattttttttagagaccggttttcaccatgttagccagaatggtctcgatctcctgaccccgtgatccacccgcctcggccacccaaagtgctgggattacagacgtgagccaccgcgcccggctttgctccgtaatttttctgtgtgtttttgagactgagtctggctctgccgcccaggctggaatgcagtggcatcatctctgctcactgcaacctttgcctttggggttcaagcgattctcctgcctcagcctcccgagtagctgggatcacaggcgcccgccagcacacctggctaatttttgtgtttttttactagagacggggtttcaccatgttgtttaggctggtcttgaattctggcctcaggtgattcgcccacctcggcctcccaaagcgctgggatgacaggcgtgagccgctgctcatggccttcctcggtaattttaacgatcaggttaggatgggaatcaagggctggacttcagggcacctcggaggacagcggatgttggtgactgactttcttgctgcaggcttatttggagggttcctttgtgtcctagttcctgggggttttcacccgctaacttcacttagagattgaaacttctcccacttccagaagctgaatcgtagtgatcagcctgcggccccctgcagtggtacaggcctggttgagcagcctcaggccgcctccccatagtgcagacctgtgcctctgagttgctccagtcctggcggccccggagctcctgacccgcagtccgctctgccggcgttgccagtgccttggtctgccctctctgtggtggagcggggcccggggcagggtctccaggtgcaccgtggggagccctccatcaggcttttgtttctgtggattgtgttccaggtgtgggctctttcattttgatcccttctctccttcctggcctcactgctggcgggtgagagaggtttctccggagttgactgccccctttccccgggtgccccctgccctgcccctctgcctggtagcccctctgcaagcccggcccctcccgacgctcctggcttcctccgtgcccctttcctggcagcggggtcgccgagattcgcccgttgctttgtccttgctgctctccaggcaaacgggcggctcctcctcaccgactgcctcctctgtcccttgaggctatagccccatgccgcctcgttcccagagtctgccctgacccctcctccggcctgtccttggaagtcacagcagtacattatcccagaactgtctgtgagcaccagcgctcgccctgcactccacagagggggtgcctggaggagagcctcgtgccctgtgggtgtgaattcacgcgctgggacgcacgtccctggcacagggtcacaccaaagtggtgaatgattgttctcattctaataaccgagaggccacacgggcacctgacctgctctttcccctctcctcctccccagagtcactgggggtaggaactgtcaatgagccattttcaggggagggagtggcctcagcttaatccagccaaaggtcccctcgggaggaaacaggcagagctcctcaccgtgacacccacgttcctgtcactgctctgtggcaggaccctgggggactgacacaccctcagtcccctcggggtcagagtgagagtggttgagagcccggggtcgcttcagcccttggcttcccgagtttagcagccaaacccgttgacctggcactgtcttccctgagaggcaggtcccggtctcatctgtgctctgttcactggggcccccgaggttagctaccaaggcgcttcctgaaatgtgacgctgatgcccgtcagcccagttcgtgcctaaccacaggcccaagcagacccaccccaacaccaaagtgtcgctgcctctgtctaaatgcaacgagtgctccccacggcacttccccctgcgtcagtcacctccaaaaattacacctgagctgagaacagacgctgggctctagttagtgacgtgtttgctgcagttgactctgaaggcttaaaaaagtgagacgggctgcgggaggaagagagacgggaacaacgcaccaacccaggagcatcgggggtccctgcctactttacacgtctttctgtgttagaataatttttttttttttgagacggactcttgctgtctcccccgctggagtgcattgcttcgatctctgctcactgcaagctctgcctcccaggttcacgccattctcctgcctcagcctcctgagtagctaggactacaagtgcccgccgccacgcccggctaattttttgtatttttagtagagacggggtttcactgtgttaaccaggatggtcttgatctcctgacctcatgatccacccgcctcagcctcccaaagtgctgggattacaggcgtgagccaccacgccctgctagaataatttttttttagagacggagttgcgctctgttgccccggctggagtgcggtggtgcgatctcggctcgctgcaagctctgcctcccaggttccagcaattctccagccttggcctccccagtagctgagatcacaggcgtgcaccaccacacccagcttttttttgtgtttttagtggagacaggatttcgccatgttggccaggttggagattttatttttcttaagtctcactctgtccagctggagtgcagcagtgtgatctgggtgactgtagcctctgcctccggggttcaagccatcctcccacctgagcctcagagttgctgggattacaggcgtgaaccaccgcttcccactaggtttttgtatttttagtagaggttgggtttcaccatgttggccaggctttggtatccgtgtatcctacacctgctctccgtgccacatgcgcccgcaggttacgccaaggaggccctgaatctggcgcagatgcaggagcagacgctgcagttggagcaacagtccaagctcaaagtgagtggggccggtgtgggcgaggaggccggggcgcacatggggttcaggcgtggagattggtggggctgctactggtgggtagggccaggggcgtgtacatgggcagcagtggggccagggccgagcttgggcgcctcatttcacagagggaaacaaggggaggtgagagacgctgccgcagagccgcccgagagggagggtcagtgttggtgagggcgtctggtcgtcctgagggagggccggtgttggtgagggcatctggtcgtcctgagggagggggtcttcttcacattctcacctcatttcttttcactcagcaggattttttattttattttattttattttattttattttattttatttattttgaaacggagtctcactcttgcctaggctggagtgcaatggcgcaatctcggctcactgcaacctccgcctcccgggttcaagcgattcatctgcctcagcctctggagtagctgggattacaggcacgcgccaccacgcctggctaatgttgtattttagtagagacggggtttctccatgttggtcaggctggtctctaactcccgacctcaggtgatccacccgcctcggcctctcaaactgctgggattacaggcacgcgccaccacgcctggcctattttattttattttgagacagagtgtcactctgtcccccagtctggcgtgcaatggtttgatctcggctcactgcaacctccacctcccgggttcaacctcctgcctcagccttccgagcagctgggactacaggagcctgccaccacatctggcgaatttttgtatttttagtagagaagggggttcagcatgttgtccaggttggtcttgaactcctgacctcaggtgatccagccactttggcctcacaaagtgctgggattataggcaagagcgatggcgcccggcccactcagcaggattcctagaatgggcacgagctctgccctcatcacagtccaaaagtgagcacctgcctggagctgcccagaaacagccttgtggggtggggttggtgtctgacctccctccccgggggccttcgcaggcttctctgctggtgcttctgtgcctgtgggtctggattcctccagggcctgatcctgggtgcagatgcagctggaagccctgaacctgctgcacacactagtctgggcacggagtctctgccgtgccggagctgtgcagacacaggagcggctgtcaggcagtgccagccctgagcaagtgccagctggtgagtgctgtgctctgcaggagtatgaggccgccgtggagcagctcaagagcgagcagatccgggcgcaggctgaggagaggaggaagaccctgagcgaggagacccggcagcaccaggccgtaagagcgcaagaggccgcgagggaggccgcccggctgcggggagcggcctggggcaggactgggagctgggtgtggtcccggggcactctggagtcagccattagagctgccctcggaacggccttgcacaaacgcctaagacctgtaaggtccctcactgctgagccggacgggaggtccccgcgcctccccacgtttgtgtgaggctgatggcgcgtcggagtccccggcgctccgcccagtcggcccagactgcagctcccggctgagatgtgtctttgccgccctcttctcccccagagggcccagtatcaagacaagctggcccggcagcgctacgaggaccaactgaagcagcaggtgagctcagcctcccctgcgaggcgcctgcgtccctgagaacgtaggtggctttgtgggaccagtcagtgggtcagaggccacggggcaagaacgatggggttgctgacggtgggtgctagagcaggggaaactactcggacagacacgcaccagcacacgtgtacaggcacacatgcagatgtgtgcacacatgtacacggagacacaggcacctgcccacacagacacacactcctcgcacacacactcccggcagacaggcacacacacccctgcacacatgggcacacacacacccctgcacacacgggcccacacactcccctgcacacatggggaaacatgggcccacacacacacacccctgtgcgcacacacccctacacaggggcatggacagacacccgcaaacacacccccacacaacacgggcacgcacacacacaccccgccacaacacaggcacacatacccctgcacacaggcctgcacatacacccccacacaggggcatgctcacacagcccgcacacacacaggtatgcagacacacccaaacacacatgggtcctcaggcacacactcccgcatggggcatgcacgcacctcccacacacacccgatcacacataggcatgcacacccctctgcacacatgggggcttacacacccccccgcacacgtgggcccgctcacacagcccacacacataccccttcacacaggcacacaccgccccgcacacacgggcctgcacacacacccccacacgggcatgcacacgcccacacacacgggcgcgcacacacccggacatgcacaaacacccacctgcacacacgggcacaccccaccacacacacacacaggcatggacacacgcacaccccctcacacataggcacacatacacaacccaggcacacacccccttgcacagacgggcacgcacacagtcccacacatgggcacacgcgcacaccgccgcaaacacacacacgggcacgtgtacgcacccccactcacagtgtgcctcatacatacgggcacgcacctgcacacgagggcacacccccaccccccacccccacacacccccgcacccatgggcacacacacattactgcacgtgagggcatgcacacacacgccctgcacacccccacacacagaccccttgtgtgggttccacagcagcggctctccaggcacgacaagcctccttgtctcccacccgggcgcccagctggcagtctgggaggttctgcttgggagggctggtcagtggcggcgggcgggtctctgggtctatgagaaaagcttgggtgacatctgttccctggtccttagggaccgtcaccttcagtcctgagctcgcaggcggggttcacatgttgcctgttgtgggcattgtagctttaacgtttaattggcggaagacagaagcttccttaagcccagcctgaatcagggcagtggtgttgggaggtcggcccgcggtggcccttgtcagggaagccacagtgggggctgtttctgccactggggagtttgggaccctgaacccatcccctcagtgactgccgtcccagccgatgtcacccgtgtctgtgtcagggtgcggcgtctgcaggtccccaggtgcccaggacgcttggagttctgtggtcctggggcggacgcaacctctggattggtgttgagcatttttctggttttaaaggcttttctctttttctgcggcttcttctcagcaacttctcaatgaggagaatttacggaagcaggaggagtccgtgcagaagcaggaagccatgcggcgaggtaggctgtctgctctcctggctggggcggaggtggcgggggctgcttgtggatccggcgtgcactctgagcctgagttctgccgcccggcccctcatagctaccagtgcagtgggcgaggcctgctggggctctgcggggtggggctccctctcggaagacacctctgtctgcgagtggacgccaggatctgttcagggagggcaggagctgcttcacttcatgggaagtacaggggccttttttttttttttgagacggagtctcgctctgtcacccaggcaggagtgcaatagcacgatctcagctcactgcaacctctgcctcccaggtttaagcaattctcctgcctcagcctcccgagtagctgggattataggctcccgccaccacgcccagctaatttttttgtatcttcagtagagaaagggtttcactgtgttggccaggctggtcttgaacttcttgatctcattatccgcctgccttggccttccacagtgctgggattacaggcgtgagcctctgcgttctgcctagaacatgggtctttactgtcctggtttcagtggggatcacaggtatttggtgccatgtggcatttgttggcgagtgctccaggcaaacgtctgtcaccactcttcaccgtgggtgggcttgtggcgaggtgtgtgcgtttaatgttcagtagccaggcacgtggcacgtcacgcgtgtctgagttctgacagctgtgtttctgtgtgaggggggcttccttcagaactccgcgttctggttttttgcttcaaagagctcgtcctgagaagttgcctaggcctctgggtcggatttctgccctaatccatgggcagggccggcctgtggcgctgtccctaccaaggtctgtgtgtgtctgtggcacgggcctgtccatggactgggcttgtccgtggagtgggtcggtccatggccttagcctgttggtggcgtgggccggtccacggcatgggcctgtctgtggcgtgggccggtccgtggtgcgggcctgtccgtggccttagcctgttggtggcgtgggccggtccgtggcatgggcctgtctgtggcgttggtctgtccgtggcgtgggccggtccgtggcgtgggccggtccacagtgtgggtggaggtggacgtgctgcactgcatggtgctgagctgccctgcctctctggggcagccaccgtggagcgggagatggagctgcggcacaagaatgagatgctgcgagtggagaccgaggcccgggcgcgcgccaaggccgagcgggagaatgcagacatcatccgcgagcagatccgcctgaaggcgtccgagcaccgtcagaccgtcttggagtccatcaggtgagcactgcccaggcccgggccggccacagatggagccccgcaggtgtgagtcgctggtcccagggcgctctccagctcttccaggcctggccgccataggctgactccttggtgggggcactgcccctctgtcctggcaaggccgtgccgccatgtcagggcctcaccctcaacctgctctcgctgcgtggtacggatcttcgtgtccttcctggtcacaccactgctttccccgcaggacggctggcaccttgtttggggaaggattccgtgcctttgtgacagaccgggacaaagtgacagccacggtaaacatattcataaaacagggctggcaggtggctgagaggcagcatgtgggggcctcctggagccccaggtcctgtccctgccggctctgcacagccctgtagctctcccagcacagagcaaacccacgttgtacctgctgggctcggctgctcctccctccttgagctgggagaaaaaaatgcagttgccagcctgggccacacggtgagaccccatctctacgaagaataaaacattagctgggtgtgatggtggcgcctgtggtcctgctactcgagaggctgaggtaggaggatcacttaagcccaggaggtttgggctgcagtgagccaacattgcaccactgcactccattcttggcgagagaataagaccttgtctcaagaaaaaaatggccaggcggtagtggctcaggcctgtaatcccagcattttcggaggcggaggtgggcggatcacgaggtccggagatcgagatcatcctggtaagagtgaaaccctgtctctactaaaaaaaagaaaaaaaaagaaaagaattagctgggtgtggtgacatgtgcctgtaatctcgggaggctgaggcaggagaatcacttgaacccgggtggtggaggttgcaatgagtcgagatcccgccactgcaccccaagaccagcatgaccaacatggtgaaaccccatctctgctaaaaatacaaaaattagcaggccaaggtggcgtgcgcctggaatcccagctgcttgggaggctgaggtaggaaaattggttgaacccaggaggcggaagttgcagtgagctgaaaccgcacaattgcactccaacctgtggaagaagagcgaaactctgtctcaaaaaaacaaacaaaataaataagccaggcctggtggctcactggtgtaatcccagcactttgggaggccaagacgggtggatcacttgaggtcagaagttcatgaccagcctggccaacatggtgaaaacccatctctactaaaaatacaaaaattggccgggcctcgtggcacaggtctgtattagctgagtgtggtgacctgagcctgtaatcccagtcactcgggaggctgaggcaggagaactgcttgaacctggaaggcggaggttgcagtgagccaagatggcaccattgcactccagcctggccacagaacaaaaccctttctctaaaaacaaagtcaagggcgcattaagcagctccttcatgtcctcaggtgacaccgtctcaccaacatggcaacaccacctgcaacattcaccgtcacgctgaccaggccaccggcaggtgctgcagtcacagcagtgggcgccggcaccacggcagagcaagtgcccactcagtgccgggcacctactgtgtgctgggcggggtggggggacggaggacacagccatgtgcgacctggggcgccaccacagcaggccagagcctgggcacaaaagagcgaggctttaaacgagagaagaatctgaacttcaaactctcagggttttattccgaataacgaaagtttttgcgaaatggagtcgggttcgctttctgggtctttgatttttttttttttgagacagagtctcactttcaagtgtgctgctcaagtgcagtggcgcgatctcgactcactgtcagcttcgcctcttgggttcacaccattctcctgtctcagcctccggagtagctgggactacaggtgtctgtcgccacgcccggctaatttttttgtatttttagtagagagagggtttcatcctgttagccaagatggtttcgatctcctgacctcgtgatccgcccgcgtgggcctcccaaagtgctgggattacgggcgtgagccaccgtgctcagccacagccagctaattttttcatgtttttagtagagacgaggtttttccaggttggttaggctggtcttgaactccaacctctggtgatacgccggccttggcctcccaaagtgctgggattacagacctggccagcctaaacgatttttaaaacaagttagagattttgggttagtcttgttttccaggaataaagtaccatttttagtggccaaggatgtaccagagggtgtggccctgtgacatccagctgggtctgcccagggccccgctcagcgaccgaggctttctaggatttatgctgccagttgcagagaaaatggccctgagtgagggcgttatgactgccccacctgcctcctgtaaccgcgtggctgtgggattcggggctgggaattcgggttcctgtggggccagcacacggccctgtgcttctccctcaggcggagagagggtgggggcagccccgtgcgtctcctgctctaggagggagggacggtgggggccggtgcgccagtgcggtgtctctgctgcaggtggctgggctgacgctgctggctgtcggggtctactcagccaagaatgcgacagccgtcactggccgcttcatcgaggctcggctggggaagccgtccctagtgagggagacgtcccgcatcacggtgctggaggcgctgcggcaccccatccaggtagcggcgcaggcctggccctccctgagtgcagttcctggctgagtcccttctgccccacgagcacagcccacgcacaccctcccgtcccttccctttccccggataacaggcacccgcacgctgcttcacgggtgggttttcctgtctggcgctgtaccttaggggtctgcatcagtgagacccttcccctgtctgcctcggtgtcccttgctcagggctcttgatggggcctgggagcacatcggggtccttgcaagacccgggacttgggtgtgcggccgtctgtcggggaagctgctacaggccatggcgtctggtggcctccctggggagccgcgccgcttgccagcccctgaggtgcctgctctccacaggtcactgggtaggtggttaagaaaataaaagccaataaggaaccggaaaatgcccctaatcccagcaatagcctcctggtctcccggcggggcagggttccagctccgggccggtcctggctgtgctttggggcagctccgtttctgtgtgttaccgagcatgtgtgtgcgttggtggctgttccgtggctgtggcaggtgacccaatggtgcttccccttcccctccggcaggtcagccggcggctcctcagtcgaccccaggacgtgctggagggtgttgtgcttagtgtaagtcggtgtgcctgggaccggggaggtgcagggaggggaccccggagctgggctgggctgtggcccttgctagcgctcgtggtggcgcccaggagcttttgggtcctgagatgcaactgcttggactgtgccggggatagataggctgcccacgagctgggcggcttcctgaggagcagagtccgcacccgggcattcccgcagcccctgtcaccgaggcttccgtgggtgcagagtgtctcccccaaacccccgtcttccccggcagcccagcctggaagcacgggtgcgcgacatcgccatagcaaccaggaacaccaagaagaaccggggcctgtacaggcacatcctgctgtatgggccaccaggcaccgggaagacgctgtttgccaaggtgagagcgcctggctgaacaggtgggccaggggccgctggggtctcacctgcctgcaggtgtctgggggcctcagccgcctggggaatggaccccccttaggcctttgcctaccctcgtgtaggctcagggtgctggtgtgggcagcagcgcctcccatcttccaggcgggggacgtctcctgtctggcaggctgtggcttccagacagggacacccggcaggggctccacactccaggtggagtgtgcaggctttgcagaggcagagggaacatctgttctgtctcccctcactcttcttgtccagaaactcgccctgcactcaggcatggactacgccatcatgacaggcggggacgtggcccccatggggcgggaaggcgtgaccgccatgcacaagctctttgactgggccaataccagccggcgcgggtgagacgtccccacagcatgcaccaggcccttggctgcggcccagcaggctgccttctgggaagggggtccaggtgtctcttggggaccctgtctttctgcagctctgtccttgtggccacgcaggaggcccaatggagggtccctcggagggaaagtcccctgagtgtggaccctggtggacacgaggtccccagcgtgtggaggctgccagtgggatacttggctcagggcagaagggaggtgggtgggtgcagggggagaggggtcttcacagctgcaggggaggctcctccacagccgccctccccccaacacgcctgcaggtgggcgtgggcactggttgccttttctagaaccatttgaaagttagctgaagacagcatggcacactcccttcaataggtcccacagtgaccccgcgcagggcacagcccgggcacccttgtggcctcggctgtcctcgttggaaccacgatcctcatggttggcaccctcccctctggcctttgacctttcactttagaagacctgtccctgcgccaggcgtggtggctcacggctgtaatcccagactttcggaggcggaggcaggcagatacgaggccaggagattgagaccatcctggctaacttggtgaaaccccgtctctactaaaaatacaaaaaattagccaggcatggtggtgggcacctgtagtcccagctactcaggaggctgaggcaggagaatggcgtgaacccgggaggcagagcctgcagtgagccgagattgcgccactgcactccagcctgggagacagagcgagactctgtctcaaaaaaaaaaaaaaagaccctgctccttgcgtggactcttgagcactgcactgggtcgctgtgtgggtgaaacctgcagggcggaggctgttgccccatgtgtggttggctggtgtgtgggtgaaacctgcagggcagagtctgttgccccctgtgtagttggtttcccactgccttctgaggctgagacgtggtcagctgcccagaggccaggctgatcggcttctgtcgagtccaggacttagggctcctgatggggcagagcctgaccccgtggggatctgcctgcctggcctgctcctgccgcggccggacgctgctgtgggctgctcctggcgtcactctcgccttgcttggcctctctctcgttcacagcctcctgctcttcatggatgaagcagacgccttccttcggaagcgagccactgtgagtgtcactaagcctctgtctggccacaggagggtggtcgggtgggcgcggctgtcatcctgggccaggctgcagcccttaagctggcttgcagtggcgcaatcttggctcgctgcaacctctgcctcctgggttcaagctgctctcctgcctcagccccctgagtagctgggattacaggtgtttgccaccacacctagttaagttttttgtatttttagtagagatggggtttcaccatgttggtcaagttggtcaagaactcctgatctcaaatgatctgcccacctggcctcccaaaatgctgggattacatgcgtgatccaccacgcccagccatacagttattattttaatacagggtgtctgtcgcccaggctggagtgcaggggcgacatctccagctcaagcagtcctcctgcctcagcctcccgagaagctgggattgcagaggcacactaacacgcccggctaatttttttgtaacgttagtagagatggagtttcccacattgtccaggcagggctcaaacttctgaactaaagaaattcaccggccttggcctggcacagtggctcacgtgtgtaatcccagcactttgggaggccaaggcaggtggatgacgaggtcaggagttcaagaccagcttggtcaatatggtgaaaccccgtctatagtaaaaatacaaaaattagccgggcgtcgtggggcacgcatgtaatcccagctgctcaggatgctgatgcaggagaatcgcttgaacccaggaggcagaggttgcagtgagctgagatcgtgccactgcactccagactgagagacagaacaagacttcgtctcaaaaaaaaaagcgagagatttgatcgccttgaccttctgaagtgctaggattaaagatgtgagccctcagtcaggctttttttttaaatgtattttttattttttagcaattctcatgcctcagcctcccaagtggcttgagattacaggtgtgccaccatgcatggctaatttttgtatttctagtacagatggggtctcaccatgttggccaggctggtctcaaactccctacctcaggtgatccgcctgcctcagcctcccaaaatgctgggttacatgcttgagccaccgcccctggccctggtcaggattttgagtttagatccatgaaagtgtcgccacgtccctgctccctgcaggagggaggcctgtgggactttctgctctggctgtttacaaggctttgcttctggtgcctaaggctggaaccttctctctgcaggaggagataagcaaggacctcagagccacactgaacgccttcctgtaccacatgggccaacacagcaacaagtgagggagcccctcgggtcctgagcccccgggcagggctgtgcagccgtcgcccttggttcccactgagggtccctggctcacagtgctgggcaccagctgtggcctcagtgtgcccacctcagatgtcccctgggaacggcccagctcgggacagcacggggtgtcattgaggaacatgcaggggcctcccgggcagagctggggtcagtcctgtcttcacggccctgtgcgccgccgccccagcttgcaggtccctctgcccctagatttctgcggtcctgtgcctgcaagggaggtggtctgattgctgccgcccagaggtccccagtagggtgaccggccctatgtccaggctccctcttccctcccaaatcccttaattttgagttttcttggtctcctgggcccctccagccccagtcacgtgtcacacggaggatcaagtcctgctggtcggccgtggctgactcttcaggcacgttgggctcctgggtcagctgctgccgttcgacgctccctggagccctgactcaggtccttcccagagaggcaaggctggggccctgctgagcctctgctgaacccgggcccccgaggtcctgcttctggctcgcatggccataatcttgacagggactctgggtcccgcatccctgctcccagcacagcggggctcaggtagcaggagggagtggtgttcccggcactgcctatcaggctgggcgagggtcagcggggaagtaccacacagggcaagaacagaggcccgagaagccgggcggggggcagctgggcgtggtggggcaggcaggcgggtgaccagggctgtggctgcgttctccccatgtttcctgtgctcacaagctgccgctttagattctcccaaaaagtctccccgagggggctgaggagcccccgttgccctcggggcatctcagctggcagccccagcgtttccttccccatccctgtcctacagattcatgctggtcctggccagcaatctgcctgagcagttcgactgtgccatcaacagccgcattgacgtgatggtccacttcgacctgccgcagcaggaggagcgggagcgcctggtgagactgcattttgacaactgtgttcttaagccggccacagaaggaaaacggtgagtgtcccgcctcacccggcccccaatccaggcaccatatggcatgggtgtaggccagctgcctgtcttccggcctccacctcatggtgtggggtccgcggccttggctgcctcacttgggaactccttccccaggcgcctgaagctggcccagtttgactacgggaggaagtgctcggaggtcgctcggctgacggagggcatgtcgggccgggagatcgctcagctggccgtgtcctggcaggtgagtcaggctccggcacgtccacccagacgggaccccagctgctgtggagatgctcagttgcgccaggcctgtcccagcaccggtgtcatgtgggagcttctgttgaggggttttcagtgcacagacgtgacacagggccccctgcctcagtcgggccactccacgcagcagcgtgcacctgctcgtgccctcaggagggtggggccatgttggttgctgacagtcacacggggctctctggaagccagtccagcatcccaggtgcccgggctctgctgggtgtggtgggaggtttctggctctcatcttggccaacaggcacctcctagagggaatggtcgtcaggacaggccccgtgtgagttgggtggtgggggtggagggacgttgtgtttcctggaccaggtcccttggcttggtcctgtttgacgggttcagacacacggtgggactggcctccgattgtcccacagttagttgttcctcggaggcacccctcctgctgctccttggatactccagggccgaggagccgagactcactggagtgtgggcatggccatccagagagctctgatcaggccgggcgcggtggctcacgcctgcaatcccagcactttgggaggctgaggcaggcatatcacggggtcagattgagaccatcctggccaatatgtcgaaaccccgtctctactaaaaatacaaaaattagctgagtttggtggtgcatgcctgttatcccagccacacgggaggctgaggcagaagaattgcttgacccggggagttggaggttgcaatgagccaagatcgcaccaccgcactccagcctggccaaagattgagactccatctcaaaataaaagaaagctttggtctttgggggttgctgaaaaagcaaaaccaggtctgtggggtagaaggcgccctggccacacacaggcattgccgcctctggggtccgcagagtctgtgtgacaacctggtcactcgatctagcagcgtatttgaatgaatgagtgacagcttaatgaagtagccaagtaccttgatttgaacgtaggagccggggtatgtagggagctgtattagtcagtacaggctgggttatgccgctgtgacaaagagtcccagatctcaaaccccgtccttgtgggtcagctgaggtctctgttccaggccgtccccacttggaaccaggtctgtttccacaactcagaaagtggaggctgggtatggtggtggctgacgcttgtattcccagcatttggggaggccaagtcagtcagattatttgaagccaggggttcaggaccagcctggaaagcaaggtgagaccccatctctacaaaaaatgaaaaaattggccggacctagtggcacatgcctgtaatgccagctgcttgggaggctgaggtgggagggtcacttgagtccaggaggcggaggctgcagtgagctgtgattgtgccactgcactccagcctgggttacagagcaagaccctgtcttaaaaactgagaataatttggaacaagcccggtggctcactcctgtaatcccagcatgttgggaggccaaggagagaagatcacttgaggtcaggagttcaagaccaccctggccaacatgatgaaccccacctctacaaaaaatacgaaaattagctgggtgtggtggtgggtgcctgtaatcccagctactcaggaggctgaggcaggagaattgcttgaacccacgaggcagaggatgcggtgagctgagatcatgccactgcactgtagcctgagggacagagtgagactgtctcaaaaataataataagaagaataataatttgggctgggcacagtggcacatgcctgtaatcccagcactttgggaggccgaggtgttggatcacttgaggtcaggagttcgaggccagcctggccagtgtgccgagaccccacctctactaaaaatacaaaaattaactggacggggccgggtgtggtgacttatgcctctaatcccagcactttgggaggccgaggtgggcggatcacggggtcaggagttcaagaccagcctggacaacatggtgaaaccccatctctactaaaaaataaaaaaattatccaggcgtggtggctggcgcctgtagtcccagctactcaggaggctgaggcaggaggatcgcttgaacccgggaggtggaggttgcagtgagctgagatggtgccactgcactccatcctgggtgtcagagcgatactccatctccaaaaaaaaaaaaaagaaagaaattaacctggtgtggtagcaggcacctgtaatcccagctgctcgggaggctgagtcaggagaattgctggaactcaggaggcagaggttgcagtgagctaagatcacgccacagcactccagtctgggcgacagagcgaaactgtctcaaaatataaatgataacagtaataatttggcttggcacggtggctcttacatgtagcattttctacacataagattatgtcacctgagaacaggtgattttacctctcccttttcagtttggatgacttttctttttcttgtcccatatctctggccagagcttccagcgatatgtggaatagaagtggtcagaattcttgcttggttctttctcagaggaagctttcagtttttcaccactgagtatgttagctgtggacttgtgatcgctggccttctttgtgtttagggcatgttcttcaatcctggtttgttaattttttttgtttcttttcttttcttttggtggggggaccagtctcgcttttgccgcccaggctggagtgcagtagagacagggtttcaccatgttggccaggctggtctcgaactcctgacgtcaggtgacctgcccacctcagcctcccaaagtgctgggattacaggtgtgagccactgcaaccgaccagttgaattttttttttttaatcataaaagtgtgttgaattttgtcaaatgcttttcctgcatgagatgagagggtcatgtggtttccttcctccactctgctaatattgattgattttcatatattgaactatccttgcattccaggaatgaatcctgcttggttagggtgtagagtcctttaactatactgctaaattcgttttgctggcattttgttgaggactttcccagtgaggctcatcagggatattggcctgccatttctcttgtggtgtgtttgtctggctttaatatgagggtaatgctggcttcctaggatgagtgaggaaatgttcttcaatttgtccaagagtttgaggagtggtactgattcttcttaatgttttgtgaattcacatgtgaagaaatcaggtccaggtcttctctttgaccttttatagcttgaagatcttaggttcccagaaaaattgcaagggtagcacagagagctcccgggcccggggccttcccacatggtgaacatcatgtgtcactgttggacccacccgcgaccaggttttgccccagaatcccacccaggaggccacgtgacatttagctgtcacttctggtgggctcctgccaggtcccgtgcttcctggaggggtggccctgtgagcatctgcgtagcccctctcctctgctgggccctgggtgacgtgcagccactcgggtggaccctgagggtccctgcacctgtttgccctctcttgggtgggctcaagaccaaaaatgatgttgagcagtcctgggcccctgagccacagtggcggtgcggctccggtcagtgtctcctgcgctcccgggcccccgacccacagtggcggtccggctctggtcagtgtctcctgcgctcccgggcccccgacccacagtggcggtccggctccggtcggtgtctccccacacagtggctcttggcgaggggtgggcgctggcagaggggacgggcaccacgtggtcatccccatgacaggttctgtcatggtgacagtgttgtgggaggatggtgtgctgctgcccctgcaccccgtgagatgaatcctgcctctgggaggtacagctgggacggggcgagggacccactcagctgtccaggaagggtcccctgccctgtgcttcctccaggtgtcctggtgcactcctgagcacggcacctagtgggggtccccacaccctcaccctgacccatgggtgcctccccttggggactccacgcccttcgctggcactgagatggagagcgacctgtccgtggcagaagggctgctgcacctgaggtgcctaaggcgacaccaagggccacagccccagtagctccagcctccgtgtgctcaatgccaagccctgtgcccaggaggacagggaaatggaggcagaggtggccttgatgtcccaaggtgggcagtggctgcctctgccctggaggcctgtgagggtcagggtctgagggtctgaggtgcactatgacccgggggcactgcctggccacggctgagactcgcagagggtctgcagttcccacctgcctctcggaagctgccctgggtcagccgtcagtggtgctccgccttgggttttctattatcagaaagtcattgagcaacagcagtgctgaggacgcaggcagggctgtgggcactgcaggggccgctcccagtgtccacacgcgtgctgggctctgccaaggtgtgggaagcctgtgtttcaccctgaggttgtcctggtgcccctggtttggcccctccccacctcggggccctggcgtgcattaagggtggcgggttcccatagcggcctccctcagctccctctctcttcactaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgtaccccagcccctgcccaggccactgtgagggtgggtgctggctgagcccctggggcagaaggagtggggcaggcggggtctttgttctcggctcccacagcagagccaggtgagggggggcctgccaggactagacagaagtggggcggcctgaaccctgcttccagccatggccaggggccacggaacccggcaggggtgtctgaggccgccctgtcagctggccggtccaagcctgtggctggagctggtgtgtgtttatctaataaagtcccacaggtgcctcacc

SEQ ID NO: 7347 - DNA, 24533 bp, Homo sapiens
ccggctgcggcgcgtggagctgctcccagccgcgctcgagtcagactcgggtgggggtcccggcggcggtagcggcggcggcggtgcgagcatgtcgtggctcttcggcgttaacaagggccccaagggtgaaggcgcggggccgccgccgcctttgccgcccgcgcagcccgggccgagggcggggggaccgcggcttgggagaccgccggcgcccaaggacaaatggagcaacttcgacccccacacaaaaaataggaccaaggcggcgcgcgagctggagcactcgcgtgagtgcggcggggcggggcgggcgggcgggcgggacgggccggggaagcgggagccctggccttgccgctcctcgctgctgtcggcagccacttcccgggcgagactgcgcccccggagcaccccccgccggagccgtctcgcgtgccgggaggatcggactctttccgtcacccgtttgcacctctgcagctgtcaggagcgggtcaggtgcgaaaagcggtgcggaggtggcgctcataggttacaggggtcagggtctggggctggccgtggtcttcagttaccgccgagcgtgcgggatccttctgcgcttgccgcctccacgtggcacaggccaaggcgtggccagatgggtagatgggtttgttgggtggttgctagcagtttccacgtaacaagggaagcgtatttgagagttacttgattctaacgagactagcagatttgcacttcttgttggaagacgttagcatttgcacggcgaggtctgtgaagcacaggccaggccgtgctgctcagcttgagtaaacccctgacccaaggccctcagggtgtgagcactgactgcaccttccctaagctcgggtctcttcccccagccttcctttcccctgtggctttaacgatttgtagcacgatgcagttcaaatggctaggagtctggaacgtagaaggtgctgaattcattgaaagaatacagtggttctcaactcttgtttaagccggggttctttctatttatttatatattgagacacagtatcgccctgtcgccgaggctggagtgcagtggtgcgatttcggctccctgcaacctccgcctccgattctcctgccgcagcctctcgagtagctgggattacagccgcgcagcaccacgcccggctaattttttttgtatctttagtagagacgggtttcaccatgttggccagggtgctctccaactcctgacctcgtgatccgcccgccttgtcctcctgaagtgctgggattacaggcctgagccacagcgcccagacagaagggattccttttttttttttttttttttttttttgagatgagtctcgctctgtcgcccaggctggagtgcagtgacgtgatctccactcactgcaagctccgcctcccgtgttcacaccattctcctgcctcagcctcccgaatagctgggagtacaggcgcccgccaccacgcccggctaattttgtagagatggggtttcaccgtgttagccaggatggtctcgatctcctgacctcgtgattaattttttgtatttttagtagagacggggtttcactgtattagccagggtggtctcgatctcctgacctcgtggtccacccgcctcggcctcccaaagtgctgggattacaggcgtgagccaccgcatgccacctttttttttttaagatgatgtcttgctctttggccaggctggagtgcaatggcgccatcttgtctcactgcaaaccgcaacgccctggttcaaagaattctgctgcctcagcctcccaagtagctgggattacaggcacgcgccaccacgcccagctaatttttgtatttttagtagagacgtggtttcaccaccttggccagggtggtcttgaccacctgaccccgtgatccacccgcctcgacctcccaaagtgatgagattacagtcctgagccaccgcaccttgccagcaggggttcctttttagaaagaagatcatttagggaatccctggtgtgaagcagatataaacagagtttccctgtttaaggagggatggcctggtggtacttgtggttccatcctgtgcccttccccggggtgctggggaacatcctgagctgaggtttctggccccggctgggtctcataaccccagagggacattcaggtttgggcccaggcccaggctaacatggatagtcctagctgggcaccaccgacagtgcgtgttctgttttgaagagatggggtcttgctttgtcgcccagtctggccttgacctcctgggtaaaagccgtccaaccgtctcagcctcctgaggagaggggactgcaggcttgctcggtaatttttcttttttcttttctttttttcttttttttttgacggagtctcgctgtcgcccaggctggagtgcagtggcgtgatcacggctcactgcaagctccacctcctgggtacacgccattctcctgcctcagcctcccgagtagctgggactacaagtgcccgccgccacgcccagctaattttttgtattttttttagagaccggttttcaccatgttagccagaatggtctcgatctcctgaccccgtgatccacccgcctcggccacccaaagtgctgggattacagacgtgagccaccgcgcccggctttgctccgtaatttttctgtgtgtttttgagactgagtctggctctgccgcccaggctggaatgcagtggcatcatctctgctcactgcaacctttgcctttggggttcaagcgattctcctgcctcagcctcccgagtagctgggatcacaggcgcccgccagcacacctggctaatttttgtgtttttttactagagacggggtttcaccatgttgtttaggctggtcttgaattctggcctcaggtgattcgcccacctcggcctcccaaagcgctgggatgacaggcgtgagccgctgctcatggccttcctcggtaattttaacgatcaggttaggatgggaatcaagggctggacttcagggcacctcggaggacagcggatgttggtgactgactttcttgctgcaggcttatttggagggttcctttgtgtcctagttcctgggggttttcacccgctaacttcacttagagattgaaacttctcccacttccagaagctgaatcgtagtgatcagcctgcggccccctgcagtggtacaggcctggttgagcagcctcaggccgcctccccatagtgcagacctgtgcctctgagttgctccagtcctggcggccccggagctcctgacccgcagtccgctctgccggcgttgccagtgccttggtctgccctctctgtggtggagcggggcccggggcagggtctccaggtgcaccgtggggagccctccatcaggcttttgtttcctgtggattgtgttccaggtgtgggctctttcattttgatcccttctctccttcctggcctcactgctggcgggtgagagaggtttctccggagttgactgccccctttccccgggtgccccctgccctgcccctctgcctggtagcccctctgcaagcccggcccctcccgacgctcctggcttcctccgtgcccctttcctggcagcggggtcgccgagattcgcccgttgctttgtccttgctgctctccaggcaaacgggcggctcctcctcaccgactgcctcctctgtcccttgaggctatagccccatgccgcctcgttcccagagtctgccctgacccctcctccggcctgtccttggaagtcacagcagtacattatcccagaactgtctgtgagcaccagcgctcgccctgcactccacagagggggtgcctggaggagagcctcgtgccctgtgggtgtgaattcacgcgctgggacgcacgtccctggcacagggtcacaccaaagtggtgaatgattgttctcattctaataaccgagaggccacacgggcacctgacctgctctttcccctctcctcctccccagagtcactgggggtgggaactgtcaatgagccattttcaggggagggagtggcctcagcttaatccagccaaaggtcccctcgggaggaaacaggcagagctcctcaccgtgacacccacgttcctgtcactgctctgtggcaggaccctgggggactgacacaccctcagtcccctcggggtcagagtgagagtggttgagagcccggggtcgcttcagcccttggcttcccgagcttagcagccaaacccgttgacctggcactgtcttccctgagaggcaggtcccggtctcatctgtgctctgttcactggggcccccgaggttagctaccaaggcgcttcctgaaatgtgacgctgatgcccgtcagcccagttcgtgcctaaccacaggcccaagcagacccaccccaacaccaaagcgtcgctgcctctgtctaaatgcaacgagtgctccccacggcacttccccctgcgtcagtcacctccaaaaattacacctgagctgagaacagacgctgggctctagttagtgacgtgtttgctgcagttgactctgaaggcttaaaaaagtgagacgggctgcgggaggaagagagacgggaacaacgcaccaacccaggagcatcgggggtccctgcctactttacacgtctttctgtgttagaataatttttttttttttgagacggactcttgctgtctcccccgctggagtgcattgcttcgatctctgctcactgcaagctctgcctcccaggttcacgccattctcctgcctcagcctcctgagtagctaggactacaagtgcccgccgccacgcccggctaattttttgtatttttagtagagacggggtttcactgtgttaaccaggatggtcttgatctcctgacctcatgatccacccgcctcagcctcccaaagtgctgggattacaggcgtgagccaccacgccctgctagaataatttttttttagagacggagttgcgctctgttgccccggctggagtgcggtggtgcgatctcggctcgctgcaagctctgcctcccaggttccagcaattctccagccttggcctccccagtagctgagatcacaggcgtgcaccaccacacccagcttttttttgtgtttttagtggagacaggatttcgccatgttggccaggttggagattttatttttcttaagtctcactctgtccagctggagtgcagcagtgtgatctgggtgactgtagcctctgcctccggggttcaagccatcctcccacctgagcctcagagttgctgggattacaggcgtgaaccaccgcttcccactaggtttttgtatttttagtagaggttgggtttcaccatgttggccaggctttggtatccgtgtatcctacacctgctctccgtgccacatgcgcccgcaggttacgccaaggaggccctgaatctggcgcagatgcaggagcagacgctgcagttggagcaacagtccaagctcaaagtgagtggggccggtgtgggcgaggaggccggggcgcacatggggttcaggcgtggagattggtggggctgctactggtgggtagggccaggggcgtgtacatgggcagcagtggggccagggccgagcttgggcgcctcatttcacagagggaaacaaggggaggtgagagacgctgccacagagccgcccgagagggagggtcagtgttggtgagggcgtctggtcgtcctgagggagggccggtgttggtgagggcatctggtcgtcctgagggagggggtcttcttcacattctcacctcatttcttttcactcagcaggattttttattttattttattttattttattttattttattttattttattttatttattttgaaacggagtctcactcttgcctaggctggagtgcaatggcgcaatctcggctcactgcaacctccgcctcccgggttcaagcgattcatctgcctcagcctctggagtagctgggattacaggcacgcgccaccacgcctggctaatgttgtattttagtagagacggggtttctccatgttggtcaggctggtctctaactcccgacctcaggtgatccacccgcctcggcctctcaaactgttgggattacaggcatgtgccaccacgcctggctaatgttgtattttagtagagacggggtttctccatgttggtcaggctggtctctaactcccgacctcaggtgatccacccgcctcggcctctcaaactgctgggattacaggcacgcgccaccacgcctggcctattttattttattttgagacagagtgtcactctgtcccccagtctggcgtgcaatggtttgatctcggctcactgcaacctccacctcccgggttcaacctcctgcctcagccttccgagcagctgggactacaggagcctgccaccacatctggcgaatttttgtatttttagtagagaagggggttcagcatgttgtccaggttggtcttgaactcctgacctcaggtgatccagccactttggcctcacaaagtgctgggattataggcaagagcgatggcgcccggcccactcagcaggattcctagaatgggcacgagctctgccctcatcacagtccaaaagtgagcacctgcctggagctgcccagaaacagccttgtggggtggggttggtgtctgaccttcctccccgggggccttcgcaggcttctctgctggtgcttctgtgcctgtgggtctggattcctccagggcctgatcctgggtgcagatgcagctggaagccctgaacctgctgcacacactagtctgggcacggagtctctgccgtgccggagctgtgcagacacaggagcggctgtcaggcagtgccagccctgagcaagtgccagctggtgagtgctgtgctctgcaggagtatgaggccgccgtggagcagctcaagagcgagcagatccgggcgcaggctgaggagaggaggaagaccctgagcgaggagacccggcagcaccaggccgtaagagcgcaagaggccgcgagggaggcgcccggctgcggggagcggcctggggcaggactgggagctgggtgtggtcccggggcactctggagtcagccattagagctgccctcggaacggccttgcacaaacgcctaagacctgtaaggtccctcactgctgagccggacgggaggtccccgcgcctccccacgtttgtgtgaggctgatggcgcgtcggagtccccggcgctccgcccagtcggcccagactgcagctcccggctgagatgtgtctttgccgccctcttctccccagagggcccagtatcaagacaagctggcccggcagcgctacgaggaccaactgaagcagcaggtgagctcagcctcccctgcgaggcgcctgcgtccctgagaacgtaggtggctttgtgggaccagtcagtgggtcagaggccacggggcaagaacgctggggttgctgacggtgggtgctagagcaggggaaactactcggacagacacgcaccagcacacgtgtacaggcacacatgcagatgtgtgcacacatgtacacggagacacaggcacctgcccacacggacacacactcctcgcacacacactcccggcagacaggcacacacacccctgcacacatgggcacacacacacccctgcacacacgggcccacacactcccctgcacacatggggaaacatgggcccacacacacacacccctgtgcgcacacacccctacacaggggcatggacagacacccgcaaacacacccccacacaacacgggcacgcacacacacaccccgccacaacacaggcacacatacccctgcacacaggcctgcacatacacccccacacaggggcatgctcacgcagcccgcacacacacaggtatgcagacacacccaaacacacatgggtccgcaggcacacactcccgcatggggcatgcacgcaccccccacacacacccgatcacacataggcatgcacacccctctgcacacatgggggcttacacacccccccgcacacgtgggcccgctcacacagcccacacacataccccttcacacaggcacacaccgccccgcacacacgggcctgcacacacacccccacacgggcatgcacacgcccacacacacgggcgcgcacacacccggacatgcacaaacacccacctgcacacacgggcacaccccaccacacacacacacaggcatggacacacgcacaccccctcacacataggcacacatacacaacccaggcacacacccccttgcacagacgggcacgcacacagtcccacacatgggcacacgcgcacacccccgcaaacacacacacgggcacgtgtacgcacccccactcacagtgtgcctcatacatacgggcacgcacctgcacacgagggcacacccccaccccccacccccacacacccccgcacccatgggcacacacacattactgcacgtgagggcatgcacacacacgccctgcacacccccacacacagaccccttgtgtgggttccacagcagcggctctccaggcacgacaagcctccttgtctcccacccgggcgcccagctggcagtctgggaggttctgcttgggagggctggtcagtggcggcgggcgggtctctgggtctatgagaaaagcttgggtgacatctgttccctggtccttagggaccgtcaccttcagtcctgagctcgcaggcggggttcacatgttgcctgttgtgggcattgtagctttaacgtttaattggcggaagacagaagcttccttaagcccagcctgaatcagggcagtggtgttgggaggtcggcccgcggtggcccttgtcagggaagccacagtgggggctgtttctgccactggggagtttgggaccctgaacccatcccctcagtgactgccgtcccagccgatgtcacccgtgtctgtgtcagggtgcggcgtctgcaggtccccaggtgcccaggacgcttggagttctgtggtcctggggcggacgcaacctctggattggtgttgagcatttttctggttttaaaggcttttctctttttctgcggcttcttctcagcaacttctcaatgaggagaatttacggaagcaggaggagtccgtgcagaagcaggaagccatgcggcgaggtaggctgtctgctctcctggctggggcggaggtggcgggggctgcttgtggacccggcgtgcactctgagcctgagttctgccgcccggcccctcatagctaccagtgcagtgggcgaggcctgctggggctccgcggggtggggctgcctctcggaagacacctctgtctgcgagtggacgccaggatctgttcagggagggcaggagctgcttcacttcatgggaagtacaggggcctttgttttttttttgagacggagtctcgctctgtcacccaggcaggagtgcaatagcacgatctcagctcactgcaacctctgcctcccaggtttaagcaattctcctgcctcagcctcccgagtagctgggattataggctcccgccaccacgcccagctaatttttttgtatcttcagtagagaaagggtttcactgtgttggccaggctggtcttgaacttcttgatctcattatccgcctgccttggccttccacagtgctgggattacaggcgtgagcctctgcgttctgcctagaacatgggtctttactgtcctggtttcagtggggatcacaggtatttggtgccatgtggcatttgttggcgagtgctccaggcaaacgtctgtcaccactcttcactgtgggtgggcttgtggcgaggtgtgtgcgtttaatgttcagtagccaggcacgtggcacgtcacgcgtgtctgagttctgacagctgtgtttctgtgtgaggggggcttccttcagaactccgcgttctggttttttgcttcaaagagctcgtcctgagaagttgcctaggcctctgggtcggatttctgccctaatccatgggcagggccggcctgtggcgctgtccctaccaaggtctgtgtgtgtctgtggcacgggcctgtccatggactgggcttgtccgtggagtgggtcggtccatggccttagcctgttggtggcgtgggccggtccacggcatgggcctgtctgtggcgtgggccggtccgtggtgtgggcctgtccgtggccttagcctgttggtggcgtgggccggtccgtggcatgggcctgtctgtggcgttggtctgtccgtggcgtgggccggtccgtggcgtgggccggtccacagtgtgggtggaggtggacgtgctgcactgcatggtgctgagctgccctacctctctggggcagccaccgtggagcgggagatggagctgcggcacaagaatgagatgctgcgagtggagaccgaggcccgggcgcgcgccaaggccgagcgggagaatgcagacatcatccgcgagcagatccgcctgaaggcgtccgagcaccgtcagaccgtcttggagtccatcaggtgagcactgccgaggcccgggccggccacagatggagccccgcaggtgtgagtcgctggtcccagggcgctctccagctcttccaggcctggccgccgtaggctgactccttggtgggggcactgcctcctgtcctggcaaggccgtgccgccatgtcagggcctcaccctcaacctgctctcgctgcgtggtacggatcttcgtgtccttcctggtcacaccactgctttccccgcaggacggctggcaccttgtttggggaaggattccgtgcctttgtgacagaccgggacaaagtgacagccacggtaaacatactcataaaacagggctggcaggtggctgagaggcagcatgtgggggcctcctggagccccaggtcctgtccctgccggctctgcacagccctgtagctctcccagcacagagcaaacccacgttgtacctgctgggctcggctgctcctccctccttgagctgggagaaaaaaatgcagttgccagcctgggccacacggtgagaccccatctctacgaagaataaaacattagctgggtgtgatggtggcgcctgtggtcctgctactcgagaggctgaggtaggaggatcacttaagcccaggaggtttgggctgcagtgagccaacattgcaccactgcactccattcttggcgagagaataagaccttgtctcaagaaaaaaatggccaggcggtagtggctcaggcctgtaatcccagcattttcggaggcggaggtgggcggatcacgaggtccggagatcgagatcatcctggtaagagtgaaaccctgtctctactaaaaaaaagaaaaaaaaagaaaaaaattagctgggtgtggtgacatgtgcctgtaatctcgggaggctgaggcaggagaatcacttgaacccgggtggtggaggttgcaatgagtcgagatcccgccactgcaccccaagaccagcatgaccaacatggtgaaaccccatctctgctaaaaatacaaaaattagcaggccaaggtggcgtgcgcctggaatcccagctgcttgggaggctgaggtaggaaaattggttgaacccaggaggcggaagttgcagtgagctgaaaccgcacaattgcactccaacctgtggaagaagagcgaaactctgtctcaaaaaaacaaacaaaataaataagccaggcctggtggctcactggtgtaatcccagcactttgggaggccaagacgggtggatcacttgaggtcagaagttcatgaccagcctggccaacatggtgaaaacccatctctactaaaaatacaaaaattggccgggcctcgtggcacaggtctgtattagctgagtgtggtgacctgagcctgtaatcccagtcactcgggaggctgaggcaggagaactgcttgaacctggaaggcggaggttgcagtgagccaagatggcaccattgcactccagcctggccacagaacaaaaccctttctctaaaaacaaagtcaagggcgcattaagcagctccttcatgttctcaggtgacaccgtctcaccaacatggcaacaccacctgcaacattcaccgtcacactgaccaggccaccggcaggtgctgcagtcacagcagtgggcgccggcaccacggcagagcaagtgcccactcagtgccgggcacctactgtgtgctgggcggggtggggggacggaggacacagccatgtgcgacctggggcgccaccacagcaggccagagcctgggcacaaaagagcgaggctttaaacgagagaagaatctgaacttcaaactctcagggttttattccgaataacgaaagtttttgcgaaatggagtcgggttcgctttctgggtctttgatttttttttttttgagacagagtctcactttcaagtgtgctgctcaagtgcagtggcgcgatctcgactcactgtcagcttcgcctcttgggttcacaccattctcctgtctcagcctccggagtagctgggactacaggtgtctgtcgccacgcccggctaatttttttgtatttttagtagagagagggtttcatcctgttagccaagatggtttcgatctcctgacctcgtgaatccgccgcgtgggcctcccaaagtgctgggattacgggcgtgagccaccgtgctcagccacagccagctaattttttcatgtttttagtagagacgaggtttttccaggttggttaggctggtcttgaactccaacctctggtgatacgccggccttggcctcccaaagtgctgggattacagacctggccagcctaaacgatttttaaaacaagttagagattttgggttagtcttgttttccaggaataaagtaccatttttagtggccaaggatgtaccagagggtgtggccctgtgacatccagctgggtctgcccagggccccgctcagcgaccgaggctttctaggatttatgctgccagttgcagagaaaatggccctgagtgagggcgttatgactgccccacctgcctcctgtaaccgcgtggctgtgggattcggggctgggaattcgggttcctgtggggccagcacacggccctgtgcttctccctcaggcggagagagggtgggggcagccccgtgcgtctcctgctctaggagggagggacggtgggggccggtgcgccagtgcggtgtctctgctgcaggtggctgggctgacgctgctggctgtcggggtctactcagccaagaatgcgacagccgtcactggccgcttcatcgaggctcggctggggaagccgtccctagtgagggagacgtcccgcatcacggtgctggaggcgctgcggcaccccatccaggtagcggcgcaggcctggccctccctgagtgcagttcctggctgagtcccttctgccccacgagcacagcccacgcacaccctcccgtcccttccctttccccggataacaggcacccgcacgctgcttcacgggtgggttttcctgtctggcgctgtaccttaggggtctgcatcagtgagacccttcccctgtctgcctcggtgtcccttgctcagggctcttgatggggcctgggagcacatcggggtccttgcaagacccgggacttgggtgtgcggccgtctgtcggggaagctgctacaggccatggcgtctggtggcctccctggggagccgcgccgcttgccagcccctgaggtgcctgctctccacaggtcactgggtaggtggttaagaaaataaaagccaataaggaaccggaaaatgccccaatcccagcaatagcctcctggtctcccggcggggcagggttccagctccgggccggtcctggctgtgctttggggcagctccgtttctgtgtgttaccgagcatgtgtgtgcgttggtggctgttccgtggctgtggcaggtgacccaatggtgcttccccttcccctccggcaggtcagccggcggctcctcagtcgaccccaggacgtgctggagggtgttgtgcttagtgtaagtcggtgtgcctgggaccggggaggtgcagggaggggaccccggagctgggctgggctgtggcccttgctagcgctcgtggtggcgcccaggagcttttgggtcctgagatgcaactgcttggactgtgccggggatagataggctgcccacgagctgggcggcttcctgaggagcagagtccgcacccgggcattcccgcagcccctgtcaccgaggcttccgtgggtgcagagtgtctcccccaaacccccgtcttccccggcagcccagcctggaagcacgggtgcgcgacatcgccatagcaacaaggaacaccaagaagaaccggggcctgtacaggcacatcctgctgtatgggccaccaggcaccgggaagacgctgtttgccaaggtgagagcgcctggctgaacaggtgggccaggggccgctggggtctcacctgcctgcaggtgtctgggggcctcagccgcctggggaatggaccccccttaggcctttgcctaccctcgtgtaggctcagggtgctggtgtgggcagcagcgcctcccatcttccaggcgggggacgtctcctgtctggcaggctgtggcttccagacagggacacccggcaggggctccacactccaggtggagtgtgcaggctttgcagaggcagagggaacatctgttctgtctcccctcactcttcttgtccagaaactcgccctgcactcaggcatggactacgccatcatgacaggcggggacgtggcccccatggggcaggaaggcgtgaccgccatgcacaagctctttgactgggccaataccagccggcgcgggtgagacgtccccacagcatgcaccaggcccttggctgcggcccagcaggctgccttctgggaagggggtccaggtgtctcttggggaccctgtctttctgcagctctgtccttgtggccacgcaggaggcccaatggagggtccctcggagggaaagtcccctgagtgtggaccctggtggacacgaggtccccagcgtgtggaggctgccagtgggatacttggctcagggcagaagggaggtgggtgggtgcagggggagaggggtcttcacagctgcaggggaggctcctccacagccgccctccccccaacacgcctgcaggtgggcgtgggcactggttgccttttctagaaccatttgaaagttagctgaagacagcatggcacactcccttcaataggtcccacagtgaccccgcgcagggcacagcccgggcacccttgtggcctcggctgtcctcgttggaaccacgatcctcatggttggcaccctcccctctggcctttgacctttcactttagaagacctgtccctgcgccaggcgtggtggctcacggctgtaatcccagactttcggaggcggaggcaggcagatacgaggccaggagattgagaccatcctggctaacttggtgaaaccccgtctctactaaaaatacaaaaaattagccaggcatggtggtgggcacctgtagtcccagctactcaggaggctgaggcaggagaatggcgtgaacccgggaggcagagcctgcagtgagccgagattgcgccactgcactccagcctgggagacagagcgagactctgtctcaaaaaaaaaaaaaaagaccctgctccttgcgtggactcttgagcactgcactgggtcgctgtgtgggtgaaacctgcagggcggaggctgttgccccatgtgtggttggctggtgtgtgggtgaaacctgcagggcagagtctgttgccccctgtgtagttggtttcccactgccttctgaggctgagacgtggtcagctgcccagaggccaggctgatcggcttctgtcgagtccaggacttagggctcctgatggggcagagcctgaccccgtggggatctgcctgcctggcctgctcctgccgcggccggacgctgctgtgggctgctcctggcgtcactctcgccttgcttggcctctctctcgttcacagcctcctgctcttcatggatgaagcggacgccttccttcggaagcgagccactgtgagtgtcactaagcctctgtctggccacaggagggtggtcgggtgggcgcggctgtcatcctgggccaggctgcagcccttaagctggcttgcagtggcgcaatcttggctcgctgcaacctctgcctcctgggttcaagctgctctcctgcctcagccccctgagtagctgggattacaggtgtttgccaccacacctagttaagttttttgtatttttagtagagatggggtttcaccatgttggtcaagttggtcaagaactcctgatctcaaatgatctgcccacctggcctcccaaaatgctgggattacatgcgtgatccaccacgcccagccatacagttattattttaatacagggtgtctgtcgcccaggctggagtgcaggggcgacatctccagctcaagcagtcctcctgcctcagcctcccgagaagctgggattgcagaggcacactaacacgcccggctaatttttttgtaacgttagtagagatggagtttcccacattgtccaggcagggctcaaacttctgaactaaagaaattcaccggccttggcctggcacagtggctcacgtgtgtaatcccagcactttgggaggccaaggcaggtggatgacgaggtcaggagttcaagaccagcttggtcaatatggtgaaaccccgtctatagtaaaaatacaaaaattagccgggcgtcgtggggcacgcatgtaatcccagctgctcgggatgctgatgcaggagaatcgcttgaacccaggaggcagaggttgcagtgagctgagatcgtgccactgcactccagactgagagacagaacaagacttcgtctcaaaaaaaaaaagcgagagatttgatcgccttgaccttctgaagtgctaggattaaagatgtgagccctcagtcaggctttttttttaaatgtattttttattttttagcaattctcatgcctcagcctcccaagtggcttgagattacaggtgtgccaccatgcatggctaatttttgtatttctagtacagatggggtctcaccatgttggccaggctggtctcaaactccctacctcaggtgatccgcctgcctcagcctcccaaaatgctgggttacatgcttgagccaccgcccctggccctggtcaggattttgagtttagatccatgaaagtgtcgccacgtccctgctccctgcaggagggaggcctgtgggactttctgctctggctgtttacaaggctttgcttctggtgcctaaggctggaaccttctctctgcaggaggagataagcaaggacctcagagccacactgaacgccttcctgtaccacatgggccaacacagcaacaagtgagggagcccctcgggtcctgagcccccgggcagggctgtgcagccgtcgcccttggttcccactgagggtccctggctcacagtgctgggcaccagctgtggcctcagtgtgcccacctcagatgtcccctgggaacggcccagctcgggacagcacggggtgtcattgaggaacatgcaggggcctcccgggcagagctggggtcagtcctgtcttcacggccctgtgcgccgccgccccagcttgcaggtccctctgcccctagatttctgcggtcctgtgcctgcaagggaggtggtctgattgctgccgcccagaggtccccagtagggtgaccggccctatgtccaggctccctcttccctcccaaatcccttaattttgagttttcttggtctcctgggcccctccagccccagtcacgtgtcacacggaggatcaagtcctgctggtcggccgtggctgactcttcaggcacgttgggctcctgggtcagctgctgccgttcgacgctccctggagccctgactcaggtccttcccagagaggcaaggctggggccctgctgagcctctgctgaacccgggcccccgaggtcctgcttctggctcgcatggccataatcttgacagggactctgggtccgcatccctgctcccagcacagcgggctcaggtagcaggagggagtggtgttcccggcactgcctatcaggctgggcgacggtcagcggggaagtaccacacggggcgagaacagaggcccgagaagccgggcggggggcagctgggcgtggtggggcaggcaggcgggtgaccagggctgtggcgcgttctccccatgtttcctgtgctcacaagctgccgctttagattctcccaaaaagtctccccgagggggctgaggagccgttttgccctcggcgatctcagctggcagccccagcgtttccttccccatccctgtcctacagattcatgctggtcctggccagcaatctgcctgagcagttcgactgtgccatcaacagccgcatcgacgtgatggtccacttcgacctgccgcagcaggaggagcgggacgcctggtgagactgcattttgacaactgtgttcttaagccggccacagaaggaaaacggtgagtgtcccgcctcacccggcccccaatccaggcaccatatggcatgggtgtaggccagctgcctgtcttccggcctccacctcatggtgtggggtccgcggccttggctgcctcacttgggaactccttccccaggcgcctgaagctggcccagtttgactacgggaggaagtgctcggaggtcgctcggctgacggagggcatgtcgggccgggagatcgctcagctggccgtgtcctggcaggtgagtcaggctccggcacgtccacccagacgggaccccagctgctgtggagatgctcagttgcgccaggcctgtcccagcaccggtgtcatgtgggagcttctgttgaggggttttcagtgcacagacgtgacacagggccccctgcctcagtcgggccactccacgcagcagcgtgcacctgctcgtgccctcaggagggtggggccatgttggttgctgacagtcacacggggctctctggaagccagtccagcatcccaggtgcccgggctctgctgggtgtggtgggaggtttctggctctcatcttggccaacaggcacctcctagagggaatggtcgtcaggacaggccccgtgtgagttgggtggtgggggtggagggacgttgtgtttcctggaccaggtcccttggcttggtcctgtttgacgggttcagacacacggtgggactggcctccgattgtcccacagttagttgttcctcggaggcacccctcctgctgctccttggatactccagggccgaggagccgagactcactggagtgtgggcatggccatccagagagctctgatcaggccgggcgcggtggctcacgcctgcaatcccagcactttgggaggctgaggcaggcatatcacggggtcagattgagaccatcctggccaatatgtcgaaaccccgtctctactaaaaatacaaaaattagctgagtttggtggtgcatgcctgttatcccagccacacgggaggctgaggcagaagaattgcttgacccggggagttggaggttgcaatgagccaagatcgcaccaccgcactccagcctggccaaagattgagactccatctcaaaataaaagaaagctttggtctttgggggttgctgaaaaagcaaaaccaggtctgtggggtagaaggcgccctggccacacacaggcattgccgcctctggggtccgcagagtctgtgtgacaacctggtcactcgatctagcagcgtatttgaatgaatgagtgacagcttaatgaagtagccaagtaccttgatttgaacgtaggagccggggtatgtagggagctgtattagtcagtacaggctgggttatgccgctgtgacaaagagtcccagatctcaaaccccgtccttgtgggtcagctgaggtctctgttccaggccgtccccacttggaaccaggtctgtttccacaactcagaaagtggaggctgggtatggtggtggctgacgcttgtattcccagcatttggggaggccaagtcagtcagattatttgaagccaggggttcaggaccagcctggaaagcaaggtgagaccccatctctacaaaaaatgaaaaaattggccggacctagtggcacatgcctgtaatgccagctgcttgggaggctgaggtgggagggtcacttgagtccaggaggcggaggctgcagtgagctgtgattgtgccactgcactccagcctgggttacagagcaagaccctgtcttaaaaactgagaataatttggaacaagcccggtggctcactcctgtaatcccagcatgttgggaggccaaggagagaagatcacttgaggtcaggagttcaagaccagcctggccaacatgatgaaccccacctctacaaaaaatacgaaaattagctgggtgtggtggtgggtgcctgtaatcccagctactcaggaggctgaggcaggagaattgcttgaacccacgaggcagaggatgcggtgagctgagatcatgccactgcactgtagcctgagggacagagtgagactgtctcaaaaataataataagaagaataataatttgggctgggcacagtggcacatgcctgtaatcccagcactttgggaggccgaggtgttggatcacttgaggtcaggagttcgaggccagcctggccagtgtgccgagacccccacctctactaaaaatacaaaaattaactggacggggccgggtgtggtgacttatgcctctaatcccagcactttgggaggccgaggtgggcggatcacggggtcaggagttcaagaccagcctggacaacatggtgaaaccccatctctactaaaaaataaaaaaattatccaggcgtggtggctggcgcctgtagtcccagctactcaggaggctgaggcaggagaatcgcttgaacccgggaggtggaggttgcagtgagctgagatggtgccactgcactccatcctgggtgtcagagcgatactccatctccaaaaaaaaaaaaaaagaaagaaattaacctggtgtggtagcaggcacctgtaatcccagctgctcgggaggctgagtcaggagaattgctggaactcaggaggcagaggttgcagtgagctaagatcacgccacagcactccagtctgggcgacagagcgaaactgtctcaaaatataaatgataacagtaataatttggcttggcacggtggctcttacatgtagcattttctacacataagattatgtcacctgagaacaggtgattttacctctcccttttcagtttggatgacttttctttttcttgtcccatatctctggccagagcttccagcgatatgtggaatagaagtggtcagaattcttgcttggttctttctcagaggaagctttcagtttttcaccactgagtatgttagctgtggacttgtgatcgctggccttctttgtgtttagggcatgttcttcaatcctggtttgttaattttttttgtttcttttcttttcttttggtggggggaccagtctcgcttttgccgcccaggctggagtgcagtagagacagggtttcaccatgttggccaggctggtctcgaactcctgacgtcaggtgacctgcccacctcagcctcccaaagtgctgggattacaggtgtgagccactgcaaccgaccagttgaattttttttttttaatcataaaagtgtgttgaattttgtcaaatgcttttcctgcatgagatgagagggtcatgtggtttccttcctccactctgctaatattgattgattttcatatattgaactatccttgcattccaggaatgaatcctgcttggttagggtgtagagtcctttaactatactgctaaattcgttttgctggcattttgttgaggactttcccagtgaggctcatcagggatattggcctgccatttctcttgtggtgtgtttgtctggctttaatatgagggtaatgctggcttcctaggatgagtgaggaaatgttcttcaatttgtccaagagtttgaggagtggtactgattcttcttaatgttttgtgaattcacatgtgaagaaatcaggtccaggtcttctctttgaccttttatagcttgaagatcttaggttcccagaaaaattgcaagggtagcacagagagctcccgggcccggggccttcccacatggtgaacatcatgtgtcactgttggacccacccgcgaccaggttttgccccagaatcccacccaggaggccacgtgacatttagctgtcacttctggtgggctcctgccaggtcccgtgcttcctggaggggtggccctgtgagcatctgcgtagcccctctcctctgctgggccctgggtgacgtgcagccactcgggtggaccctgagggtccctgcacctgtttgccctctcttgggtgggctcaagaccaaaaatgatgttgagcagtcctgggcccctgagccacagtggcggtgcggctccggtcagtgtctcctgcgctcccgggcccccgacccacagtggcggtccggctctggtcagtgtctcctgcgctcccgggcccccgacccacagtggcggtccggctccggtcggtgtctccccacacagtggctcttggcgaggggtgggcgctggcagaggggacgggcaccacgtggtcatccccatgacaggttctgtcatggtgacagtgttgtgggaggatggtgtgctgctgcccctgcaccccgtgagatgaatcctgcctctgggaggtacagctgggacggggcgagggacccactcagctgtccaggaagggtcccctgccctgtgcttcctccaggtgtcctggtgcactcctgagcacggcacctagtgggggtccccacaccctcaccctgacccatgggtgcctccccttggggactccacgcccttcgctggcactgagatggagagcgacctgtccgtggcagaagggctgctgcacctgaggtgcctaaggcgacaccaagggccacagccccagtagctccagcctccgtgtgctcaatgccaagccctgtgcccaggaggacagggaaatggaggcagaggtggccttgatgtcccaaggtgggcagtggctgcctctgccctggaggcctgtgagggtcagggtctgagggtctgaggtgcactatgacccgggggcactgcctggccacggctgagactcgcagagggtctgcagttcccacctgcctctcggaagctgccctgggtcagccgtcagtggtgctccgccttgggttttctattatcagaaagtcattgagcaacagcagtgctgaggacgcaggcagggctgtgggcactgcagggccgctgccagtgtccacatgcgtgctggctctgccaaggtgtgggaagcctgtgtttcaccctgaggttgtcctggtgcccctggtttggcccctccccacctcggggccctggcgtgcattaagggtggcgggttcccatagcggcctccctcagctccctctctcttcactaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcagggacctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgtaccccagcccctgcccaggccactgtgagggtgggtgctggctgagcccctgggcgagaaggagtggggcaggcggggtctttgttctcggctcccacagcagagccaggtgagggggggcctgccaggactagacagaagtggggcggcctgaaccctgcttccagccatggccaggggccacggaacccggcaggggtgtctgaggccgccctgtcagctggccggtccaagcctgtggctggagctggtgtgtgtttatctaataaagtcccacaggtgcctcacc

SEQ ID NO: 7348 - DNA, 490 bp, Homo sapiens
atgtcaactactgactagaactggtggaaaaggttgtttactgaaactgcgaggaaggtagactttaaaatgcaggacaaagactgaacatactgatatactgattctttgaagggaagtttagaactcattgtatctaacattattcaggcttaaaacagtttccaatccagtgggaaaagtcactccatatattccgtgaagtcaaccagttccatcaaggagaaagtcagggccgctgggagcgcgtggaccgtgggctccggggcggcgcctgcccgggcaccccggccccgtccacgccccgcaagaggagctcgctggccccgccacgcgggaaggggtcgccccggggtcttgggcgggagggccgtgcgggctgcggagacaccgaggaggggaggcgcctctcctgagctcttggcgcagcgaccccagggcgccgactcatcgcggaagggctcggcttgcccgggcgccggtgccgcct

SEQ ID NO: 7349 - DNA, 318 bp, Homo sapiens
aactggtggaaaaagttgtttattgcaactgcgaggaagttagactttaaaatgcagaacaaagactgaacatactgacataccggttctttgaagggaaatttagaattcattgtatataacattattcaggcttaaaatagtttccaatccagtgggacgagtcactccatataattctgtgaagtcaaccattcctatcaaggagagagtcggggccgccgcgagcgcgtgaaccgtgggctccggggtggtgccgacgcggctgcgggccgggactgacgttgcgccgggttcgagtactcccctccggagttt

SEQ ID NO: 7350 - DNA, 3241 bp, Homo sapiens
ttttgatgatgagctcctagcttcaaagtcaggacccagcggggctccacgaaagcctgggcgacccagccactgggcctaagcctgacctgctgcacccctgcctccctccacagttgccgaggtactgtctgaatgccgcctgctcgcctacatatcccaggtgcccacgcagatgtccttcctcttccgcctcatcaacatcatccacgtgcagacgctgacccaggtgagaggccccggcagacacacagcagggaaggtcgattggaaaccacttcctttgtcctggtgcccagcaggtttctgtcccccactccagaagtgcgtctctggagacccagctcttctgaggactgtgctcaggaggaatcagtgtcccattgtacagacagggcctaaggaaggagggctcgcaagtgccctcaggtcacaggctgacttgcaggccagtgctctccccgcctcccccatgtccacgtccctcacaccttctgccctgctgggctttggaatcggacctgaggctgcccaactccctcactgaatagtcatgcagccttcccttctctgagcctcctgcccctcttttctagagtgagggtgatcttagcacctctcagaggtggtctttggttccgttctgaggtgaagcaccaggtgggagtgcatggtgagtggggcagaactctttccccaccgaggcgcgcaggctagtgctgaatggcacttctgaagcgggataaccgccccaacacacgcacccagccctgcctgggacggaccttccggaaggagtgatgcttgagcccaggtctggacagggacaggtgttgttgcctcaggtggggtgggaggtgggcgtggggaagaggaaggtgctcagtcaggaaactggggctgctgggggcccccttcccccagtcctatctcacctctgtgcagggagagctctgtgggtggcccgaggcctggggccactctcctccctgcctgatggctacccaggttcaccaggggccactggggctcccaccagcccctgaccctgtgggcctgtggccttgcaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacgtgagtgccccaccctcaagggggtgatgggtgggccgcggacccagggcctctcagaggggtgtcccggtgctgggcttgacctgggtcctccaggcgccccccagcccctccttctttgcccagagctcctgcatcagcttctcatactggaaggagacagtgtccatcctgttgaacccggaccggcagtcaccctctgctctcgttagctacattgaggagccctacatggacatagacagggacttcactgaggagtgaccttgggacaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggccgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatgactgctgtggacctggcttttgtccctaggactgtgtttttcctcctgaaccccaaagaaaagaatgagaaggaaactggctgtggtgtttattcagggcccagggaaggctgaaggcagcagggggcgatgcagagatggcaggatcggggcaggtggcctcagccagatgtgcaacagcagacattcctctttagagcccagggggtcaggccgtcactccttgtgctgaggagaaagggatagctgagtgagcagtactacctgtcagcccccacagtccccctgcacagagagcaatgcccctgccactcctcaccttggggcccagggcgtcccgggtccgtgcccgcagcttgttggcctgggtttccgccatgtctgcccgctcctccgcatcatccagctcgtgctgggccttgcgatacttggccaggttggtgttggcctgctgctcctgggggcacacacagggccttggttccgcttgggtgactgagatgcttattctggtccctgccccagtccaagaagggagctagctcctcctggttctcaactttgttcctattgccactgtccatcctcaccaataccacagcgggaataaggaagttgggacgcaccaacttcatgtgcctttttgtgcctgccccacccctcagaggcagccccagccttggccaggggaaagcacatggggtctgttccatgagaaggagctaggtctgatctccccagagatgttagaagcttctctcttccctctgggtcactgaccttggagggtggagctgctgctgatgcctcacctggccacagaccctggggcagagctggggtgcccggtccaggtgtccaggccccagcgcactcaccgcctcctcaaactggcgcttgtagctcttgaccttgctctgcagcttgtccaccaggtcctgcatgcgagccaggttctt

SEQ ID NO: 7351 - DNA, 20295 bp, Homo sapiens
agggccatttgcgacttgaagagcggtccccataatttgctgtcatacatctgcctgggcacttcctgggggtctggttggtggcaggagaagggcataagcagggagggatgggtcatgttactgtattggctgtgtccgaatatttttactttatgttaaagttgatgaggcacaactattgcagagtccatttttccgagtctctgcgctcacctggctcctgggattgtggagggagttttgcagctttcagagtctgtgttttgggctcatggcccagccgaatggccatgctacaagtctgttcagagcaggttcgaggggcagaaacgtgtttcctcacaagctgtgactcaatcctgtctccggtggctgtgtcagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggtgggcccctctccagcgtctcaggacacggggagcaggtgctgcccgggtgctcatggtatgccaggtgctccactgggccttctgttagaatggctctcgctttagcctggcaaagcataggggtatttctccttctgttctacctataaggaaaccaggctgattccagaaccgggagtcttttcactgtgccttgctgtatggagcgtttctaggcagtcttggttggtgctgagggcagaagcaggcagttgcctctgtgaggtgaagactaaagagttgaaagctggcaagcctggccctgtggacatgctagaggagttgccaacctgatgtgggctcagggcagtgggacagagcccagagctgtgtctgcttaggaaaactgggcaagtacagggagctccagatgtgcaaggttccctgagccttgaagtagttccaagacggaggaggaggggcccataacctacagtggaggaaaaagggcttggaacagtgcggccctcctcaagactattgagaagtagccttttcctgcagaccgcgcccttctagggaggaaaccaagcatgggggcaggagaggctggaggctcagcagtccttccacatctttctgagtcagacactggactgtcacaagtctgggcaacagaggtgcagttacccccattttacaagtgaggatgaaaacgtccagaagagaatgaaagagtgtaccaggtgggagggggcagtgccctggggaggagtgtgcatagttgctggaacagtgaggcagcgcgggacagcctggagcaaacagccaggagaggagggctgagggctcacagggaccaggtcatgtcaagctgtcacaggccattttaaagactttggtttttactctgagtgaagtgagaagtcattcctctgactgcttttggaaagactggaaacagcaaggaagggaatagggcgaccattaggggccctcataatagggccaagagatgatagcagctaggaccagcacattgatggtgggactggtgggaggtggttgcattctggatatgttttgaaagataggatttgctgatggtttggatgtgaacttaagagtgaggagaggagttaagggtgactcccaaggtttttcgcccaaggaagtaggagaatggatttgccaggtattgaggtggttaagactagcaggtaaggggtggaggagcaggcttagggaggaagatggggagttgtgttttgtacaaggtagatttgaggtgtgtgttagaattgacacttggattgattacctacacctggtgttggggagatggcaaggctggaggtatcactttgggagtcctcagcatatggttgtatttaaaaccaggacactggatgagatcccacggtgatagccacagcattggtgtcccttccttcaatacggaacatgtttttaataaaaaataatagttttagggacagcttttatgcattgagtgctattacttttttgaggcactttcgcagttgcttatatgtgaaataattgtagggacagcttctgtgcattgagtgctattactttttcgaggcactttcacagttgtttgaattttcaggtatttagtaagttacacaacaggtggtgactctgtgtccccacactcgattcttgagaaagccagggcataaactgggctgtgcgctcaggggacaggcctggatagagccaggatttaaactctgctgccctgtctcctctttctgccctctcacagcagttctctgttccctgagccttcttgttgccaggttgctatgagttgttgcggtcttgagttaaactgtatgattacagtgctggttccttgggaagggaccactaatgaccttgaaatcctggccccccaaaaccactgtttcactagcgtgttctcatttgcacagtcagcatttcctgggtttctgctgtgtgccgggcaccgtgaggatctggattcccagatcctgcctacactgggtagcaaggggaagggtttccttggccaggcctcacagaaggcttcctccttaaagaggcctcctcgttaatgagcagttgggccaagttctcagaccaatcttggccaaattgaaatctcaggactggaaaggctccccatgtgctgtcaagtttcatccctctggtgctaatgaaaaccatccatatagcagtcgtttcttttagtgccccctgagtagcttctacagtacctcactgagccttttcaacagctccatcgtcccccatcgccttttctatcaagggacttgggttcaaagaatgttgcccagggtcacagagctatcttgtgaacccagggctgtctgactgcagagataaatgcctgagcctgtacccgctgcctcctctggtagagtggcacttcatctcgcccacctgcctaccatcctgctatagagcaggctacggggctggacctgagagtaggaataatgcattctacaagtaaaatttgttttacaaattttacacatgaagaagctgctattttctttctttcttttttttttttttttttttttctttttttgagacagtcttgctctgccacccaggctggagtggtgcagtgacatgacctcggctcactgcaacctctgcctccccagctcaagcgatcctcttgcctcagccctccaagtagctggggttataggcacacaccaccacacccagctaatttttgtatttttagtagagacagggtttcatcatgttggccaggatggtctgaaactcctggcctcaagtgatccgcccgccttggcctcccaaagtgctgggattaacaggcgtgagccaccatgcccggccgagaagctggtattgttaagagaaaagggaaatgatgtagtagaaacctcaaacctaagcactggcctgaacttaggagacccagggtcaggtccaagtctgccttagaaggcccctctcttcccagctgtgtgactcacccctaatctcttaagcttgggtttctagtctgtgcagtgaggcaattgcactggatgaatttttttgggccattgttggaacattttatagctgtgtgacctgggcctggcttagggccctttggagtgagacaggaaggcacatggcttggtgaacaccatagatgtcagccgtacctccccacccccagttaagcagggcaaggtagatccaggctgggttttagtaaaggcctgagtggcagaacaggtgtcattttacatcagcctcagtctaacagattctgggctgcttatgagtcttaacactggccagaggctgtgatttctagtaggaagagaatagtcacctctattactttcagtggcaaaaatcgcaattacttttacacaacctaatatgttgaaggaagaggtccatggaaatggaggctgccagggatgtctttgtcagcttctggtctcccaagataaatgcatacctgtagtgggctagaaaggggcagacttaagatctgaacacctgagttaggtgccgttgcaatcactgaccttacccaggctggtcttgctgaacttctcccccttgtaaaatagcaataagcgagcactggtgctgtgtgcagagctttacatctgctttctgactcgatccttacaacagccccgagaagggctagtaatagccttatgttatataaacaaattttaacagggaaatcattcctgcagttctgttttaaaagatataaattagtataagtgaagcctctctcccctctgatccttgacattctattctaatggttccatgaagcagctaattttaccagttattagtgtatccttctagagacatttttatgcttacaaaggcgaattgtattcctctttttttacacaatcagtaatacagcatgagcacacttgctttcccagtattatctctcggcaattgttcagttcacgacatataaaataccttgattcttttttactggtgccttgtatcccattgagtggcataccataatttattttggggtattacaaataatgctatagtgagtagtgttgtaaatatatatcatttagtgtttatatggatctgtctgagtgtaaattcctaaagtggaattgctggtttaaagggattatggatttgcaattttagagctactgccaaacactcttccctgtgcaggtcataccagtgtgccctcccaccaacagcgtgtgaatgtacccaatgcccaagtcaccaacacggtcttataaagctttgtcatctttcccagtctgaaaaagtgaaaaatcagagacatttgtaggactccttatagaggaatttctttgcctgtggcatgaattgccaatgtatgttctctgtttgtcatatttggcttgtgactttgcttgagttttgccatacagaatttttaaaggtttaggtggttgatgtcaacaagcttctttttgagcttctaggtttattataatccttcagaaaggcttttccaactcttagatcatttttttttctttgcagagatttttctagatcttagagttttttaataattgtatcttactttcagctgaaatttatcctagtgcaaagcatgaggaacattttgatgttaatacgaggagacaaatcttaaggaatttgtttaaggttacaaagtttgcacatggtaaagctaagagtcaaacccaggactcttgcatcccaaaggactcttgaatcatatgcaggactctctgaatcccaaactcatgcttctgtgataggaactaccggacattatgccttgtaggattattgtgagcattaatgagcaaagttagaaagtgggtttgtgtgtgctgggcataggggatacacggatgttttcttcagaccctggccctccttactgacagtactgatacttgtcctgaatatcattatcgtgtgtactgagcacgaggttttgctagatttttcaagcacatttgtcttaatactttttccttcctatcccattcaggttcacagaatgattgcagagttcaagctgatccctggacttaataatttgtttgacaaactgatttggaggaagcattcagcatctgcccttgtcctccatggtcacaaccagaactgtgactgtagcccggtaagcaggagacccccggggacagatggggcctcactggcttggagtagttgtttcaagacctgctgctgaccctttgaccttttttcctttgggagtagagcagaaactaaaatcatatcttatagtcccctaattggaagctaccttggagtaggatctgagtgaactccactccccaccccaacctatgcagaaatcccttttaagatcttcctaggctgggcacagtgactcaggcctgtaatcccagcactttgggaggccgagcgggcagatcacttgaggtcaagagttacagaccagcctggccaacatggtgaaaccctgtctcactagtgtgagagacacttgcgtctctcactaaaaatacaaaaattggccaggtatggtgttgggtgcctgtaatcccaactcttcgggaggctgaggcaccagaattgcttgaacccaggaggcagaggttgcagtgagctgagatcacgccactggactccagcctgcgtaacaaagtgagactgtgtctcaaaaaaaaaaaaaaaaaaagttcctgcctgaggccctctagccaacttccccttgtaatctctgtgatagggatctcatttcactccaggcaggggctgcccactgcatgagctagcagcctgcttttccttatttgctgttttatcctattgtaattttcatccacctatagaaccgtgctcccgggcgtggtggtcacacccgtaatcccagcagtttgaaaggccaaggcgggcagatcacttgaggtcaggagttcgagaccagcctggccaacatggtgaaaccccgtctctactaaaaatacaaaaattagccaggcatgttggtggggcacctgtaatccctgctactcaggaggctgaggtgggagaatcacttgaacccgggaggtagaggttgcagtgaactaagatcaagccactgcacatccggcctgggtgacagagcaaagacactgtctcatacaaaaaaaggtggctttggttttttgagcccaagcactctcctttagcttgtgtctctcacagtccccttgagagagctctgaacaggacattggaaggcttgttggaagagcttgaatgaatcactgaatctctgagcctctgttttcttgcaaaagaaggataatactctttcccctattggccccccggctagtcggcaccctgcctaccagcatgagaaggaaagtgctctgggacctaaaagtgccacccagccatcggcctggtgccatggggccctcttctcttcactgcactctggggacttccctcagcgacctgtcttctgctttatcatttgagtttttaatttcaagcaaatatattttgcatttctagatgttctgtctggctcaattcggaaactgcttagccatgatgttaatatcttttttctgctgcatattctgtttttaatcatttttaaaatactttcttaaggtctctttcgattgctcatggggcactaatgcttgtgtttgggtcttcagacctcagggtggagtgttgcctcgtgttttgtaatgtctgtggagcggccaccagaattgcttgaacccaggaggcagaggttgcagtgagctgagatcacgccactgcactccagcctgggcaacagagtgagactgtgtctcaaaaaaaaaaaaaaaaaaaaattctgcctgaggccctctagccacttccccttgtaatctctgtgatggggatctcatttcactccaggcagggagggggctgcccactgcatgagctagcagcctgcttttccttatttgctgttttatcctattgtaattttcatccacctatagaaacgtgctcccgggcatggtggctcacacccgtaatcccagcactttgagaggccaaggcgggcagatcacttgaggtcagtggggttagtttcccccttggatacctgtgtagcctcagccctggaggcatttctacagggcacttttgcttttgtctggcagctgtcccagggccagttttcttatttaatgtcttggccctactgccccagtcgtatgagcccagggtttctgctgctcttgggagggcccccttcacccaccagcagcaccatggcagagccaggctccctgggctggtgggtcaggcctttctaacccttctttcaccaagtgtacatgctccccaggctttactgggacctgacaccctgtctagtccctgcagggcattaaaacccaagccttagtgtgactaggtcttgtctccacctctccacactgcccacagctgctgagtatcagttccttggctcactattccaaactcctcggtcctttcttcatttctaactcctatggacttcccccgctcctccccacacgtgttgttttgtttgttggttggttggatttttgggacagagtctccatcacccaggctggagtgcagtcagtggtgcgatctcggctcactgcaacttccgcctcccaggttcaagtgattctcctgcctcagcctcctgagtagccagaattacaggcgcagcaactatgcctggctaatttttgtatttttagtagagacagggtttgccatgttgcccaggctggtctcaagctcctgacctcaagcgatctgcccgcctcggcctcccaaagtgctgtgattacaggtgtaaccaccacgccccgccttattttttattgagtgtgatggcatgtttttagcaggaagggggccacattagcttaatctgctgttgatcagatgtggaagtgaacagatggttttctaactaaagaaaagtcctcatggtacatgaggacagaggcttagagaagcaggctcccaccagagtgtctgcttgtgttattttggaaccttgtggctgtggtcctaacattgaggctgtgcatgtgtttcaggacatcaccttgaagatacagtttttgaggcttcttcagagcttcagtgaccaccacgagtaagtacaagagtgtccctgcaaggagagttgttgggctgtcttcggaaggcctcgatctccttgtctggtccctgacctcagctcgagaggaggccctggagctggtggaagcccactgtcccctcagtgttagcaggtgtgacactgcagtcggacctcccgtctttccagacttccttatggcaggcactgccccaagctttcttctaaccctcatagccaccccaggaactgagtatggaagtcgttggccccttactacctttggaatcaatggatttctcaacctactgcccctctaaagcaagagtggacagcgtggctattcccaggggccggcaggaacttcagacaggcaaagccgactgcttactgagcagctggaggattcttccctccacaaggaggtgtgctcccatttttcttgaaagacattctgcgctcatttattttttaaccttcgatggagaatgtacaaggaaaattactctctgctgtaaggaaaacagtgcaggaagggggtgactagcagctgacccttgaccttggcattggggaggtgatgtggggaccttagtgaacaagaatttcagtgagctcagctccagccagctgcgtgtgcacaggaaactgggcccactgttgcataacttctgattttttctgccaagcaaaggcagaaattaagatttatgtgaaaggtcctgattttaaatgttggtttaaatattttaaaaaccttgcatttgagctaacagaacatgcctggagacagctgtggccccagggcacctccatcatatgcacccatcctctgtgagaggttttccggctgaaagccatagaagggctccaggaagcatgttaaccttctgaaaaatggcaccacatatgttatggaactgtgctgttttccctgaggaagtgagtctctggctttcatcagactcttcagtctgagtactctgtgggatatcaggatgaatgcaaacagccatggcccctgctctcatgaagggcagagtctgaaaacagagacagttgttcatccaaggattccaccgttgagcattagtgataagtggagatggtattcaggaggagaggaacggggtctgtgagagacatttgacagggtccaggactggccagaggacactcaggaactctcccctgcagaagtggcttgccagccaagacctgaagtgtcagcttgtagtgaattgagtgaacaggcatgtgagagggtgtgtgttctagccagaagcccctgaacgagggaagaccattgtggccagctgatgggagtgatgtgggcttggctctgggctgggctgcacaggacgttgtgggtcacagtcacagggtgttgtgggtcacagtcacaggcctggattttatatacagatggtccacttagaatttttcaacttcacaatggtacagaagtagaattttgaattttgatcttttcctgggctcatgataaacagttcaatactcttgcaatgctgggcactgagctgcagctgcagctcagaatgtatttcaagaaaaatggtgaccagctacacgatcaccaaggtagacaaccagtactctgtgctgtgcctgccgtgttgccagtgattatggccaactgtaggctgaagtcagtgttctgagcacattccaggtaggctaggctaagctaggaggttcagtgggttagatatattaaatgtgttttctttctttttctttttttcaagacggaatcttgctctattgcccaggctggagtgcagtggcatgatcttggctcactgcaacctccaccttctgggttcaagcaattctacctcagcctcctgagtagctaggattataggcgtgtgccaccacgcccagctaattttttatatttttagtagagatggggtttcgccacgttggccaggctggtctcgaactcctgacctcgtgatccacccgcctggaccttccaaagtgctgggattacagacgtgaaccaccgcgcccggcctcaatatgttttcaacttaacggcattttcaaatacgatgggtttatcaggacataacctcctcctaagtcaggaaatgtctgttctaaatgcagtgggaagctgtggaagtgttttcaccgggagtgacaggatcagagtcctgattctgaagatcacttttggcaccgtgtgatgactcagttcctgtgggataccttttagtaaagggagctggtgtcctgggaacacaggacccagcagtgacaggcctggatggcaagtcgggggaagtgtcacagttaaccaggcctctgtgtgatgtgtgaccgtggtgcttggtgggactgctgcagcagggccaggcttgagtgtgattggacctgttgaggtgttggtgcctttgagaaaacaagtggaaatgtaggcaaagagaaaggcccagagctgctgagggaaggggccttgtcgatgaatgtggcaggcaggggtcggggatgggggtggggccagggagagattccactgcctgagagcccagagttccctcctgcaggtgctggctggagtgagaggtgctagaggaaagtgcctggtggcttctcagattctgtccacaggaagtgggcaggagactccctacactagcctggtgctgacccagcagccccagttcctgtcctttacctcctccaacccattttgtttcaggaacaagtacttgttactcaacaaccaggagctgaatgaactcagtgccatctctctcaaggccaacatccctgaggtggaagctgtcctcaacaccgacaggtgagtgcaggggtgcagcttttccctcagcccatcccggctgcccacgttccccgggggctcaccggtgagcacatccaggtatgcacgcgtgtcctctctcacatgcagctacagtgtcctgagggctcctgtgtgccaggcattgtattcatgtcacctgcattttctcattggagcctcacagcagccctaggaggggagccccatcagtacctgcacttgacagatgaggtgagcctcagagaggtcacctgccagaagtcatgtgtgctccgcactgccccaccgccttgtctcgtgcattcagcccctttgcttatgtgctcctttcttgcctggtggcatctgcagccaagcaggacagacagaagcctcttacctgctgccaagtgttaggttgcattacctgggttaggtttgcctcacctggagccaggcagtggggggctagtctcacaggcgtcagaatacagtggactttatccaacaagagccatgatttcccaaccttttttgtttgtttgttttgttttgttttttagacacaaggtcttgctctttctctcaggctgcagagcagtggtgttatagctcactgcagccacaaacttctgagctcaagtgattctcctgcctcagccgcccgagtagctgggactacaggtgtgcgccaccattcccagctagtgtttttactttttttttgtagagatggggtctcactatgttgcccaggctggtctcgaactcctggcctcaagtgagcctcccaaagtccagggattacaggtgtgaaccacctctcctggcctcccaatcttttttttctaaggtagcagaactcttcattcaaataaaattgtacccagtcctgccctgatgtctgcagtggatcacagcagagctgctctgtttgaagggcccagacccctgcgtgcctggccgtcttccttcccccatgacggggccagagtcatttcctcatctcctgcctttgcttcatagactgggaagctgaggcttggagttgtggacacttgcccaaggccagctggaagtgaacctcaggcacggagtacgctgggcctcaccctattggcagagtctttccccatctggcagactggcatgacctgtttcaacacacttttggtataaacagctctcctctggcagttctaagccatgtctgattctggatatgtttctggcctgggaaggaaagctggcctgagatgtggtgggaatgcacttggcagtttaattctgtggctgcaggggtctccggggctctggacccagttggagcaggaaggcatcctgcagacttggaaatgtccccatggtttttcaccgcctaagccagcagaatgacccatccccagggcccctgtcagcctctcagatctgtcaccaatatctctcttctatttcaggagtttggtgtgtgatgggaagaggggcttattaactcgtctgctgcaggtcatgaagaaggagccagcagagtcgtctttcaggtgagtctggggaaaagtacctgccgattctgcggggctgcagagccaggtgtttctcaggaggttaggaatacctcctttagtcaccagcgtccatgcctcctgaagcacaattactgttggggagaggtggtttgactgccatcttgtgtagttttgactcgacaggtatgtgagagcttcttctgcagcccacagtgaccgagcattcaccaagcacctgttctgtgctggtgccttatgggtgggagagaactaggatacgggccctgccatgaattccctagagctgtgctgtttcaatgcagtgtgggaaggaatggagccagggttggcccaggagctatagcagcaaaggaaagcctcttccgctgctagggctgggggctgggtgaatacagggagaccttctctgaggtccttagatacatctaagatgagtcttgaagtcagtggacaggtagagttccatcagggccgggcgtgagctgtcaggaggcttcatgcccacatgggcctttgtcacttcagtgccttgtccaaactccctgtcgtggatacccgctgtgccctctgggtccctcggtcagcatcaaccactacttccctaggccagcccatcgtctgtgagcccagtggcctgtctgcatgtgttcgtccgcttcccacacacattcctggcccctcaattgcacgtcctcccattcttgtgaaagggcaaggcctagagtatgtttcacgggggctcgcaggagccagcccttcgatcccagatgttaccctttctgtgacacagccccttccagacagacccagatagaagacttctccactgagctggctctctgtgaggatgggggcactgctgtgtccccaggcccaggatgaagcctgatgcttggtagatgttcagtaaatgttgagtacatgaaaaggcaacaaacatctcccaaccccttggagaactgaacatgggccggaagagggcagccttagccacctgagccagtatttgggtcgcaggttttggcaagctcgggctgtggagagtttcctccgagggaccacctcctatgcagaccagatgttcctgctgaagcgaggcctcttggaggtatgatctggagcagccagtgtcttgggttccgtctccccccagcccacgcgttgctgtgtcctgtcctgagccccaaacagttcatcaggagcagagcagatctcgtgacttccaaatgcctgtgcaggctgccttagattttgccctgggtttccaactgtgggttccccatgggtgcttacggggtgacaggtttagagggtggccaggccatgcaggagggtgacagtttggttacccagcaaggcattttgaccctgaagatattttgtactaaaagttaattttcctttattgaataatggtcttcagaaaaagtaaaacttagagcagaatggccaaagttataattggtctttcagattttttcatatggacaagaaactgacccacgaattataaaatccatgtggaaaagaattgatccaaatcaatgtaacttcaagaaaatgtagaaaactttataaaggagtaaattggctttattctcttgatgaaaactcagtattttggtgtaaactctatttaaacaatttcgttcataaacacaaagacaaaccatggggtcaaaatgtgtcctttgcttttaaattctgtccttcatttacttgaatgacctcagtgcttaggcagtggcctgtgttttagacctggtgatgacagctcccctcacctaggagctgagcaccccggccatcttggtgaccacagagcaggtcacaggcttcagctgtacgccctgggcaggggagagattgtgctgcattcccagtctgctccacctcctggtgaggtctgtcaggcctggtcctgtccttggagccaccagcatcctcagacaagaatctagacagtgttgccagttccatccccaggatgcttgctcaaagccaatgcatggtctgagctccatgccaggccctggtgggggcagccacgttgacaccttcaccctgtccctcctcacccagcacatcctttactgcattgtggacagcgagtgtaagtcaagggatgtgctccagagttactttgacctcctgggggagctgatgaagttcaacgttgatgcattcaagagattcaataaatatatcaacaccgatgcaaaggtaaagttaacccagggctctgtggagtgtgctgggttgtccagaagttcacctggagtcctggtctgccaggctttaggcacaggttttacgttagagacgacgggggagtctgggcagtctttggcaaacattcattggaacctgctctgtctggctttgtgctagaccctgggaatgcagggatgaaaaccggggctgcttgtgggtagggagtgagggtgggaatgggtggcttgtgcgcctgccgtgacgcagcatggtgggtgccacggtgggagccgctgtagggagggactgggcctggtgtgttaggctcaccgagtgtgtgtgacagaaacccagctcaggctagctgaagtaaaattaaaagtaaaaattaaaggaatccagcacccttgagcgtaaaaccactggagagagtgtcggatctgtgctgaattccggggagtgcctcttagtacctgggtggtgaggggaggtccctcagcttatctgagcctctgtcttcctatctgaagcagtggggctggtagaggtcgctgatgccccttgtagtgactatccccccgggccatggccatacctggccagcagcccactgcctgctgtgagcttggtttctgtatagttccaggtattcctgaagcagatcaacagctccctggtggactccaacatgctggtgcgctgtgtcactctgtccctggaccgatttgaaaaccaggtggatatgaaaggtacatgaaaggcaggctgtcaaggcaagtcatgcagggtaagaatgctggcatcagacaccctgtctccagcagggagacaagaatgactgagggagctgcaccagatgcccacgtggccggcctcaaggtggcggcttccagggcaattggctttgctgccttgttcaacactttaataaggtgaaaatccattgttgctagcaagatgcaaagaaaaccagaaaaagaccttcctcttctgggctggtattgcctggcacgatgagttggccccctcgtcctcagtgtgctgtgcgtggcatcgcaggtgccctgtggtgcagcaggcatctgaaccctcctggacttgctaacgcacttccatgtgtatgcgcacgcgtttcctttttttcctaggagagggcttgtggcatccagcagattctcctgagggtttgtgacccccccacacccccaaaaagtcaggcacttgttccttgtcacggtcactgtcattgatagcaagaagtatcccggttgttggtaatttagccgtttgcttcctttttctgccccagagggtctgtttcaggggaacagccacacagattttggtaccttcggttattgccctgcctcccagttgtgcgggaagcagttgctccgacactagtggacggagcagaacctgtgccttgtggtctcagcactgggccggactcacctgagagctggtgtggaaaaccagttgcgctaggacctctgcagaaggagtggaacttttgcgttgtttttcttaatgcagcgtcatggatccatcttcctgtggagggaactcttctgtgtgtgatatggagggcacgggtctggagccagtctggggagggctgagggagagctgccctgagcttggttctggaggatgaggtggggtgctcctgggcactctgagaacatggctttgcctggtagcaggacagctggaggtccttctttctgccacagtcagctttcgttgaagctgttttgatgatgagctcctagcttcagagtcaggacccaagcggggctccacgaaaggcctgggcgacccagccactgggcctaagcctgacctgctgcacccctgcctccctccacagttgccgaggtactgtctgaatgccgcctgctcgcctacatatcccaggtgcccacgcagatgtccttcctcttccgcctcatcaacatcatccacgtgcagacgctgacccaggtgagaggccccggcagacacacagcagggaaggtcgattggaaaccacttcctttgtcctggtgcccagcaggtttctgtcccccactccagaagtgcgtctctggagacccagctcttctgaggactgtgctcaggaggaatcagtgtcccattgtacagacagggcctaaggaaggagggctcgcaagtgccctcaggtcacaggctgacttgcaggccagtgctctccccgcctcccccatgtccacgtccctcacaccttctgccctgctgggctttggaatcggacctgaggctgcccaactccctcactgaatagtcatgcagccttcccttctctgagcctcctgcccctcttttctagagtgagggtgatcttagcacctctcagaggtggtctttggttccgttctgaggtgaagcaccaggtgggagtgcatggtgagtggggcagaactctttccccaccgaggcgcgcaggctagtgctgaatggcacttctgaagcgggataaccgccccaacacacgcacccagccctgcctgggacggaccttccggaaggagtgatgcttgagcccaggtctggacagggacaggtgttgttgcctcaggtggggtgggaggtgggcgtggggaagaggaaggtgctcagtcaggaaactggggctgctgggggcccccttcccccagtcctatctcacctctgtgcagggagagctctgtgggtggcccgaggcctggggccactctcctccctgcctgatggctacccaggttcaccaggggccactggggctcccaccagcccctgaccctgtgggcctgtggccttgcaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacgtgagtgccccaccctcaagggggtgatgggtgggccgcggacccagggcctctcagaggggtgtcccggtgctgggcttgacctgggtcctccaggcgccccccagcccctccctctttgcccagagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggccgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatgactgctgtggacctggcttttgtccctaggactgtgtttttcctcctgaaccccaaagaaaagaatgagaaggaaactggctgtggtgtttattcagggcccagggaaggctgaaggcagcagggggcgatgcagagatggcaggatcggggcaggtggcctcagccagatgtgcaacagcagacattcctctttagagcccagggggtcaggccgtcactccttgtgctgaggagaaagggatagctgagtgagcagtactacctgtcagcccccacagtccccctgcacagagagcaatgcccctgccactcctcaccttggggcccagggcgtcccgggtccgtgcccgcagcttgttggcctgggtttccgccatgtctgcccgctcctccgcatcatccagctcgtgctgggccttgcgatacttggccaggttggtgttggcctgctgctcctgggggcacacacagggccttggttccgcttgggtgactgagatgcttattctggtccctgccccagtccaagaagggagctagctcctcctggttctcaactttgttcctattgccactgtccatcctcaccaataccacagcgggaataaggaagttgggacgcaccaacttcatgtgcctttttgtgcctgccccacccctcagaggcagccccagccttggccaggggaaagcacatggggtctgttccatgagaaggagctaggtctgatctccccagagatgttagaagcttctctcttccctctgggtcactgaccttggagggtggagctgctgctgatgcctcacctggccacagaccctggggcagagctggggtgcccggtccaggtgtccaggccccagcgcactcaccgcctcctcaaactggcgcttgtagctcttgaccttgctctgcagcttgtccaccaggtcctgcatgcgagccaggttctt

SEQ ID NO: 7352 - DNA, 188 bp, Homo sapiens
tctgcgtgatagttcttcaggttcacttcacagattagctgacacttaactgttctggaagctgggccaaggagtgctaacatggaaattgagtaactatagttttttgcccaaggtacaggagaataaatatgagtagatagaatctcttaaattaaaaatttctccagtaaatttttcctaagtct

SEQ ID NO: 7353 - DNA, 3241 bp, Homo sapiens; identical to SEQ ID NO: 7350

SEQ ID NO: 7354 - DNA, 20295 bp, Homo sapiens; identical to SEQ ID NO: 7351

SEQ ID NO: 7355 - DNA, 188 bp, Homo sapiens; identical to SEQ ID NO: 7352

SEQ ID NO: 7356 - DNA, 10172 bp, Homo sapiens
ggcatctccttaatggctccctagtggatggagagcctcccatgaagaggaggcggggaaggaggaaaaatgtggagggacttgatctgcttttcatgagccacaaacggacgtcattgagtgcagtaagttggggagcttgcctgcatggcgattgcacgtgttgacagctgagggtcctgtgatgctcacgatgctgggctgtgtttctctcagcagcattgtatgaaagccagcttcctccactaaagaaatagttttacaataaacagtcatgattctgatcattgatacagatcacttggcctgaacgaagtgtagcttgaggatgtattcttcccaagttctgatgtgttgattgctctcagaagaacagccaaacctagaaacatgttcttctgaatctagaattgttatctctgaattcttgaggtggaacaagtttcattgatatgttttaggcctggcatttattaaaattagtataaatgtttcattttggacctaagatttgggttaacataaaaagctagtgactgcaaattctcctatctccttaagtagatattttaaaaatttgagctgtgcttttgctagaataggtttgaatagaatgtgtgaaccaatggattttgacttttcctttctcagttcagaggaaataaattaatgcagtataatcaaaatgattttctttcttaatctgcttcaactacatctcacccaaaaatgtggtgcctgactcactgatgaccagaattttatcccaaagagcacaattacatgtgcttttttaaaaaatggtttagcactatatatcttgaacctattgaccagaagccccagtcaccatagtggctggaactccttgtctgtgttgtgaggagtgggtgctccaggaagccttccaggtactgggccatcctggacccttcttcaagcagtgggacacagtttgggaaactgaaaattgagattgagggaagacagttgtctgtttcaacatgtttttacttacaccatccctattattatttgcccattttctatttcttgaactcagagaaagcttaataagatggcaggaaaagacatggttgagttaaagttcagaaatgaaaaataacatccactgaaatttctttgccctctggtggggtctaattaaaacagaagcattcaggtggctaagagtaaattttcaaaattgggccgggcatggtggctcacgcctgtaatcccagcactctgggaggccaaggcaggtggatcacttgaggtcagcagttcaagaccagcctggccaacatggcaaaaccttttctttactacaattataaaaattagcctggtctggtagcacgtgtctgtgatcccagctactcaggatgctgaggcaggagaattgcttgaacccaggaggcggaggttgcagtgaatcgagattgcatcactgcactccagcctgggtgacagagtgagactctgtctcaaaaaaataaagaaaatttttttcaaaattgattaccaatgcagtgatcatcataatggtcatatttgttgatggtatgattgttttcagaatcctgtaaaagtacactttgtaatggactagctgtgacttacatgttttctgtaagttaaaatgccatttctaggggtatggccctcaaacagagttgtagcactagtaaatagccttcctgtttgaaactacttctttgatagattttgttgactgataaattctttctccataaactttaacaaattgggaagtttctgcagctgacacttctttttgtttattatcatgttcaatatttgtaggtttttttgtttttgaaacagggtttgtttttgagacagggtctcactctttcgcccaggctggagcacaatggcgcagtctcggctcagtgcagcctccaacttctgggctcaattgattctcccacctcagcctccctagtagatgggactacaggcgtgcaccaccatacctggctaattgttttgtatttttggtggggacggggtttcaccatgttgcccaggctggtctcaaacttctgggctcaagtaatccacccacctcagcctcctgaagtactgggattacaggcaatcatgttcagtatttggatcacgacacagctttgtctctggatcaggtgttaggaattaataatgcaacacacgtgcttttttcctattgcaagtacacattctattttaaatctgagactgattttattcatttcactattttaagccgttgttaagaatttgttgatatttttctttttctaaagtcccatttagaaagcctgagagaattcctaattgaagttagagaatgtatttttaaaactttttttttttaactgtcacattttgaaatgtagggattcctcatttggtgttgtcgggggtgatgtgcatgcacataaaatacaaggaaagcactgctcgatctgtaaataaaccaagtaggaaaagatgtaaaggccagcagtgttacctggatgaaagaggacagatcctagaatttagtattttgtcagcactctaactgtgctgccatgaaaaagtaagagtgcattcagcaacagtggacaagctggcactattccctgtgccagcactgagagtcaaaaaatacagtcctgacaagtgcttgcactggagaatgcagtgtttaggatggggtagcacataaatcataatgtgtcctggttgttcatgtgtgccacgaccaagggatgtctagggtactttgtgagcccaaaggaagcctgggagtggagggaagaggatatggggagaaacagatgaagaagtttccctatggatggctgtacttcaattaagttttgaagatcatgtagtagttggtcattttaaaagggttggcagagaacatgtgtaagaggagagagcctcttgggtttgaagaactgaggaatttgctgaggaagtgagcttcagcagagatgagcttgcagagaaggcaggatgcaaatcatggagggccttgatgccattcggaagaacttggattttgtcctggagttaatagggatgcaattattgaaaaaaataggagagtgatgtgacataattttttgaactgggaagggctgcattttagaaaactgactccagcgtagtggtgtggaggttggattgaagataggtgggattagaatcagggagaccatttaggaatattgcaataacctgggtgggaagtgacaaaagcctgggccatggtagagctgtggggaaggagaaatgggtgtctggaggttgaaataactgtagacttcagttagtggtggtctttccaatgttgccacacatgtctgagacaaagtgtcccactaccaacaaaattatattgtgcacagagtgcccataagttacatatagactggcttttagaaattcctttagtataaattatctttaatatcattatccggggatctccaagagagactgagaggccgcctttcatgcatatcagctcagactataccccccatgttgtattcccagtggctggcttaggatttcagagcatggaaccttagtggactataaattttttacctaattactagttctacagtgtgaagaatgatataaaagtttcgtcttcttctttttatttttatttttttgagacgaagtctcactctgttgcctaggctggagtgcagtggcacagtctctgctcactgcaacctctacctcctgatttcaagtgattctcctgccccagcctcccaggtagctgggattacaggcaagtgccaccatgcctggctaatttttgtattttttgtaaagatggggtttcaccatgttggccaggctggtcttgaactcctgacctcaggtgatccgcccacctcggcctcccagagtgctgggattacaggcgtgagccaccgtgcccagcctcattttctgacttttaatagctgttcccaaacaactagacattgtttctagtaactattttctctttttgataaaagatccattctaggatagcgttttcttgaaataggacattgtcagaggctctctcttcgtgtgagaattcataccattgtgaactttctgcaggaggatgctgaggtgaccaaagcttttgaagaagatatagagaccccaccaacaagaaacattccttctcccggacagctggacccagacacacggatccctgttatcaatcttgaagatgggactaggctggtgggggaagatgctcctaaaaataaggatttagttgaatggctgaagctgcaccctacttacactgttgatatgccaagttatgtaccagtgagtattgcagagtttagagttggaaggaatcttgcaggccggtccacttcattcccttacaacatagaaatccctgacagctggtccctctgccttttccttgaatgtttcctggtctcaaacatttcccaggtctttgttgttgaatcttcttcattacagatactagcttcaggtctgtcttactgaaggcagccttacagttatttgaagatgcgcgttatgcatttccttactgtttgcttctcccatcaaactcatgtgacttcttcagttattctttccatggcatcgtttccaggcagtcttagtattggggtaacactgttgaatgcactttctccagtctccagacgaggccccgccatcccagagtgctatgaagccaattacttccagagatttgaccagttagtgcagcccaagattgtattagctgcttttatggcaactaatcctggtgccttatattaaacgttagacagttcatatctccaaatggtttgtcacacgaactgtttgctagctagcaatgcaagtcttttgctttctgtatttatgtgattgattttttaaaacttaaatgtagagttttacattttattttgttgggttcagcctagagttcttgccactcagaaagtacccccaccccctacaagatctgtctgtttgttggttagttctcattacagacagtctcatgttgttgatggggtatcatctctgtgttcattggagccactaactagaaattagtaaaagtactacagaaagcctcctttaaaagtatcatgacttggttaaacatttaaagaaaaactttaagtgaggttattgatagataaaaggaaaagccaattctcacttatgtattccttaatggacgggtaaaataggagttttttctttcaaagagaaaaatatggtttctaatattaataattaaaatgattcttgaaacttccataataattgaagatgatctgacagttctctttggcatttatatagagaagaataagtactaaataccaattttactaaatatgttttttcttttgcagaagaatgcagatgtgctgttttcctcatttcagaaaccgaaacagaaacgacatagatgtcgaaaccctaataaattggatataaacactttgacaggagaagaaagggtgcctgttgtcaataaacgaaatgggaagaaggtaaacgctgggaaagggaattgatcactatgcgatttcttagcccagaaggaagtgttttatcctgccttcttctataggggaaaagaatcctgtctgcccgaatgcgtgtgtgcgtgtatgtgtgtattatagaagggggagggagtagattaacagaaaggggagggaagactgtgtttttaatcatttgtcaaatgcctctacccagatgggtggagctatggcgcctccaatgaaggatctacccaggtggctggaagaaaatcctgaatttgcagttgctccagactggactgatatagttaagcagtctgtaagtacaaactgcatttctatcaagaaaggtagctatacaaaactgttttccttagtctttcttattttctgttggccattaattattcagttgtaacttagcttaaaagaattgacataatacatcattttcatacatcatttcatacatcattaatacatcaatcattaatccaaagtgaattcatttatcagctccaatttaaaaggtttgtatggaaacatacattcacaatcttagaggtagacttctccaggggggattgccccagctaagcctacttaacagctcacctgtggaataggatgtatggtggttgagatcattaagattaactgtgatttctgatttaaaaacaaaacaaaacaaaacaaaacaaaaatacaacagttctgcctaaaagatttgttaccattagctttttaaaaattcgttcatgacatgctggttctttgttttaattatacattaaaaatgtctttcggtgtaacattctgttgatcttaacacacgtgtgagtttgtgaactgacaccgtagtcagaatagggttccatcccccacccccaccaccccgagttccctcacaccgtcctttccccgaccccagcccctggctgccgctgacctgttgtccatccctgtctttttgagaatgtcctgaaatggaagcatgaaggacataagtcttgaagcagtttctttcgctcatcatatggaaggtcatcgatggtcacatgtgtcacagttatctcctttctgttgccaagtagctgtctccattgcatagatgtgacactggacggcttagccctcacacactgaaggacatctgggttatttcctgatttttgaaactatgattagagctgctataagcaattgtgtacaggttttggtgtgaacataagttttcatttttctagggtagatactaaaatataattacattttccatatttcaaaaatacttttacatatatttgaaatatccaaaataacacattatagagggcataaaacatcctgggtttatattatgttatactattttataatttttctcccatacaatatctttttttttcttttttttttttttttttgagacaaggtgtttgtcacccaggctggagtgcagtggtgaaatcacagctcactacagcctcattctcctaggctcaagcaatcctcccacctcagcctcccaagcagctggcactacaggcacacatcaccaagcttggctagtttttgtattttttgtagagaaggcattttgccacgttgcccaggctggtctcaaactcacctcaagcaatctgcctgccctgacctcccaaagtgctgagattacaggtgtgagccactgtgcccagccaaaatttttttttaattgacagatatttaattgacaaaaattaattgatgaatcaaatatatatgcaaggtgtacagcacagtgtttttttcttttaagagacagggtcttgctgtgtcacccaggctggagtgcaatggtgcaatcatagctcactgcagcctcaaactcctgggctcaagcagtcctcccacctcagcctcctgattagccaagtagctgggatgacaagcatatgccaccacacctggataatttttttttattttgtagagatagggtcttgctatgtgccccaggctggtctcagactcctgggctcaagaaatcctctagtcttggcctcccaaagtgttgggattacaagcatgaaccacggcacctggcttcaaagtgatgatttgatataattatacattatgtactttcctttttaaaaatttgttatgggtacatagtaggtgtatatatagggtacatgagatattttgtacaagcacacagtgcataatgatcatgttgggtagatgaggtatgcatcacctcaagcatttaccctttgtatttcaaacaatgtgattatactcttttagttattttaaaatatacagtaaattattgttgactgtgtagtcaccctgttgtgttatcaaaaactagatcttactcatcctgtctaactctatttttgtaccccataatgtactttctgatgtatgatttgttgagttagttatggatgcagctaacttgacatttacctcactgatgagtagccttgagcaatttttgtgcagttcagcaagctaacataataataaaaacaagttttgctgtcattaagttttatcattgagctgttaggagggaagaactacttaggtatttccatttggaatggcaggttcaccacagaggctcacattgagatcaagttgtcttcgacagcctttatagccactgtttgcctcccctgtactccagggttttgttcctgagtcgatgtttgaccgccttctcactgggcctgtagtgcggggagagggagcgagcagaagaggaagaaggcccttaagtgagatcgccagagcagccgcggccgccgctgctgtggcctccacgtcagggatcaaccctttgctggtgaacagcctgtttgctggaatggacctgacaagccttcagaatctccagaatctccagtcgctccagctggcaggcctcatgggcttccctccaggactggcaacagttgccaccgccggaggcgatgcaaataaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgcccgggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttcttttgaaactgctttccatgtaagataaaatgtaaatgcctgccaactgtagtaatgatgctttaaaaaaaagtgacccatgatatgcagagaatgtaattatagaatgtagtatataggga

SEQ ID NO: 7357 - DNA, 986 bp, Homo sapiens
actcaactgttttgaagactagacagtaaggaaaaccttgaattactctcacataattccactccagatatctcaacagcaatgcatacaaaaagctcctattactccctcaaaagggcatctgagaccgagaatacttagaaatgtgtgcagcgtgtgataatgtggtacactgaagaacaaaagggcaaaagaaaaatgaggctttaacaggcacaatatctaggtcatttatccttggttaatgggtagaaaaacacaatgcggtagtgtcagcaagggacacaaaggcactctggtgtcctgcagaccagcgctcgatgccagaaaccagggtgtggaaaaacccatgtggaattgaaacagacccacttaagcacgcacgcgcgcacgcacggtctcaggagctactgatttgtggacccctttttgacctttggtatttaaagtaaaatataatttgagatctactgttttcacctttttatgtcacctgaaccaacacaaagccatatttccatccagttaaaaagcaggggaagggatgtggacgagagtgtttcgtgtgtgttgccttcctccacacccttcccccaggacgtccgcacacagtccacccccagccagtgtgctgccagacaggtggtctaaattcctcccagactgtgagattcagttcgtttatgctccaagatgaaaatatgccccttaatgattctgggaaagaaacaacctgaaccctccaccttacagatcctgtgattgcttttatttatcatcgtcgttgtctgctgaaagtgaatgggccgtgcacactggaggaaagtgccttgaagagaatattttttgaaagggaattatttgaacacgggaaagtgaaactaggtctgcatgaagtataggaaatttaagtatttaagtaacaaagatgttagcagggagaatttgcttaataaaatgagtcattaaagggtgttttttttaaa

SEQ ID NO: 7358 - DNA, 8173 bp, Homo sapiens
tgcgtgtccgcatgctgtactacctaagacaagaagtgataggagaccaggcggataagatcttagagggtgctgactcaaggttagtgcgagctcacatttgttctcaacctcagtgagataatctgggtagccggaaaacatcatggattgtgtttcagaaccttcataaaccactagtaacccatctccttttttgcatcttgaatgcagtatttgtccttcgtgcttggggatgtgatgagaatcaggaaaaggctgtttgcatttatgtttgtagtgtaaagagatgtgaactaaagcactggtgttctgagatgacccttaaaatgggataccatgtgataaagttcatttctggtcatggcagagggctactgactcatgccctttcttttaaccttgctgatacctccccaccatgctcagatgtttatcgtgggagagagggcatgtgagctatgtatcacattcattacttggaattcttttttaatactaatatttcttataaatgttgtctttcagtgaagccgatgtgtggatccctgaacctttccatgctgaagttcctgcagattggtgggataaggaagcagacaaatccctcttaattggagtgttcaaacatggtaagtgacgtttctgtttgaatacatctcaactgtatggcttggtctttatttagaactctttacatactcttttccaaagtcataatattaatgaggatagttccaaaggactcttggcgtctaccatttttctgtactaaaaatctaatatgaactgtaaatatcagatgctgtttttgaatgtttgttgagcatttgagaagaaaacatttctttcttggctgtaaataaaacccaaaccatatttgttttaataatagccaagttgtactatagctctccctaaactttgcttccagcgcggcttcccttgctaactctgccaaccagtgtcaaagtggacggtgggcttaacctctgctattaatctgtacaagtgcctcctgggctttgttccaagcaatatttcacaaatgtcagtgctgagaactcgcggctcccctgagtgggatgcagccttgttaactttgaaaggctggggatgcagaactggcatgatatatacagtgagcgattcctgattataatcccaattctctggaggtcgcggaggtattctcagcagcccagcctgactaaaggggagaatgatggcttataaaacctttcatgattacagtttggcttgcggctctacagcagttaggagcggtgtgttgtagtacacatcctaattgaattgtgctgttctgcctatgtactgcagccacattttgtgagctcagcctcaaaatcattttcccgcagtgcactgttgggatctgccattttccatctagtcaacttgggcagtcaaaaagcaaattgcagtttgaaaaccatagagggaaccgtgtcatcttactgacatgcatcatcctaaacctaataagacaggttcgctggccttatgtatatggggatttttcagccagccatgcgagttcctgcaggactgatgctattcacagagtggatgggggtggactcagtgcacccctgcagaggtcataaaggaacattgcgaatccttctaaatgtcaagcaaaattagatctggggaaaaatagggtcagaaatcctcccaggcatcttgcagttattctgaacctgtttttctattagtgtttgtggtaattctgataatatccctgaagtgtaacttggctcccagtagcttccctagaaggagcgttccatagaatgatctactaaaacaaggtccacttggattcaacagagatgctaaccttgactgaaaaacaaacttgtgttgtggcagtgctgtgattttgccagtgatggggcctttctttgtttctgtgtgttttctgtgcacggatgggcacggcacaggctatgagaagtacaacttcatgcgagctgaccccgcgctgtgctttctggaacgagtcggtatgcctgatgccaaggccatagctgccgagcaaagaggaacagacatgctagcagatggtggtgacgggtaagaaggacattttaaaatttgaataaactttatgtcagtttcacatctattggcagggttcagttcttaccctgcagtacacactgtattgtgtctgatttgaagttcaggagatgtttaccagtctactctatttgtatgtcgtaatgactgtttaaacaatatacattatcttgataatctgaaacttgtttttcttttccaaatgtcatttcccgcaatctccccagaccccctccaccacactgccatggctgcatgttttaaatactgatagagttgcttttgatgtcaaacccataattaaaagtagcactgggcagattattactctttcctacccaccccccttccttcttttgcttatcagtatgattcaaataatttttgtgtttgttttacataggggagaatttgatagagaagatgaagacccagaatataaaccaaccagaacaccgttcaaagatgaaatagatgtatgaacttgagtatattggcttttatagctccattaaaatattatatgcccacataagacttgttaaactttatagataatgaccttttctttaaaagacaaagaaaaatgagaccccaaattaaagtaattctgtttcttgctttgctttcaaggaatttgcaaattctccttcagaggataaggaagaatccatggaaatacatgccacaggtaaggtcccagaaaagcttgtgtagccgagcagacgtgcactgagcagtcattgttcacgtggtagggactgtcctgcttcatgacagcagtgtcttaacaccttatttcttctacactgacctgttttgtgaatcattttaattcttgttaatggctgtgttttcatgacattgaatttcttagataggataactgtttctttgatgataattagctgatttatattttacactaattagtgaaaaattttaagcatctaaactatagctcttgggaatagagcatagagcatttgctaagtattcacctaaaatattttcagtttatttagaatattgaccttttaccgaatataaaatcattacacaacaattatgcagttattttttatactcaagatgattattgcacatacattagaggagagtaccttataagaagtttatgctgtaaagtgtgtttctttatgtaggactaataaataatgttttcatcccctctaaggagttaaaaaagaaataagtgtatatattccaagtgaatgttattacttatttatattttaaaaatgagggcactgagatgccctttcccacactgtcatttgaatcttaatgagtcatcctgttttgttggaatactctgtattgcaagattgcagctacacatttcaaaaatgtttttccacttccccaggcaagcacagtgagagtaatgctgagttaggccaactttactggcctaacacttcaaccctgactacacgtctgcgccggctcattactgcctatcagcgcagctataaaaggcaacagatgaggcaagaggccctaatgaagactgaccggcgcagacggcggcctcgagaggaagtgagagctctggaagcggaaagggaagctattatatctgagaagcggcaaaagtgagtttcttcaaggtttccactcagctcccggtacatgcccctctgccctgctcctgtagacccacaagagacaggactcatatcaaaggtagtgaccaccaaagaaaggctcgctccaacaaagcagtctgtttccccacccccaaataactaccatgtataaagtctggggggaagaagaaaagaaacagtaaatattaagtcttttcctgaagtatgatgcaagctaatataatctttctaacaggtggacaagaagagaagaggctgatttttaccgtgtggtatccacctttggggttatttttgaccctgtgaaacagcaatttgactggaaccaatttagagcctttgccaggcttgacaaaaaatctgatgagagtttggagaaatacttcagttgttttgtggccatgtgtaggcgagtatgtcgaatgcccgtcaagccagatgatggtaggtacatttagcaacaaagttctatacaaaaagacgagtaaagtgaaaaataagaaagtgtacaatgtagaatgcccttgaattctccccaagtaaatatgagcccttctgtgttacagaaccgcccgacctctcctccataattgagccgatcacagaggagcgagcctctcgaactctgtaccgcattgagctgctacggaagatccgcgagcaggttctccatcacccccagctgggagagaggcttaagctctgccagccaagcttggatctgccagagtggtgggagtgtggacggcatgaccgagacttgctggttggtgctgctaaacacggggtcagtcggacggattatcacatcctcaatgaccctgagttatccttcttggatgcacataaaaactttgctcaaaacagaggggcaggtaatacatcttccttgaacccactggcagttggatttgtccagactcctccagtcatctcatctgctcatattcaagatgagagggtactggaacaagccgaaggcaaagtggaggagcctgaaaacccagctgccaaggagaaatgtgagggcaaagaagaggaagaagaaaccgatggcagcgggaaggagagcaagcaggaatgtgaggcagaggccagctctgtgaaaaatgaactgaaaggggttgaggtcggcgcagacactgggtccaaatctatttcagagaaaggttccgaagaggatgaagaggaaaagctggaggatgacgataagtcggaagagtcttcccagcccgaaggtaaggccttaccactggcccctctcctgaccctgcagcagctggttgtgagatgcgttgctttctggcagcacggcacctgctctttttcacgagtacttagtgtacattttcttctgtgaagggataatttcaagttatgcttatatctgtgttttgctctcgcaccttatagcacctaaccatggtattttgaagaacataaactctaagaagggttgcatggacacattagcaatttctggtttaaggatggaagttaacttgtagtgagtgacagtgtattaagaattctatgtgattttaattttgacaaatatgagggaaggtggtcattcactgagtaaatattgttaatcattttgaaacaattggtgcttgttatgttttgattcagaagtaaagagtgggaatagaatctaaaaataaccaattttttaagtcacagtacggttgctgaaactggcccagaataaaaatagagcacgtactgtgctgtagctggaaccttcaacttttgacagaaggtcagcccttttttctgtgtggaagaacatagactcttgagtcaatgacttggttggctatcagcctcttgtaaggtttacttgcacggtgctaggtggctagtgactaacctctctaagcctctgtgtcatcatctgcaagatggaaataacaccatctatgttaaagggctgttgtaagctttagacaacagtgcccaataccattctagccatgtagtaggtactcaataaaatggagctgattagtattcacatttttaatcatgtcctttctaaacttcagtttccctgatactgtggttgtgagtaatgcacattaactcatttctcagcaggagctgtctctagagggaagaattttgatgaagaaagcaatgcttccatgagcactgctagagatgaaacccgagatggattctacatggaggacggagatccttcagtagctcagctccttcatgaaagaacatttgccttctcgttttggcctaaggttggcaggtttttgttgctgttgttttgctgaccaaaaaggattagggtagaggaaatctttctagcttgatttttcaagtaattttaaggtaaacttttgacacagtatatgaagactatagatttttcttatacttttaaagaatgatctgaaaaagcccaaagaaaaaaattgtagaacacttttctaataggatgggaaatgtgatgtgaaagaaagataataagaaatagaagtgtgtatatggattgatctttggctccatgtggcttttaggttacttacccccgttgtctagcataatctatggattatcactgtgttttaaaatttttttgtgaaataaagccttcagatttaagacaactttatagttttggaaacctaccagcttcttgacttggaagagggtgtactgttgacccatttgcttttgacgcattatgagataattccaaatgtagttatctgtaaccaaaagcaaaatggaaattacttttttggctaaatagtataattttataataattccctgtgtaatttaggtctgtttttcagggtgaggaaataatcatcctaatcaccataacagggctgtctggtttaaaacaacacaaaaaatgagcttcagtcagcctaccccccaggctcgtctttcccagtattattgtgtaagaaacaaggtgaaaattttgaccaaagaatgtactgtcaaagacattttgtttcctctctctatccctttagttcccctgttatgctaacctcctttattgagtgtaggagggagtttcccagatcagtcaaaggttatagtagcagacacttttaatctatggaaactcagtctaaagctgtaattagaaatttttaatgtacacgcttcaatgaaatttgaagtgataataggtagggaatgcaaattgacattcattaggtgttcctaggttggtgcccacttcataatgctgaactttattaatagtgacgctaatgatgtcctacttcctgggactgcaatccagcctgtagatctgaagggccagggcggcaagaagctaatgcagggtttccattgtcatctactgacatccaccagcagagctctatggagcttgtacaagagttactttttaaatatgaagatattttgaaggtggtgattatgtagtacatttttctgttttatgtagttcagtgttcgtaattaaaaatagcatgttttctgtgttgaagccacctaggaccttctgccagagcaatgccattataggagattttgtttatttactttcttgtttgatttcttgccttgttttcttttactttttgtcctccagttgacttttaaacattttatgctcttttgcatcttgaaggatgtatttatctagtaattttaaccagggctttgttaaaatttcttgtgacttttcttctccctccaggatagagtaatgataaaccgcttagacaacatctgtgaagcagtgttgaaaggcaaatggccagtaaataggcgccagatgtttgatttccaaggcctcatcccaggttacacacccaccacagtggacagccccttgcagaagaggagctttgctgagctctccatggtcggccaagccagcattagtgggagtgaggacatcactacgtctcctcagttgtcaaaggtgaattagaatggcttgtttctgcagcttaaaagggagctctctaagccttaactgagtttgcgagcttatatttcactggccttgcttagaaataagatagctgctgtttcctcagctctgtgcaccagtcatgaatgcttaattccttaagcttcttgttccttatttctaaaagccagcccatatagcagtactgttttggctcactgcaactctgttctgttggaatttttcaataggaagatgccctcaacctctctgtccctcgccagcggaggaggaggaggagaaaaatcgaaattgaggccgaaagagctgccaagaggcgaaatctcatggagatggttgcccagcttcgagagtctcaggtggtctcagaaaatggacaagaaaaagttgtagatttatcaaaggcctcaagagaggcaacaagctctacctcaaatttttcatctctttcttcaaagtttatcttgcctaatgtctcaac

SEQ ID NO: 7359 - DNA, 7609 bp, Homo sapiens
gcagctcggtgctgattatcacaactgtttggtgacctacttcactgacctgtgaggattccttcccttcaggtactggattcttgatctttctgcatcatcaaggtcctaattgcaatgaattacactcttgcttaaaaaaaagctttataaatgtaaaactttctcatataaacatctttttatgtaatgatcattatttctgacatctccaattgaagtacttgataacttaagcaaaattaagatgtttgatattcatgatgtcaagagatttatagtagtcatttctaaatcttcaaaactatgtaaaaaagaaagggctcattttgtatgtataagaccaaatataatcttgagcagtatactgattatttttggaataaggtaaaatttggaaagccaaattttttttcctatataataagtcaatttgagctttcagttacccaacagattgctccagcaataattggtaattttataattaacttctgttgtttgtagcgagtgactaattctgtaaagtgctgtgagagacgagataaagagtctttaaaacattattaattgaaataggattggaggaatacattatacatttgctatgtaagtttttgaaatagctttacatatgttattataaattgcattcagcaagtagttctgacttttgtaatgtgcaaatgacattcagctgtaggaactccagcttcttaagatttttgctgataatttagagcagtggctgcacagcaaaatcactcaggagctctgaaaaaaataactcgtcttccagagattttgattttgtttttctgcagtgaggaaaatgtatctgtaattttataagctcttacaggtaattctaatgactagcttaaaggattttgaatgtcactatcttgaaggattttgaatattacacaaatagggcataacttggaaatagcaatggactgtgcagtgtaccagatcggtgtccatattgtcagaaaaaaattgagactccttctaaaaatgcatttaagagccaggtgtggtggcttgagcctgtagtctcaactactcaggcggctgaggtagtaggatggcttgagctcaggagttctaggctatagtgcacagtgatcacacctgtgaataaccactgcacgccagcctgggcaacatggtgagaccttgtctcttaaaatacaatgagtttcttaccagtctaatctaactccagtgtggtgagggggtgggactagaccttgaccacagtgcccaagtagataggaaatgaatgttgattgaatatgtgagtgagtgaagagttatgcttcattcacgacagcagatgcttaatccatatcagagaagtgaaactttacttttaaaacctgccaagcaaaaagaaagcacaatagctcaccataacttgttctgtaaagccttttgtacattccaaagcactttcacattaacttttctcattcatacatttcaaattttaacaatacatatagccaggaagatcttttttaaccccagttacagaagaaaagctaaaaccacatagcagcctggcagtaatatttgatcaagttagcgtgagaaattagaaataatatttttcaaaatataacatttgggtcagttcaaattaatggtgaaaagatgagttattcagtaaatggtattggtacagttggctatccatttggaaaataaagttatgcaaaataaattccagatggatgagttaaattcagatacaacgagaatttaggggatttttaaaatgtaatcatggtatggggaaggcctagagcagaaccccaatccagaagtcataaaaggagctactgagacttacctactgtggtaggtaaagacttgcactctgatttcatgcaatttagatttatttccatttctgcttattgcaactgtatgatcttagaactaaaactatcctttaaacatccaaacagatgtttactcaaggaaatacatattacaacaatgagctatcattctttgcctcttaaattggcaaaaatttaaaagaattggaaagaggtgaaaaagagtacagtccctcatattctattggtaaagtataagtcatactctctttttttgtttttttgaagggtaaattgacagtatctattaaaagttaaaataagtatgtcctttgactcagcaatttcagtcctaaatatctgtcctagagaaataattatacatttaaaaatatgtactaggattgttactgaggcattattcaaaatagctaaaaaacacaatattctaaatgcttatcaatatggaaattgacctgttgggggtaagtggagaagggagattcttttttttgaagatctatgggtgtcggtgattttgctgtgaaaaaccactagaaatgtttttagatagtatttttcctaacaattgttagctagtgttttgtactaaggagcaattgtaaggcatagctaattttaatcaaatgtagtagtttgaatgtctttctataaacaaattttataactgcttttttttttttttacagaatggaaacagactgtaatcccatggagctaagcagtatgtcaggatttgaagaaggttcagagctgaacggttttgaaggaactgacatgaaagacatgaggctcgaagctgaagcagttgtaaatgatgttctctttgctgttaacaacatgtttgtctcgaaaagcctgcggtgtgcggatgatgtggcctatatcaatgtggaaacaaaggaaagaaacagatattgcctagaactcactgaagcagggctcaaggtaactcacttttccttttagaaaaaaaaattatttatgtctttaccactttatcaaaaagaggggtagtggggaggggaagagtgttaaaagagaactggatattcagtagcttccaaatttttttaagaaaaacttttaacctagaaatttttattaattttaaaggcttttgatcgatatggggaaacagaatttttttgaaaaacatttgatttgcagggcgtgactttgttttaatcatgacccccaaaactaatttatttctcatctatagctaaatgtgttcaccagaattatacatacattctttgcattgaatgggttttgcagtcactgtgttgaaaagattttcaacacctcttgaaaatgtcgcttctgttaaaataacatacttgacaacactgttttccaactctgagatcagaaataaatcagagcagaacattccacccccagatttccaagagtgtcccattaaccctttattatgagtatctctttattatgagagcttttctaggcggattaacctttccattctttaaaccaaaatcatgagtttagaatagtagaaaacatcacctgagagcaacttttaattaaaaaagaaaaaactataggccagacctgcgggctcttacctgtaatcccagcacttagggaggccaagctggtaggatcattttagagcagaagttcaagaccagcctgggcagcatagcaagaccgtgtttctacaatatattttttgttaattaacccaacatggcagcacttgcctgtaatccagctacctgggaggcttaggagggggcctatgagttcgaggttgcagtgagctaggattgggccactatactccagcctgggtacacagaccctgtttaaaaaaaaaaaaaaactattataaaatctttgacctactgaacaaagggatagacattagaaaatctaaaatctagttttaaccttactaatcagtgaatcttcagtcttagaaaatgtcatacatttctgtgtttctatatttattcaaagtaattgtacattatcataaggtggtgagcaaggcctgcctaagcaagtaagaatgtcacatgatatcaagtacataaacatctctttaattcgctggattcactttgctgaagatgagtcgtgtatactgtatattccttgatggagcaaattgcaaggccagcatctgtactaccctcagttccctcacagctgctgcaaagatagctgcttagctttaagcatagtacctgaattaactaatttttgtgcacttcttttcacatccttaaatttgtactaaaagctcagagtatttagaggtgaatcttaaatcagaagtagagataaatgacagaattagtaagataattctctgtcttgtgttggttaattctaagttgactgtggagaggtagaaggagttctgatcagagagtcagcagtcttaaatgtgaatttaagtgatcttgagtgagtccgtctacccctgagagagtttctgcttcttaatctataacttggagatttaaaaaaaacttaaaacgatttggggaatgattatatgactgtatgatacagaaagatctgaaccatatgtaaaacctgacatgtagtaggtgctcaaatatttgtttgtttttcagtctgattcagttaacatttattgagcaactatcctgtgtcagcaattgaaaatcaaaccatgcataagacatgatccctgtccaccaggaagatcacagtctagcagagataagaggaagaaggcaaactgaactctactccactgtagagagtgcagtaatagagcatggatctgaagaggtgtgattcattttccttaggtgtctgcctctgcttttcatttaaaaaaaaaaaaactcagcttctatttctaacacaaactttcacctcctatggcttaaatagatgtcataaaaatttaggatttatatagggaatgtacacacttaagtcagcaaaaactaaattaattttgccctatattgtgctggtgaaccatgatataccttataatcttgtcaaaaagaaaagttgtagctgtgttcacaggaaaaaaaaaaaaagaaaaacacatggcctgtcagccttttgcctaagatcaattggagtatcttttcttatcagtttaatatctgttatgtcctctatctaaggacaatatattaaatggatttttggagcagggagatagaataggctcttgctccattaacttcacacatcgacctggtattgcaaatacctccagaaatagtgtacccctaccaagaaaaaaaaaacacattaacatgttcttttatctcacagaattgagcatttattccctgtcaggtaagaaatatattaggtgaaagtggcctttcagattactaataataaagctaaacagttattaaaactaataaactattaaaccaattattaataaacaattattaaaattaacaactaattattaaaactaaattattaggaataatttttagaattgtttataaaagaagtgaaaaataatgaaaaaaatatgaactaatgatatattacctattatagtacttaatatagtggaccctcaatatatgtggaattaaatggggtaaataatagatgcatgttttagaatatgaaaatgaaataccatttttgtgtagcttttcaaattctttctctgcatttccttgagcttctaagtaaaaccttttaaatgttgaaaattctatagggagcattttagtggtgtttctgtgttatacattataagttgctgaagtattaaaggttgtatttaaaatgtgtatactctgactttgagaaatagtttcactcagttacccatgtatctggtggtctagtggctaggaaaagaaataatttatttttttgaaaggatgattactcacataaacacttggattttgctttctgtaccaacatgaaaactaatgaattcactgttgcatttctcttgtaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattacttaactagtattaaatgaaaaacagggactgaaatagttctgtattccgtgtttgcaacagccagccaactaagcagaggataaaccgttagcaaatgaatgtaataattactcatttccaagatatctaagcacataagcaaatacaggaacagacttcattctttttcttaacaaaaaagcatcttcagtgtgtgatttaaaagaaagaagattctggtttcctagaaaacaatattttggcctgtgttgattcttattctgaatgtgtgtttacataatgtacagtatatattcagaaagtatttttgcttcaacgtttactttctatgatgtagtgctttggtattcctacagcaccccaccttccccaacagatgtacagtgttctgtctccattcgaaatctacaatgtaatatgagtgcattgtatgggtttgaaaccaaaggatgaatgaagcattcagagacttaatatttgaaaaaggaatagtcagtattttatattttattacaggtactgatatttataaatttaataaactgtaccatgctgctgcatgttttcaagtacatgttgaacagtaaggattggggagttgttttttaatggtcacctaaagcagctgctatagaaatgttgaactaaaattttgcatctggtcataccttcatgcatttatcatttgcagatatttttccatcattattaaaaaacaggaacttttaggctctgaagatcatgtggaccagagcaaattaaagttcagtttgtgtcacaattcattgccagacttcattggaatgctttgtttgatgatgtatgttcattctcagctttattttcagatgcttaactgggcaacgaagtctaacttcaggttgaactttctcatgtttaatctcaggctaaatgtaaatgatatttgtaaagtttgaataaaattctgtttactcattttgagttagtatgaaaaaaagtgattgtatgtttaagaattgaaattgttcattttgtgataaatgattaattccaaga

SEQ ID NO: 7360 - DNA, 7609 bp, Homo sapiens; identical to SEQ ID NO: 7359

SEQ ID NO: 7361 - DNA, 3948 bp, Homo sapiens
ccagacccagggctacctgcggagtccacaggaccccctgcgccgggcagccgccgtgcttataggtgaggccgcccggggtcacactgcccctggcaccggggctttgggagctgggccagcctccccctggggggctgtggggcctgcactcatgcatctgctgtggtccaggcttccttgtccaccacgccagccccggctgtgtcaaccaggacctgctggactccctgttccagggtgaggccccaccttgccaggggatggtgtcctggagacgtggctggtgctagggcggagtggacgggagcggtgggtggagggccaggggcccggcactcggcctcctgggctccccagcctgagccgcgatctcctcgcagacctagggcgactgcagagcgaccccaagccggctgtggcgccggcagcgcacgtgtccgctcagcaggtggcgatgctggcccgtgcccggggctgcccccgcggccccgccttctccgcatcgccccgcgccccgcccggcccccaccagtcttcgccgacagccccttccagcgccggagcgtcgcgggccgctggggctgctccggaccccgccgagcctgaggctcgggctggggccgagggccagggtccgactcgggcaccccacgcgcatagcagcctgtccccgccctgacggaggggctccctgggcctggtgctggacgccaatgccctcccccaccccccacccccgtgacccctcttcaggcacccaccaccctgatggtgacagagggggacagccagcacccatctgtccccgtcagggctcttgttctcacagccccctggagcatgccccatgccccaaccttgggcctggctcctggcccagatggcacctggcctcttgagtctgctgggggaccccaaagttggtggtcccatagcctgccctcctgggtctccacctcatgcctggacaggacgctgtggcctgtccgggccttggccagccctgcagctgcacccccgatcctcatccctcaccccattccctgccagcatcctaaggctcctggcgggcatcctctctgctcaaaattattgacctgtctcccggccacacctgctgtgccctctcagccaggccatcatcaccccctgttcattatgtcaggcctcatgggagcctggccttctccagaagctggccccggcgtcctcccaagctggaccacgtaggccccagatcacacctgggggtccagatgtaggggtcctgtgtgcacgcccaatcagaccgagcacttgtgacactaccccaacacctctcccagggctgaatgaggaacgcgccactggacacatgaggaagaggctgctctgggagctactgatgctgtgacctcacctctctggctttgggcggcaggtccctgcacctaggatgcctgcctggaaatgtccttgcattcgtggcctccttcacagcctcctcctcagagaagcctctgcgagtgcacagggagtgtgtgcagccttgtgaagggctgggaccacttgcccagactggggcccctcaggcacaggcgtggggtcctactgacctgtctccccagctcccacacagaaagcatctaaaataaacacacgtggatggaaagcgttgggcatctgttttgagtgtggttatgggagctgaccctggtccaagatctggctcaggctggggtaataggccatagtccctgatatggccccaggtagagtcagtttggcagcagggttaaaggtcaggcaggctccaggcacaggctatggccaggtcaggttgggttaaccctaagacagagaagctgcgctctggtctaacaggcatggaatggatggggttagagctgtcagcaccggggtgagtgtctctttgcaggtcatatgcaggaagctgaggatcaggtgaagggcccgggtcttcgtggagtcaggggcaaggtttggtggatgagtttggagcctccacagcagataccaaaacgggattcaacataccagaaacagatagagagaaagaggccagagaggcagaggccaccagatgcccagtgaaggtcagatagacggaagccccatggacgtccgtgctagccttcaggaagctctcaaaccagccatctgtccgaggtccgcacctcccaggacgggctaggagcacccatggggggcacaccctcggcactggcggggacgggtttcgggacacagccacatggatcgtctcagtagcagccccaaagagggaagcaagcccggcctccttgctcaccttgcaaccaggagccaggccccagggcaagcatgtgctgcccacctagcacaggcttgcccacaccccacagcacgctggacagtctggtgggcaaacccaacagtgatgccacgctcaccccagatgggggctgaggcggggagctggctgtggtgggcaggcagcacccctgcgctcctccccctccctcatggtgcccgggagagtccgcgccgtcctgcggcaggctgtgtgcagcgcaggcgggcttgccccatacagctccctgttaggagtgtgtccagccccgccttgctctgcactgcccagaacctggttgccctgccaggagtgagattcatgcaaagtccacatggcctctagagtgtgactcttccctgctggaattcctgggaggctccaggtggcacagtgggctggtccctccatggggatgctgtgtccccagggtccatcagatccacctgcagagagcccaccccagggcaaatattccaacggggtctaagattggagggcaagagggcaggtgcaccctgacactcattccctttccacctccagccagtgggccgggacagtcttggcctggatgcccaaacaatctctaacgggccatgttgccagagagctcattggtggtgcagctctcaagatggggctcaggtgtggcctgtcacatggcatggcctgccggtctcagggccccgaggctgtgccttgtgtgcctgcctttccaaatgctttctaggacccgggctactcccaccccactcaccctttcaggtcacccgaaagggttttccaaggaggaccatgagtctgagaggcgttgagtttgttcctacactgtgggtaggagtgtctaggagattctgtaacttggatctgagatactggagtttgttttgtctcctgtttcaatgttaatgtcactattcatagcaataccccatctctacaaaaaatgaaaaaattagccaggactggtggtatgtgcctatcgtccagctactcagcaggctgaggcgggagaattccttgagctcaggagatcgaggctgctgtgaaccatgattgtcccactacacagcctgggtgacattgcaggaccctgtctctttaaaaaaaaaaaaaaaaaaaaaggccaggcgcggtggctcacgcctgtaaacccagcactttgggaggcggaggcaggtggatcacgaggtcaggagaccgagaccatcctggctgacacggtgaaacccctgcagtgagccgagatggcgccactgcactccagcctgggcgacagagcgagactccatctcaaaaaaaaaaaaaaagtctgctgggtgcggtggctcacacctgtaatcccagcacttcgggaggccaaggtgggtggatcacaaggtcaagagatcgagaccatcctggccaacatggagaaaccccgtctccagtaaaaatgcaaaaattagctgggtgtggtggtgtgctcctgtagcctcagccactcgggaggctgaggcaggagaattgtgggaggtggaggttgcagtgagccgagatcacgctactgcactccagcctggcgacagagagactccgtctcaaaaaaaaaaaaaaaaaaaaaaaaaaaa

SEQ ID NO: 7362 - DNA, 331 bp, Homo sapiens
cccaaccaggtccagctccaggccctgttccctgtccccagatcacaccgagtcagcagccttccctagacccgccgcttcctcgctccgcgctggccgccccctcccacccttgcagcccctctctgtctccgcctgccctgactgcgccctcccacgcagacacgggactcaatccgcgcctcggccgtcgggctccttgggactctggtgcgccggggccggggcgggctccggcctggggctccgcggccccctgcggaagctggtgctgcagagtctcgtgccgctgctgctgcgcctgcatgaccccagcagggacgctgctgag

SEQ ID NO: 7363 - DNA, 835 bp, Homo sapiens
tttccttcgtatgccacctttattgtgtttccccaactcctgggccccatggtagactggccacatggctactgggctcctggccttcctagggctagcagctggtgggcaaacactctgccctgctggagagctgccaggccatgcccgggcacaggctagtggggctcctggctcagtcctgatagcagtgccagggaggcgtagagtgcacacatgcggccctgggcctgcggctcccagcacacgtggggagtgtcctcccccagctctaggccacactcgtccagcaagacccaggccggtgctccttcgccccagctgttccccaggagcccggggggcagggacatggtgctgcgctcctgccacggggcactctgctccaagaggctgcccacctgccaagacagggcaggagtgagtcagatggggaaatctgggcatcttgtgcctgcccataccaccccttcccaggtgccacagggccccttccactggctcagcccatcctcctgcagcccgaacccaaccctctcaccagctcgagcggccccaacagggtctgcgactccagcgcctccgccagcagcttgtgctgcgtttcactcagcactgggagagagtcaggtaaaagggggtttctgaacgcccaccgggaaagcccacctccctccctcccacccgccacctgcccccagcggccgctcactggtcagtgcccccagcaggtagacaacagggatagcgagttccggcaccagcattccggagacaacaccaggcactccaggacagcacctgctggaccgtccaggggctccaccggcccaag

SEQ ID NO: 7364 - DNA, 2446 bp, Homo sapiens
ttccagctggcatcccgctgctcagcaacagccccaccccgctggagagcaggctgggttacatgtctgccaggtgagcctccctgggggctggttggggtggaacgtcatagtcgagctgctcactgtgcctccctgggcaggtggacctctgaggggagcagacctcctggtcttaccccaagaaatcaggcaggcctctagtccacagagctgtccccgcttgcctgggtctgaggcgcccctccatgaccaggggaaagtcaagttcacaccgccaaggtcccagtggggaagggctgggcttaccctgccaaccccctgaggaagctgccctctggcccctgtggggaggagtcagcccctggtgggaccctgcccccgcccctccctctagcccctccagccccggagtctggcctttgtctttgcccttgagctcttgtttgcttcctgtggctcccttattcccccagtcctgctgagcaacatctggagtgagagggacaccctgtggaggagacagacgggcaattatttaaacctgttattaattttccattcatctcattccttgccaaatgttttcccctctccctcccttaggcagctaacagtgagtaccccccactaaccctttggccaacttgagagctgatgctggccaaggattgagttgacagaggggagcgctttgctgatgagattggcgggagcaggcggatgtgggagcccagagccttgtatcagtagcacccagcaagggggcagagggcctccaccactttcccgtttgggaactgttctggaggggcagatgttttgaagctttgaattgctagggacctcggagaagctgctctggtagctgagagaaagagggaggaggtgacagatgtgatggcctctgtgcatcctctgtcacttccgcgcctcctctctcccctcgccatgctctcctcttccttcccagtgagcagctccggctcctacagcactcccattcgcaagtccctgaggcgggcagcaccacctttcagggcataattgaggccaaccggaggtggctggaacgtgtcaagaatgaccccaggttgtatccttttacctggttcccaaactgggctgggctgtggggactgtgcttgtgccctgaggggctgaggaggatcctgttcagcctttgaccctttcatggcccctgcctggctatgcccagcgactgcagttttccttcaccttgtggccagacctctcttctcgtcaacacccaagccaaaagctactttgagcctcctgcagctgggccttgatgagcacaacagagtgaaggtgtatcgcttctgaggccctgagcaggggcttggggcagcccagcctctcctccacccagaccaagtgcctgaggagctgcctgccttcttccatctgagaaagcaccctccttccccctttgacttgcaggagccaccagggaccagggggttgagtggaacagtaaagccacacattctgtgactatataacctatctcaggctaaaatgtgtggactcgtacgagctcttgtcattgacatggcaagctgatggcgtgcggtggctgcggggtatcagggccgggagccctttgggaggaagggaggcgttagaggagctgccttcggaggctcagggagtccctttggagctggttgtttccttggccctgcagcgcactgctcggggctcccaaggaggttgtgtgtatggttcttaattcatcaggacaaagacccccagcatgtgtgtaccctgggacccgatttctctgggcccacatctatctccaatacctcagcctcagatcagaccctttcttttttgtctttcttctcttaatttttaaatgcctcttttcttgagcattccatctctctttttgaccctctcaggactgggcttagctgtccagagccctgccggagggtgctgggggctgtccctctgcaggcactgtgttttcctcaggggctgtcctcagaacacccctcctgctccctggggctcctcagggagccatttcagctggagtctcaggtctcaaaaacaacttctccaggaggccaaaaaaagactgggttggcttctggtcctcatgatggcttttatcctcctgggacactttgggtatattcatgggcattgtttccatctgtcttttctacctgtgccacccctggccctgattccacggctgcctcaggcaggcaggcaaggagctaggccggtgcccggccctggcagcaaggggtctttgtgcagttggagatgctgccgttgtggcagagcgtcctgcagccccgcttccatcagcaggctctggggtgggggctttgcaggggatgctctctgatgtttgttccgttgtttaaataaaatgcacttatttttgtttttttttttgcaa

SEQ ID NO: 7365 - DNA, 3502 bp, Homo sapiens
cccagctccctccccgggaccctaagagcacccccacccccacctactatggctccctggccaggttctcagccttatcatctgctacacccacgtccacccaatgggcctgggattcagggcaggggcccaggctcccctcctctgtggctcaaacggtggacgacttcctgttggagaagtggcgcaagtattttccatgtaagccccactctgggcggagccttcccacctgcctcctcctcctcctcttccttccttttcttctaccctctttctcctgctccttttctcctcttcctcttttgcatccctttgccacacctctcctcccccaacgttaccatagtccattggtccattgactctacctgtgggtccctggggaaggagacattgcaggtggccctgcagccaggagttctatgggttgggacggtttagatggagcctggctgactggggcctttattgtggattctggagctcagtagaacctaaaaggtcattgtcgtcattatcttaatagctaccatcttgtgcaatacatgatgggccaagcagtttatatatattttttcatttagttcttaattctctgaggtagtaattatttatccccattttacagatgaggaaactgagtttcagagagtttaagtagtatgctccagggtacccagtgagtgagtaacaaactcagttgtgaccccatgtctctgtgactccaggattctgcttggaacctcttggctgtgtggctaattcttgcttctgagccaggtggcctccccaggtctcagccctgctgaggattatgaaaagccataaaacaaggcatttgaggggaaacaaaatatcttctttttgccctaacccaaattgaaaagtagattaagttttaaaaataaaataaataggaccattcctgtctctcacctgtctctggcctccagccactgaagcttttccttttattgtttattctggggaggcaagaggtgctggtgggcagggtggtgaccactgcccatttctgagtcctgtccccatgctcttccagctggcatcccgctgctcagcaacagccccaccccgctggagagcaggctgggttacatgtctgccaggtgagcctccctgggggctggttggggtggaacgtcatagtcgagctgctcactgtgcctccctgggcaggtggacctctgaggggagcagacctcctggtcttaccccaagaaatcaggcaggcctctagtccacagagctgtccccgcttgcctgggtctgaggcgcccctccatgaccaggggaaagtcaagttcacaccgccaaggtcccagtggggaagggctgggcttaccctgccaaccccctgaggaagctgccctctggcccctgtggggaggagtcagcccctggtgggaccctgcccccgcccctccctctagcccctccagccccggagtctggcctttgtctttgcccttgagctcttgtttgcttcctgtggctcccttattcccccagtcctgctgagcaacatctggagtgagagggacaccctgtggaggagacagacgggcaattatttaaacctgttattaattttccattcatctcattccttgccaaatgttttcccctctccctcccttaggcagctaacagtgagtaccccccactaaccctttggccaacttgagagctgatgctggccaaggattgagttgacagaggggagcgctttgctgatgagattggcgggagcaggcggatgtgggagcccagagccttgtatcagtagcacccagcaagggggcagagggcctccaccactttcccgtttgggaactgttctggaggggcagatgttttgaagctttgaattgctagggacctcggagaagctgctctggtagctgagagaaagagggaggaggtgacagatgtgatggcctctgtgcatcctctgtcacttccgcgcctcctctctcccctcgccatgctctcctcttccttcccagtgagcagctccggctcctacagcactcccattcgcaagtccctgaggcgggcagcaccacctttcagggcataattgaggccaaccggaggtggctggaacgtgtcaagaatgaccccaggttgtatccttttacctggttcccaaactgggctgggctgtggggactgtgcttgtgccctgaggggctgaggaggatcctgttcagcctttgaccctttcatggcccctgcctggctatgcccagcgactgcagttttccttcaccttgtggccagacctctcttctcttcaacacccaagccaaaagctactttgagcctcctgcagctgggccttgatgagcacaacagagtgaaggtgtatcgcttctgaggccctgagcaggggcttggggcagcccagcctctcctccacccagaccaagtgcctgaggagctgcctgccttcttccatctgagaaagcaccgtccttccccctttgacttgcaggagccaccagggaccagggggttgagtggaacagtaaagccacacattctgtgactatataacctatctcaggctaaaatgtgtggactcgtacgagctcttgtcattgacatggcaagctgatggcgtgcggtggctgcggggtatcagggccgggagccctttgggaggaagggaggcgttagaggagctgccttcggaggctcagggagtccctttggagctggttgtttccttggccctgcagcgcactgctcggggctcccaaggaggttgtgtgtatggttcttaattcatcaggacaaagacccccagcatgtgtgtaccctgggacccgatttctctgggcccacatctatctccaatacctcagcctcagatcagaccctttcttttttgtctttcttctcttaatttttaaatgcctcttttcttgagcattccatctctctttttgaccctctcaggattgggcttagctgtccagagccctgccggagggtgctgggggctgtccctctgcaggcactgtgttttcctcaggggctgtcctcagaacacccctcctgctccctggggctcctcagggagccatttcagctggagtctcaggtctcaaaaacagcttctccgggaggccaaaaaaagactgggttggcttctggtcctcatgacggcttttatcctcctgggacactttgggtatattcatgggcattgtttccatctgtcttttctacctgtgccacccctgccctgattccacggctgcctcaggcaggcaggcaaggagctaggccggtgcccggccctggcagcaaggggtctttgtgcagttggagatgctgccgttgtggcagagcgtcctgcagccccgcttccatcagcaggctctggggtgggggctttgcaggggatgctctctgatgtttgttccgttgtttaaataaaatgcacttatttttgtttttttttttgcaa

SEQ ID NO: 7366 - DNA, 1798 bp, Homo sapiens
gcggaaaggccacaacctgctgaagaagaaagaggagaagctgaatcagttggagtcctctctttgggaagaggtgcagccccatgtccacatagtccagtgggccctggccttcctcttctgttcttgggattgggttgagttctttggtcctgcatccgggggagttgggcctctagggcccaggattgggcagtaggcttgtctactggctgatgaaggtggcagtggcttcaattctgagtttgttgaagacacctgtgggtttggatacctgtgctgaatggtccggaatatacctggaacctcttgctaaaggtgcctgagaagagggccaagcctttaccctgccctggtccctaaggacaggtgtgaccagggtgtcaggaatggacacacatgatagattttcctacctgccttgggaccttgtggactttctcctagatgtctgaggcttaggtgtagcgggggaggcttaggtggagtaacactgcagggagagcttactgggaagggtggtgggggtctgtgtggacctgatggcactgttgtctctgtctcaggcatttgggacatatgctgagccttgcctccctcccaccctgctgtgaggcagcctgtgtgatttgcttcgcccagggtacctggtggaactctgggccccagaggagtctactcaccaagtcctcagttcccacacatcacaagggcgacagcctacataccaccttgaatttgtagcaacaaaattgctaggagaacaaatggagatggccatatttcatggatttgcgtaagaaaaccagcttaaagacaaaacataaagaagaacctagctcagtgtcccagccacttcctaggaaggaaaaaggaagggtagaaagcacgtgggagaggtgggtcataactgctgactttaccccacaggcctcagatgagggcactctgggaggatcccccaccaagaaggcagtaaccttcgacctcagtgacatggacagcctgagcagtgaaagttctgaatctttttccccgcctcaccgtgagtggtggcggcagcagaggagtgagtgggggagatgcggggtgaggaccatggtatccatggaatgggaggaacttggggaatagaagaagagctctcttccctcagccctgcagagggaggcctctgtgagccggtgtctggactaggtgctcggtcagtgctgggaaggaatcacaccatctaggtttgccagcacgtggggctgaaaggtcagggaagccctctgaatgctgcagagcactctacggtgtgaccactggccttgctggcctcttctcttccagggcctccttgaggaggcttttctctctcagctgccctggcctgtatgtgacagaagggccctctccccttccttctctctggggtcctgggcccttcacccagcaccttgccctggaaacctgtttctcatggccagcttctcacttgcactgtctggaacacagaagccctgccatccctgaccccctcataaggttgaggggctgttgtctggagaagcagggaggggtggccagtagggtcctccatgacagctgtgtctgggaatggtccagggtcctgagcttgagtcccttcccaccatccacctcttttctttcagtcgactcaaccccgagtctcacctcccgcaagatccacgggcttagccactccctccggcagatcagcagccagctgagcagtgtcctcagcatcctggacagcctcaaccctcagtcgccgccgccgctcctcgcctcc

SEQ ID NO: 7367 - DNA, 1329 bp, Homo sapiens
ttttttttttttaaaggatattcttagtagactatatgttcacatgactcgatattcaaatggtgcaaaagtcactccatgagttatctagtgctccccattgaaggtaaaaaatactaccagttctttctggagattttatgcaaataaaaagaagggacacttatgattctcttccctattactggtggagtatgggtcactcctaatgtaggatgggatgattgccccaagctctgtcgtgagtggttgattgacggttttcttaagggaacaatgctgggaaagatgataggcgcccgccactgacccctcccgcctccctgcccctccagtaaactcccacacaaaatagcagtatgaggtgtggggaaataatcttggcctccgtcctgggtttacttttgactctgccacctacaagctgtcacctgaacaagtcctttccgttcctgtgtcttccctggtcacaagctctaagcctgaacccacactctgggaatgaagcagggtagcggcctctgcttcagcaactctgaggggtctaccttgggtggggagttggcctcatccagagggctgctggagggccaagacaaggctctggtggggaggtgtgctgagaggggattgcttatcccaccaccagcttttctgggggaggtggggaagtgatggttaaaaaatggagttcctgctatcagccatgtcctgatgaattggaaagtccccttctttctcctttcctcttgcatctcctgcctgcttcccctgcctgccctcctgtgacatgtgccctctccagcaggtatgtcacacagcaccccaagggaagggcagtgtaacgctcttttccatgatggactaccacagccagaggaagacaggccttcccttcttttctagttctttttggtttgaaaacaaggcactcttattttccccttccaagaagctggtggttcacacgggccagcacacgcattatcaaagacctagtttgtttctagtaaatgagtccattgaagtgggagccttggccgggcaaggtggctcacacctgtaatcccagcactttgggaggccgagatgggtggattgagatcgagaccatcctggtcaacatggtgaaaccctgtctctactaaaaatacaaaaattagctgggcgtggtgacacacacctgtagtcccagctactcaggaggctgaggcaggagaatcgcttgaacctgggaggcggaggcaacagtgagccgagattgcgccactgcactccagcctgggcgacagagtgagactgtctctccaaaaaaaaaaaaaaaaaaaa

SEQ ID NO: 7368 - DNA, 1799 bp, Homo sapiens
gcggaaaggccacaacctgctgaagaagaaagaggagaagctgaatcagttggagtcctctctttgggaagaggtgcagccccatgtccacatagtccagtgggccctggccttcctcttctgttcttgggattgggttgagttctttggtcctgcatccgggggagttgggcctctagggcccaggattgggcagtaggcttgtctactggctgatgaaggtggcagtggcttcaattctgagtttgttgaagacacctgtgggtttggatacctgtgctgaatggtccggaaatatacctggaacctcttgctaaaggtgcctgagaagagggccaagcctttaccctgccctggtccctaaggacaggtgtgaccagggtgtcaggaatggacacacatgatagattttcctacctgccttgggaccttgtggactttctcctagatgtctgaggcttaggtgtagcgggggaggcttaggtggagtaacactgcagggagagcttactgggaagggtggtgggggtctgtgtggacctgatggcactgttgtctctgtctcaggcatttgggacatatgctgagccttgcctccctcccaccctgctgtgaggcagcctgtgtgatttgcttcgcccagggtacctggtggaactctgggccccagaggagtctactcaccaagtcctcagttcccacacatcacaagggcgacagcctacataccaccttgaatttgtagcaacaaaattgctaggagaacaaatggagatggccatatttcatggatttgcgtaagaaaaccagcttaaagacaaaacataaagaagaacctagctcagtgtcccagccacttcctaggaaggaaaaaggaagggtagaaagcacgtgggagaggtgggtcataactgctgactttaccccacaggcctcagatgagggcactctgggaggatcccccaccaagaaggcagtaaccttcgacctcagtgacatggacagcctgagcagtgaaagttctgaatctttttccccgcctcaccgtgagtggtggcggcagcagaggagtgagtgggggagatgcggggtgaggaccatggtatccatggaatgggaggaacttggggaatagaagaagagctctcttccctcagccctgcagagggaggcctctgtgagccggtgtctggactaggtgctcggtcagtgctgggaaggaatcacaccatctaggtttgccagcacgtggggctgaaaggtcagggaagccctctgaatgctgcagagcactctacggtgtgaccactggccttgctggcctcttctcttccagggcctccttgaggaggcttttctctctcagctgccctggcctgtatgtgacagaagggccctctccccttccttctctctggggtcctgggcccttcacccagcaccttgccctggaaacctgtttctcatggccagcttctcacttgcactgtctggaacacagaagccctgccatccctgaccccctcataaggttgaggggctgttgtctggagaagcagggaggggtggccagtagggtcctccatgacagctgtgtctgggaatggtccagggtcctgagcttgagtcccttcccaccatccacctcttttctttcagtcgactcaaccccgagtctcacctcccgcaagatccacgggcttagccactccctccggcagatcagcagccagctgagcagtgtcctcagcatcctggacagcctcaaccctcagtcgccgccgccgctcctcgcctcc

SEQ ID NO: 7369 - DNA, 1865 bp, Homo sapiens
ttgtcttacaggtacaccaggggttggaaaaaccacactaggcaaagaacttgcgtcaaaatcaggactgaaatacattaatgtgggtgatttagctcgagaaggtaagggacactttggtgttagatttgttttgttttttttttaaggtctggtaagtggagtgttagtgctgggtattgtcatagggtacaaaaaacagagattgccattaaagaatatatactctgttagggaatccacagaaatattaagtgtctaatgctatgtcctggttattttgaccattttcccttccgccttcaaaatggctggcaattcttgtgaatagttgggaaggctcctataaagagactggatttcggataggtagaatgtgaataaggagaatgtttttaagttgaacaaacaaaggtttggtactgctaaacatatatatgagcacagtgagtatattggtctcactggaaagagactgttttgagctcaggtgtgggacctgactatgctatggtatcttagattagtgtgagatttgcatgcaactgcatatattctaagatgatcattgtttttatttattttaccctgttttcccctaatctttcatcgctcccttatttgtgtcttcatctttttatagtcgacaatgatttgtacatggtaggaactcaataaattaaagcgaccttaagttgcctcattaaaattaagaaaacatatggtttaaattttaaaaatttttttacagtttaacatagatttaaaatttttttaagttcctgacagttgctactaaagtaactatttcagattgatctaatgtacatatttttttcaaatgatctaaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcgat

SEQ ID NO: 7370 - DNA, 244 bp, Homo sapiens
tttttttttttcttttgagacggagtctccctctgtcgcccagactggagtgcagtggtgtaatctcggctcactgcaagctctgcctcccaggttcacgccattgtcctgcctcagcctcccaagtagctgggactacaggcacctgccaccacgcccagctaattttctgtatttttagtagagacggggtttcaccgtgttaaccaggttggtctcgatctcctgacctcgtgatccaccc

SEQ ID NO: 7371 - DNA, 35764 bp, Homo sapiens
gccaagctgaaagttctactctttctagtggaatatcaataggtgagaaatacttctctgagagggttgcaatttaactttaaataaaaatgttaataaaacttggctggaaaaaaaccccacccacacacagagaaaatttggttaaaaaaacaaagtagcagttaaatatgggatgaagttaataatttgtgatggttttaaaagtgcttgctgtttttaactccagaaggggaagcatttgaagaaggtggaaaaagaacatatgggctggttgaattagttaactgcatgtgatttggatatggggaggaggaagagtgtggagtcaagaatgacttccggttatttgggttaaacaagtataatagttagatgatgatgctattaccaaggtagagaagacagagtaataatctgtgggcagtgaagcgtttgtgaatttggggaatcaggtgtgttttggacatgtttagtccctatggagatgtcaggtaggttgttgaatatgtgaatctggagctcggggataaggtcagatctgaagatatacgagaggtagcatatttataagccatgattggttgagggtacctaaagagagagtgtacataaataaaaaaacattctcacatttagaagtctgattattttttaaaagaaggatgagtcatcaaaggaaactaaaaaggagagatcagtgaagtaaggggaaaaaaacaaaagcccagtagatgaagtatctcaaggaggaggaaagtactgaatgtgtgaatatcaaatgcagaacaagagagctaagatgagaatggggaattgactgggggatttggcaagataaaagtcattggtgaccttgataagagttgcttcatggaagtgtcagggcatggcctggattggagtagatttgaaaatgagaggtgaggaaacagagatagctactgtgaaggagagcagaaaatagagaccatattagaaagggatgtgagattaagagagggatttgtttgtttttacttcctaaacttttaatttttgagtcttctagatgagcattatttcttgttacaattagaaattattcatatagcctgggcagtgtggctcacacctgtaatcccagcactttgggaggcccagatgggcagatctcttgaggtcaggagttcaaaatgagcctggccaacatggcaaaaccccatctctactaaaaatacaaaaagtagcagggcgtggtggtgcatgcctgtaatcccagctacttaggaggctgaggcataggaatcatttgaacccaggaaacagaggttgcagcgagccatgttcgcagcactgcactaccctgcctggatcacagagcgagattctgtctcaaaaaaagaaagaaattgttcatataatagctacttttatttttaaaaagaaataaaggaggaatatgtcttcatctatgattaactaccagattgttcaaggactaagcctattgttactaatatcttaatattggtaaacagccagtagaaggagatgcaaaaggagattgattttctggaacatactgactttcttagcccttgagagttaaaattaaattatttcagagctctccattaccattcagtagttgtttattctgatagtcccctttttatataaaaatacaagtgattaaatgataaaatgttttaaaaagaaggcaagtttgtcacctgaaatacctcttatcaatgttctaagttgcctatatgcaaatactaatctcagtatgaagaataattttgcaaaagaaagaactttttttcagtcaaaaattttctacacgtccatggaatttggcatgccacttaaagcaaaaagtttttaaaattacagctctcaagtatataatattttactctttctcataagtgttataatgagaattattctgtagtttatagcttttacttttcatggatgtccttttggctaccaaaagattattgtttagttattttattgagttacagttagtgtctcagtgtggagacttttctcttttagagcagatttttgcatttgtgtttattttttaattattctaaggctaagtaagtaaacagtaaaagatcattgcatcctagtttgtaaactaagaacattacacataggcatttaccttcgaggatttttgttttaaagctttaacaatatgaaaaaaagaataagtctattaccataagatgataggtgttaatatacacacacgagtttttccctcagctttaacttttacatgcaatattaatctacagtgaaggctttgaaaatactgtgggaaaattaaccagtgcttagaacaatggccttaaacattttctaatgtggtatctatcctagataatcttgagtagtctcacctagctaactaagagaagcatattcactctgagcttcatgcttacattttctacaaataagttatcctaattatgcttaaattttcagtctttaccacatagtgccacaaatcaaaggataatgtagataatgtacaagaccccaccaccaccacgggttacctctggttcttctgaaccatacaatacagaaaattatttcagtgattgttatctcagtttatccaaggatggtacataactagtgccattgcaaacccgtagaagggtattaatccatcgtctctaagagagacgagtctaatggataccttacagcatccattacaggtgtctgatggataccttacagcattagaatttgagtctctcagaaccctgcccgtaaaaaagagtttgagtctctcttcttagaaccctgtctgatagacaatttaacttgacctattaatcatcctaatttttttgagagccagaattacctttaaagtaacatttaagtaaactaagctgttttggactctctaaattcattccccatagtttttttgttggttttttttccccctagctaattgtaaacgttctgtttgaagaccattttattttaactgatcttttggccaaagagaaaattgttgcatttttatagcaccggtttttggttttttaaatttagagattccatcttctttgtctctagagacaaataagtggatttcattaggctttttatacttagggtagtaatggactttaatacaaagagaaaggagtatgccatgaatcgtcaaggattttataattatattggtcctaaattatgacaaacctaataagaaattttgtgttattttatgttctctaatggtaggaaaaattgtttattgacataatgaatttcagctacaaataggcaagcaaaaatgttttatgctattttgttattttaggttgtcgtgtcaactgtattccaatatattgcaaaataaacctaacagcagtaatattagaataaagaattaatatgtggatatgttcatctacaatgcgattgtcattttatgagcatagttaattaatttatttttacattgtgaaatgcaaactagagaggtaattctgatgtttaaaaaataggataacttttcattttaggtagcagcgatggttctgaactaagtgaagagacctcatggcctgcttttgaaaggtaagataaattgtccatttgaactacttggagtttattttgtctgggttaaataatataatacaaattttcagagataatatttactacatatccctaagcgattaagttttctactggtaaaagaaattagaagttgatatttaagtttggatatgtaagtaatgagaatgaatgatagtcttatctctaaatgtttatttggtggcatgacacatgtatttgaattttaatacatttacatttataacttaaaaataataaccgatcatcgacaagtaacctacttacatattcaaaaaattatttccttaagttctggttcatttaagtaattttaaggcatttagtggaatggtcaactttattctctgctgctttgtcaaggacaaaatgatttaataaattttaaattatacaagtaaagcaagttaaggttagaatttaaatggtcataaactcaaaattttcagagtacacttttatactgaaatactctaagttgtgctcccttctccttcctttgttgctttaagctgttaaatctgtcatctgcctgtagcaaatatcatactatattgaggtctaagtacatataagatctgaagaatgtgaccaaacaatgcaaataattatttattaaatgtccattaggattcttatgttttcactgaccatttcagttctgccatttcagactcataaggtatttggcttttgaccaaaacaattgctcccttttttgtatatgaactaagtaactaaatttctgaaaatgcctatattcattactcaagcgggtcatttagattgaatgttaaatgtcatattaatactgaagttgaaaatgtgtaattgcataactccttatcagtcacaatttataaaacaattttaaattaaattttatttgaaatcataaatttcatgctgtttaattggaaaaatagatccttattttttatgtgacttcataaagatttctcactattatgtgattaagattttgtttataagttctacattgcaaagtacttttgatcctttctactctaattatcagtgttcccaacttttgttctctttgttttgcgggataataataagtaaaaacaaattatttttatttatttttgcattatttttcttgcaacctttacttctgatctgttcatttgggtttgcctgaaatgtgaaaaacacaagaattgcctttgacatgttgtctgaatttgttcaaattgtctttccctctagaaagaacgtaaaaccatgagaagttgattatagagtgtactgtaatctttatatttaaaaaatattgattaaccaaattgttttttagattgcttgacttatgactaaccagaatggtggtgtgttaaataatctgttctcatcccagcaggttacttatgaagacagtatttaatgatgttaccttcacgtctcaaaacaatttttttgctttataacaggtgttttgctttgcagacatgtgtggctaaaaaaagctacttttcttatgccaagtttaaaatagtgggctcttagaacattttgagaacagtgaaatgaatgctgcccagcaagattcagacatgaaataatagaaagtgaataaagaactaggatataaagtactactcatggatagtgaacttgaaaaatgtactctgaatgttgacataccattttctgttcttattttctagacagacatcaaatacattgtcttattttctagacagaaatcaaatacattgttgtctttttttctagacagacatcaaatacattgtttaagttgctaaaataatgcttttcctttaaaacatcatttatcaacagtgctttcgggttttcctaggcaaagaagtatcagtatttttatgtgtctgtttttattttttttgtttttaactattatgtgccattttggataagtattaactcatcatttttatcatttattggctttgtcagttaatgtagaaataatataacgcctatattactcagttcatttcttttatttactataaaggataaagaggaaaataaagttttcctcatgagtttacaagccacattgcttttaggtgtcttcatagggacatataataaaaatgaattacttatataaatccgggcatcatatttaaactagaatccaagaagtggtatagaaacgtaagaatttttgaagtatttttgaggttttttttttattatttggctataaatagctctttaattcttttagcagatttgtgaaagtgaatgtatatgtaaatatatggtgtgtactaaatacctctaagtatttctagagtcaatagtagaagaaaaaattttttgaaatctatgctgcatgctttaaaaaagaaagaggaacaatcacatactatccttttgtaagatttagaaagctatattacaagaagaaactattatactgttctaggtattgataatgactgtgtgaataaaagtatatgtaatatatacaatttataatggaatccaacaggaacagattataccattctctcggcccggtgacaagagtggcacgaaatggctatcgaagtcacatgaaggccagcaggtacaattcccctgcattcaggggtcacagaactcccttatggtgttggtgattggcttacatgggtgtggtctgacgttatttcttttctttctcaactaattgatttaaaaactaaacaaattacctagaaaaactttctttccaagatctaatatgaagataaatttcaactattctttctgatccacagagctaattgctaaaacttgcatcttaatgttacatattttaaaatgcttccaagttggtagcctttaaactgcaccagtctttctaatgctgatagtttttgaatgaacaatataaaaatctgcttctttattcataagttgtaatcaaagcattttctttgctaataaatttatatttgatttgtctttttaaaaagtttttcagataaactacaggtcctgaatgtagacgagtctatttcataaaataatcatttgtatatttaaattcatattcattcagttgtttgtctggttaaaccaggtctcttttggactgttattagctgtggaggcagataagggtggtgtattgattgggaacgtggggtttagtggtgatgggtaatcagttcataatacaacaaaataccaaacttcagaagcaaactttacgtcagtttgatggtgtctaatctccgtgcatgtacctccctgaatataaatagctctagcatgaaatttctactggtttataggttcttaagtcactctgaagacacctaaataatcacaaaggaataaactggcaaactttagttttcattgctcttataggaattctgcagctcatgtcaagtcaccagtgacatttttgtcagcatgtatgttttattggctcatgtagaaatcattaattattgtattaaacataggaccttaaatcaattagggaaagatattaaagtgttggttattttgtgatttttttttttttaaaagatacatgaaaaggaaatcttgagttttgggttttttcctttcgtggagagctattaggccataatcacttatccattgacaccatttaaatgttattaaaatgtattgcagaaagctagtttttaaaatatattattattgactttattacttctttctgctattttagaattaaattaagcatgttttctttttttttttttgagcttgtatttttattttcagttttatatatacttaaatacttttaacaaatagaatcctcatttttcctaccaggacttaaagtttctatgtggaaaataaggttgcaacagtgatgcagtgtggcatgttaagaagaagaaaacaaatcttaaatttttaatttaatatttactaaagtgaattactgcattctttctaaattatactgttcaaatatgtaataaagtgtgttttttaaccatctgctgactttaataactttctaatcaactttttgtacagcttataaatttcaagattaataaacctttagaattgtcagtgtcttctcagctctgaataaagtaacaaacttttaaaattaagaataattacattttatttaagtacctacttgatgactattgtagacaaaagctcttatgtgttcttttcttcgttattatagttctgcagaatcagaagatttggcagtacatttatatccaggagctgttactattcaaggtgttctcaggagaaaaactttgttaaaagaaggcaaaaagcctacagtaagatttcatcatattatattttaatacacctctaaaaatatgcaaatttataagactctgtaaaagtactaaaacaattaaaataaaacctgattatagtagacttgaaataatattaaataaggtcctcccctcttatccttgggtcatccattccaagatcccccggggatgactgaaacctcagatagtaccaaaccaaattaccatcatttggaacatgtttctgttcatgtcttccattcacaaatataataccttttctatcttaactaagcacttaagcccacacagtaaccgtaacttttgcagtttgcgatgctatagcaaaactagcatgaatttctttttccttcttcacaatttcacagatacaaaatttgttcttaccatggatcttagcaaccttagcgtctaatttttctttccttaatccaagaagttttcttttcacttaaggaagcagtggggagtgggacacaagggtagcacatatagtgtggagacgctggacaaagaaagggaagattatgtccacagaagcacagagcagaactgtgtgagattttatcatgttactcagaacaacacatgattttaaaacctgtgaattgtttatttctcaaattttccaataaatatttttagactatggttgcctgtgggtaactgaaaccacagataagagggaaaatattgtacacatttgtttcaccatgttttcttaacataaaatgttattatatgtgccatatagatttctgttaaatcatgtgttaagggtgcttaaatcctgtacttttttttacccccattatagttcgtatacaaaattatttcttagagaaccctgaaagtatatcatgaagaagtattttagtattaagtttaggtaaaatagaaaataaagagtaacaaccctaaaaaatggaatttgattgtgttttatcattttatttaaattcctgtaatacagttttgttttctacataacatagaatccaaatattaaatgctttccaaacctataactatattggggggggaaaaaaggaagattggtggaacaaagctcttaatatgtatcaaagaagtttcttcttcctcaacaccagcatagtagtttgactactaaggaacaatttttttccctttctcaaatttgaaatataaaacctttgatatatattcacacttaaagcttttgaagatatgggggcttcatataagtaatcttattttgttgtttatatcacagtaagccaaaggcacatacaaatcaagaatctcttaggcaggctagtgaactcagaattgcatgtcagttgaagcattaccataccttttgtgtgctggatgctagaaatagagcagtgaacaaggtgaggcaaagtgtcttcctcctggattacatttcagtgaggagaaatagagaataaggctttaaaataatgtcataggatacagaatgatggggcaaggagggatgccaccatggcaaaacatttgagctgagatctgaatgaggaaggtgagttagctgtgtgaatatctagagttcaggagacaagaaggcttgtgtagtttacgcattgaaattggggaaggtggaggagatcaagtaagaggcaaaagctggagttgtttgatgataaattaaacatgatgtatgagagaaagagtgaaaacaaagataacttctaggtttggggactgagatgggtgtatgttggggacatttattgaaatggggggcaggtcagtcttggccaagttcagtttgatatgcttattaaacattcaagtggaggtgtcattgtggctgttgaaaaagtatggatcatgaggtcagcagagaggtggcagggagatagatttgggagtcattagcatacagatagatagtatttgaaatatggaactggatgatagattatctaagaagaaagtatagctagagaagaaaacaaggttggagatggggctctgtagcattaaaggtctcccacaaagaagagtataaaggaaaactaaggaactgttatcccagaagcctagcagttacagtacttcaaaaagcaaagagtggccagctgggtcagatgctgttaagaggctggctatgataaggatagaggctttgctaaaattacaatcatcagtgaccttgatggcccaaaagccaaatgaaatgagttaagtagaaaatgggcaaaacagaagaagtagaggcaagatttagagacacccttgcaagaagttatgctgtgaaaaggagaagagaaattggttggtgtctggggagtgaggagatgggtcaaaggagggattttaaaggtgggagtactattaaggttcatttgtataatggtggtagagggagagagattgagaagcaatggagttaattgcaaaagcaaacttctttattttttttttctttttttttttttattatactttaagttttagggtacatgtgcacattgtgcaggttagttacatatgtatacatgtgccatgctggtgcgctgcacccactaactcgtcatctagcattaggtatatctcccgatgctatccctcccccgaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttggattggttccaagtctttgctattgtgaataatgccgcaataaacatacgtgtgcatgtgtctttatagcagcatgatttatagtcctttgtgtatatacccagtaatgggatggctgggtcaaatggtatttccagttctagatccctgaggaatcgccacactgacttccacaatggttgaattagtttacagtcccaccaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacactgttggtgggactgtaaagcaaacttctttaaaaagtgagagagagttggaatctagggcataaaaagagagttgagtttgcctttagatagaatcggggttaactattcttttgtagctggaggaaagactgagtatgtgggtctacaaacaggtagttacatggcagtgacaggagtatttgagattaagatttcagaagtgatacagctcaactctgaggttaggactttggttgaagtgaagtggacttgatcattggcacttagaatgtaaagaaactaagaagccaggagcattgtaatagtatattcctgtgtttgtcctatccaggtagcatcttggacaaaatattgggcagctttgtgtgggacacagcttttttactatgctgccaaatctctaaaggctaccgaaagaaaacatgtaagtatttgttctctacatttttagcgtggtttcccagactgttcatggttataaagaaagcagtcctaatgggatacaaaggttttttgggtttgccttgttttttcctatcttctagtccaaaagtttttacatttatttcttttttaaataccatttttccattgcaaatgtcaaaactgcacattacgcttatctattttgacatcaaagctttctcaaatctggagtttcctgttcaatattgttcaaaactattgccttggagtttcctttcctaatcagcaaaatgtggaaatgtgggaccaacatctaaagttctttccacctcaatctctggttcagtgattcttcccaacaatgaagaggaatgatcaattacaacagttactgcaatcactttcttgtgcttcatattacttaaaagaagcctcttttcaccctgtagaattttcctataaatcttttttgcatgctgttttgtttttacataccagtgatagaatctttgaaaggaagaatgattttctatgttgcattaataaaatctgagaggaattttatttctaagtcacatgttttgggggagaaaaattacgtggtttatcctactgaggaaaggtaagccagtgaagaaaaatttaagtcctttttctacttaaaacttaaccaaatgatactgtataattcagagtaattcagagaaactcttctttattctcacagttttagccctttaatcaaaccacaggtatagaaaagaacatttttggtttaaatgaatgtgggaagtaccgtaagatagcattgcctttctttatcagctatacccaccacctgccaccctcctgatcatcatgactcattgtcttgcttttcttcatagtgttagcatatatgtttccctaattaatccatggtttcattttttaactgtacctcagtgggatcatatatattcttaagcactagcttttttgctcactattattatataattgttaagatagctcttgcattgagataaaggacttgagtgaaggatcatggagatttcttcggtgaatatttattttttgtattctggtcaaattgacaataatgcctatataccctacaacatttacatagattagttttgctagaacaatttgtagagttagtactgctgttctcaaagtgagaaaaaggttggattcattcagttcaattaaatccttagcttcatatggaaagtaacttttcacatagccacattgagatacttgctggatagatttcacttagctgactattgtagaaaagtcattattcaaaataaaatggtttttttgttttttgttttttcttagtttcaattagaaaaagtccaaattagagaagttataactgaatttgtcatctaatggatatgttaaatattgttttgtgctttgcattgttgcttgtgcataaagttactagtatattatactttgggtttttaattatatgaggtttctgataggtaatgtatgcaaaatgtttggaaattaaagcatagtgagttgtgagaaaatcttattgagtaccaaggaaattgaccgcatttctcatcttttctaattaaattaaaatataattaaagaataaatttgaagaacaggatagagggtatagagacaggtctatatctatatttggtattaatcttgagatagaaaagatatggcacagaactaaatggaagaaaaaaattttaatcgttttcaaataaagttagaatacaaataaattggaggaaaatatctgctatatgtaagcaaccgaaaaaggattaaaatcaccatttaaacatagcaccacctgtattgttgtgttttggttttggttttggttttggttttggttttggtttttttttttgccaaaatatttaacctgaatcttatgaggaaataatcaaatccaaattgtgggtcattctatgagacagctggcctagattcttaaaaagaccaaaatttggcaggtggagtaagggcagggggacaggaggactgttctagattaaaggagacttgacaactaaatgcaatgtatgtcttttagttgaatcctggagttatattggggaaaaaatttaaaaagctataaaggttattattggaacaacttaagaaaatgtaacatggactttatgtggttgtctcttcaatttcttagaaatgacaattacgttgtgattgtataggaatatattcttgttattaaaagatacatgttgaaatatttagggttcaatgttatgatgtctgcaatttgcatttgaatgttcagaaagatcaaacaaacacaaaaatgtagattaaggatatatggctaatcattgtggcattctcaacttctgtacagtttgaattttttcaaaataaaaagctggaggagaaaaaaaatcatagattaaaatatacctgttcatggcaataaacccagaagtgggacatatggaagtctgtataccttattttagtattctataaagtatatatttttttgcctatgaagaacagtttgtgtgggtagagtgatcaacctcacttactatttaaaaatgcaaattaagggagacactttcctgccattagacaaaaatttaaaagattgatgacatagcattggtcatgatatggggaaacagactgtcatccatggctggtaaaaatttaaattggtattgtttttgtggtggccagtccgagtcagtatttagcttggtaataaccagaaattcctcatctgagaatctgtcctactgaaatttttgaacaagtgcacaaagattatctgtagaagaatatttctataatatttatgacaacagaaatctggaaatacccaaaatacttatcaataaggaaatggttactgatagatgaaaaacacaagtcagagtgtaaatatatcccccattaatacgtaaaaaccaacagcagcaatgacacaaacctctgatataataaatgcatagaataaggtctggaggttgtcacctcaagtgatgattatatctggggaatgtgatgggattcgctggtggttaaagggcatttgcactctagtttcatccctgtttctgaagcagtttatgttgcttgagttactttttactttttgaaaaagggaattgaggtggaagtttttaggcttaagaaaagaatattagaagatcatagtattcatgtcgaagtacattatgagctgtcaaatcagcagtcctgtggtagggccaatttcattcttcacagtagtaaaacttactgatttctttagctttcatatttcaatttcatgttgttatgaatgtgccatgttcattctttttcccatttcctttaatcgtgaagcatatcatacatacaaaagaagataggtagtgtacatgtacattttaaagcataataaataaaatgaacacctgtatactctccacccagtgtgaggaacagaatgttactagaaccgtcaaagccttcccagaggcatccacttcttccctgtcaaccatatccacagcttcttgctgtcctgaatttcttgttaattgtcgccttgtttttctttagtgttttaccatgtacacgtccttatacaatgcactgtttgatttttaaacaatacctgaatggcttcacatacagtcttaagcactagcttaagccaacctgttcttcttttataactgccctttctcagaattaagaaaagaagttgtagctaaaataataataaaagaatggttaactacaaaagtaatagacaggctaagaatacccttcttttttgaaaaatacaagtaagaatattgtcattaagaattatctggttgcagggagctgagatcacaccactgcaccacagcctgggcaacagagtgagactgtctcaaaaaaaaaaaaaagaactctctgatagcactgctgatttattacatcatcagatttaagacagcatagctactaaaatgcaaatgtccttcctataaggagtagtacagtaattcagaaaaaaaacaacagattaatatatcatattcacaaacatgctctctgggaatagggaatagatcagttaggttttgatgcagagttgaagctgggaaggtctggaaagtaggagattatctgaagaaggcatgcctaggatgaaattcagcagtaaaaggccccaggctggctgagaccagcatgaagtcacaaatctcatctttcattaggagaaactgaaaatacactccctaacactgaagttttgctagaataaaccataaattttctgtttccgctaattatctttttttctctcagttcaaatcaacatccaataagaacgtatctgtgataggatggatggtgatgatggctgatgaccctgaacatcctgatctcttcctgctgactgactctgagaaaggtgaattgttagaataactggggcttacgatactgcgtatgtgtttgtgtatatgtatgtatgtatgtgtgtgtgtatacttgtcatatatataatgttttatgcatacatgaagaacttgatgagccaaaacctagtttcactggaatactcaagagagaaagtatttgtgtagttttatctattgggaaatacttctgtcccattatgtattttaataatatttgtggagcttattttctttgctccatgggcatatatgcttgaaaattaaaagcccagctaatccctagagacctaactaggaaaggagggagggaatttgagaatatataccccattgttacttcaaatttttagagacttgccatataggccatactgcttccttcatcaataccttgaaatggattgttattcttaagttctgaaagtggcagagttttcctttaaatatttattctatcacttttaattaaattattcagaaccaatattctgcagtcttatccacacagatctagagatgccacacaattattgtatttatttagatgtattttattctaaagaatatttaagaacaaaattatttcttttaatccataagcagcaaaacagtgactttctgaatatatttggctcagatcactttccaagttaattataatattttacatacagtatatagagagacacttatgaataaaataactggctattgaccattggagtttataaagtagatatgagaaattggaggatgggccatgtataatcacatcatatgttcttcttactctacctgtgactatagtggatacctcaaggctcatcagaaaatatccccaagtggttgcttttcttccatcataacaactgctagctgttgacaagtaccagaaagatactttcagcagttcacaactggaatactatgttaccttttattgacttcacaactatattttgacctctgtttattcagatactattttgtatcaacagatatcccacttttatgtttcagtgttttaagtaaacaagtaagcaaatatgttggaggcaggaaaaaataataccaaaatgtcttctttttagattaagtagattgatttacagaataaatacaccctactcaacattttttttcccataagttattggggtacaggtggtatctggttacatgagtaagttgtttagtggtgatttgtgagattttggtgcacccatcacccgagcagcatacactgcactctgtttgtagtctttttaccctcatcccccttctcacttttctccccaagtccccaaagtccattgtatcattcttatgcttttgcatcctcatagcttagctcccacgtatcagtgagaacatatgatgtttggttttccattcctcagttacttcacttagaataatagtttctaatcttatccaggtcactgcaaatgctgttaattcattcctttttatggctgtgtagtattctatcacatatatataccacagtttctttatccactcgttgattgatgggcatttgggttggttccatgattttgcaattgtgaattgtgctgctgtgaacatgcgcatgcaagtatctttttcatataatgacttcttttcctctgggtagatacccagtagtgggattgctggatcaaatggtagttctacttttagttcctcagggaatctccacactgtattccatagtggctgtactagtttacattcccaccagcagtgtagaagtgttgcatgtttaccacatccatgccaacatctactgtttttttattttttttattatggccattcttgcaggagtaagctagtatctcattgtagttttgatttgcatttccctgatcattagtgatatggagcattttttcatttgtttgttggccatttgtgtatcttcttttgagaattgtctattcatatccttagcccacttttcgatgggattggtttttttcttactgattcgttttgagttcattgtagattctagatgttagtcctttgtcagatgtatagattgtgaagattttctcccactctatgggttgtctgtttactctgctgactgttgcttttgctgtgcaaacgctctttagtttaattaggtcccaactatttatctttgtttttattgcatttgcttttgggtttttggtcatgaaatccttgcctaagccaatgtctagaagagttttccaatgttgtcttctagaatttttatagtttcaggtcttagatttaagtccttaattcatcttgagttgatttttgtataaggtgagagatgaggatccagtttcattctcctacatgcggctagccaattatcccagcaccgttagttaaaaagggtgtcctttccccactttatgtttttgtttgctttgttaaagatcagttggctgtatttgggtttacttcagagttctctattctattccattggtctatgtgcctattttcatagcagtaccatgctgttttggtgactgtggccttacggtatagtttgaaatcaggtagtgtgatgcctccagatttgttcttttcacttagtcttgcttcggctgtggtgggctcttttttgattgtatgtgaattttagaattgttttttctgattttgtgaagaatgatactggtattttgatggcgattgcattgaatttgtagattttgcttttggcagtatagtcattttcccaatattgattctacccatccatgagcatgggatgtgtttccatttatttgtgtcatcagtgatttttttcagcagtgttttgtagtttccttgtagagctctttcgactcctttgttaggtatattcctaagtggttttttgttttgttttgttttgcagctattataaaaggcgttgaattcttgatttgattctctgtttggtcattgttggtgtatagaagcctactcaaaattttgaattcaaagccccagcctccttcccatatcaaaggcataattcacgaaattacatttcaagatgagagcattttcattggatttagttaacagattctttgttttcttcagtttctcttagcatgcctaatagaactacttcaggtagccaaaattttatgaagtctatctatactaatggttttttgcgggggaggggtgagtatgtaaattgtagctgtggccagctttattgtagatatggctttttttcacattgacctaatgtctgtgtctgagttcagcaagtgtaacggtgttacttgactaaacatttggtgaagaaacaattacttcagaaagtgaaaaagttattttgagtgttagaatctcaaggaaaagctgaataatgcttaaatatagttaggctcttgagccattgaatgcagttattaaggaaagaatagaattcagcacaaattgtgaaataaaaagaacttaggtcaatgaaaaaaggaaataaagcttaatttagagcagcctatagtacatggatcctttcttttctcaatttgttttctcaccttaatacatataaccatttaaaatatcctcattatatgtcagtcttgaattaaagtcaatatagaaattacaaaatacacacagcacaaatgaatatctaatttcttaaaagagagaaagttgcctcctagactttccccaagagccctcaacagaactggaaatctgtaataatattgacaaatatcttgtaactaaagactaaaagcatagtctatcaatgttatatgactaatccttaattatactgaatagctagtgtttaagtattaaacatattgaagcattctggcatgttaaaacttaacattaacatctactaatatttaggccaggtgtgggggctcatgcctgcaatcccagcactttgggaagccaaggcaggcacatcacttgaggtcaggagttcgagaccagcctagccaacatggtgaaaccccgtctctactaaaaatacaaaaaacttagctgggcatggtggtgcacacctgtaatcccagcttattgggaggccgagacacgagaatctcataaagctgggaggcagaggttgcaatgagctgagattgtgccactgcactccagcctgggcgacagagcgagactccatctcaaaaaaaaaaaaatctaatatttagatcatctaagtagtaagtattcagaaccaatattctgcagtcttatccacacagatctagagatgccacacagttattttatgtaggtgtatttcattctaaagaatatttaaggagacaaaattatttcttctaattcataagcagcaaaagtgactttctgaatatatgatagcatgtaaatgtgttgcatcgagaactctttattgtattggaaatacaataaaaataggaaatacaataaaatggaggtgttgaatagaattctaaaactgaaaactctagtcatgtttaatttgctcattattatctggcagaattattatgtgtcgtccttacatttttaatatttcccccttattttggataattttaggaaattcgtacaagtttcaagctggcaatagaatgaatgcaatgttatggtttaagcatttgagtgcagcctgccaaagtaacaaacaacaggtaagcatttctcctaattctcagaatagtccataatttgggaacatatgtaaaagagttccaagagaagtaaacagactagttctgaattaactaggagaatggtggtgtttttattcttgttgattacagttaataagatatgaaggtctacatcttagtgaggagctagacagtaatcatgcaaacaagtaacaaaatttcgaacagtcagaactatataaagaaaacaatagacgtatgtgatatagagcaatgggagtacagacaacttttgataacataaggttgggcagcaaagatctccctgaggagatggtattgacaagaaccacaagaaggaacgagctataagaagaggagagcagagtgctgtgtaagggaagagcaagtgcagggagcctgaagctggaacaagcttaaggtgagttcaaagcacagaaaggtagctagtatagtagtcagagtatagttctctaaagggtaaaaattagatggcatattaaattaataaaaattattcgaattcatctttatttgatctattgacaatttgatgtgggtttctgtggtggtagtgaaaccaaaaaccatttaaattttgtttgcttttattttactgaaacaaaaatggtctaattgaaaggctttcagctgcagaagagcaggaatccattgtgttgttttccccaaaccctgttgcacagttagagttgaaccacagattggtagagcagacataaaacacatagccacatttatagaaatttatatagactttttgtagaaccagttgtttgttaaatatatttgaaaatcattgacttagcatattgataatgcagaagtctatggttagcattatcagtaggtaatattgaatatgatgcactatataagcttagaaagcttacagaagtatttttcaccctgtcatatcaggatgtaagttattaccctttcttgataattgaaactaaggctccataatacaaaatgacctacacaggtcacacaagtaaaaaatggtggattcaaactttcttcatcctttaagtccattctttttgtttgttttttgacttttgggttcagagggtacttgtgcaggtttgttacatgggtatattgtgtgtcactgaggtttggtgtataaatgatcctgtcacccagttagtgagcagagtacccactggtttttcaaccgtcacccctctcccaccctccccactctggtaatgctcagtgtcgattgttcccatctttgtgtctaggtgtattcaatgtttacctcccacttacaagtgagaacatgcagtatttggttttctgttcctggattaattcacttaatggtctccagctgcattcatgttgctgccaagggcataatttcactgttttttaaaaatcactgtgtagtattccatagcatatatgtaccacattttctttatccaatccactgttgacaggcacgtaggttgattccatgtctttgctatagtgtatactgctgggatgaacatacatgtgtctttttggtagaacaatttattttcctttgggtatatgctcagtaatgggattgctgggttcagtggtagttctgtttcaagatctttgagaaatctccaagctgctttccacagtggctgaacttacattcctaccaagtgtataagcattcccttttctctgcaaccttgccaacatctgttattttttgacttagccattctgactggtgtgagatggtatctcattgcaattttgatttgcatttctctggcaattagtgatattggccgtttttcaaatgcttgttggccatgtgtatttcttctcttgagaagtgtctgttcatgtcctttgcccactttttaatggggttgttttttgcctgtaaatttaagtttcttatagattctagatattagacctttttcagatacacagtttgaaaatattttctcccattctctaggaatgttggtttattctgctgatagtttcttttgctctgcagaagctctctaattaggtcctgtttgtcagtttttgtttttgttgcaactgcttttggagtcttcatcatgaagtctttgccagggcctgtgtccagaatggtatatcctaggttatctttcagggtttttatagttttaggttttgcatttaagtctttaatccatcttgagttgatttttgtatacagtgtaaggaaggggtccagttttaatcttctgtatatggctatccagttatcctagcagcatattgaatagggagccttttccccattgcttgtttttgtcagctttgtcaaagatcagatggtagtaggtgtgaggcattatttctgggctctctatactgttccattggttctatcctgttccattggtatctgtttttgtaccagtaccatgctattttttggttactgtagtcttgtagtatagtttgaagtcaggtagtgtgatgccttcagctttgttctttttacttagaattgctttagctatttgggcttttgttgttgttgttgttgttgttgttcccatatgaattttctaatggttttttctaattctttgaagaatgtcattggtagtttgataagaatagcattgaatctgtaggttggtttggacaatatggacatttaacagtattgattcttccaatccatgagcatggaatgcttttccatttgtttgtgtcatctctgattactttgagcaatttttgtaattctctttttcttttttaattttttttttttttttttttttttggagacggagtcttgctctgtcttcaggctggagtgcagtggcgcggtctcggctcattgcaacctccacctcccgggttcaagcgattctcctgcctcagtctcccgagtagctgggagtacaggcgtatgccaccacgcccagctaattttttgtatttttagtagacaaagggtttcactgtgttagccaggatggtctcgatctcctgacctcgtgatccacccacctccgcctcccaaagtgctgggattacaggcgtgagccactgtgcccggcttgtaattctcatagtagagatcttttacctccttgattagctgtatccctagatatttttttctttttgtggctattgtaaatggaattgtgttcttgatttggctctcagtttgagtgttattggtgtatagaaatgctgttgatttttgtacattgattttgtatcctgagactttgctgaagttgtttatcagatctaggagctttgggtcagagactatggggttttctagacataacatcatatagtctgaagagagatggtttgacttcctctttctatttgaatgccttttatttctttctcgtgtctgattgctctggctgggacctccagtaagtattatgttgaataggagtggttagagtgggcatccttgtcctgttccagttctgtaagggaatacttccaacttttgcccatttagaatgatgttgctgtgggtttgccatagatgactcttactattttgagatatgttctttcagtgcctaatttgttgagggcttttaacatgaaaggatgttgaattttatcaaaagccttttttgcatcttttgagatgatcatatggttttctgtttttaattttgtttatgtggtgaatcacatttattgatttgcatctggtgaaccaaccttgcatctcaggaataaagtctacttgattgtggtgaattaactttctgatatgctgctggattcagttagctaatattttgttgagaatttttgtgtctgttcatcaggtatattgacctgtagttctgttttttcattgtatctctgctagtttttggaatcagaatgatgttggcttcatggaatgagttagggaggagtcttttctttctcgatttttcggaatattttcagtaggattggtactagctctttttcgtacatatggtagaattcaactgtgaaatccacctatttcaaggcttttttgggttggtaggttgtttattactgattcagttttggaactcattattggtctttttagggattcagtttcttcctcattcaatcttcagaggttgtgtttccaggaatttatccatttcttttaggttttctagtttgtgtgcatataagtgttagtctctgaggattttttgtatttctttggagtcagttgtatgtcacctttgtaatttctgattgtgattatttggatcttttctcttgttttatttgttaatctagctaccagtctatcgatcttgttttttctttcaaagaaccaacttttggttcattgcttttttgtatgcattttcacatctcaatttcattcacttctgctctgattttggttatttctttttttctgctagctttggggttggtttccttttgttttgtttttctagttcctcaaggtatgatgttaggttgttaatttgagctctttctaacttcttgacataggtattgagtctgatatgttgtgtctctgttttccttagttttaaatcattttttgatttgtgtcataatttcattctttacccaaaagtcatttggaagaaagttgtttaagttccatataattgtgtggttttgagaaaacttcttggtattgatttctagttttattgtactgtagtctgaggctatggttggtatgatttcaatttttttgaatatgttggcacttgctttatgcccaagcatgtggttgatcttagagaatgtgccttgtgccaatgaaaagaatgtatattcttgtgttgttgaatgaagtattctgtagatgtctgttgggtctagtttgtcaaatgttgagtttaagtccagaacatttttgttagttttctgcctcagtgatctgcctgacactatcagtggggtgttgaagtcttccattatgtagttatctaagtctctttgtaggtctctaagaacttgttttcctaatctagatgctccaatgttgggtgcatgtatctttaggatagttaagtcttctggatgaattgaaccctttatcattatgtaatgcccttctttgtcctttttgaccattgttatagtctgttgtatctaatataagactagcaacctttgttcttttttgttttccatttgcttgataaatcttgctccttacctttactttgcacctagtatgttgttacatgtgagatggttctcttgaagatagcagacagttgggtcttgcttctttggccagcttatcactttgccttttttgcctgtttacattcaaggttactattgatgtgtgaggatttaatcctgtcatcatgttgttagctgcttgttatgtagacttcattgtatagttgctttatagtgtcagtggactatatacttaagtgtgtttttgtggtggcagttatttttctttcatttccacatgtagcactccttaaaggacctcttgtaaggcaagtctgatgatagtgaattccttagtctttgcttgtctgaaaaggattttctgtttccttcacttatgaagcttagtttggtgggacatgaaattcttagttggaatttcttttctttaaggatgctaaaaataggcccccagcctcttctggcttgttaggcttctactgaaaggtccactgttaacctgatgaggttccctttactgccccttttctcaagctccatttaagatttttttcttttgcattgaccttggagaatgtgatgattaagtgtcttggggatgctcatcttgtatagtatcttgtggggagtctgaatttcttgagtttgcacatcaacttctgtagcaagattgggataatttttgtggatcgtatcctcaaatatgttttccaagttgcttactctgtctccttttcttgcagtaacaccagtgagtcataggtttagtctctttacataatcccatatttatcaaaggttttgctcatttttaaaatttttttctttaatgtttgtctctgttaatttgaaggagtgctcttcgagttctgagattctttccttggtttggtctattctgttgttaatgcttccaattgcattatgaaattcctaggctgggagtggtggctctcacctgtaatcccagcactttgggaggccaaggcaggcagatcacttgaggtcaggagttcgggaccagcccggccaacatggtgaaaccccgtctctgctaaaaatagaaaaattagctgggcatgttggtgcatacctgtagtcccagccactagggaggctgaggcaggagaatcgcttgaacctgggaggcagaggttgcaatgagccaagatcatgccaccgcactccagcctgggcaacagagcaagactcccatctcaaaaaaaaaaaaagaaaagaaaaagaaagaaatttctagagtgaatttttaaattccagaggttcagtttggttctttcttaaaatggctgtgttatctttcaactcttggattgttttactgttttccttaaactgggtttcactttttcctgtatctcactgagcttccttgctattcagattctaaatccaaagtctgtcatttcagtctggttaagaaccattgctgggaacctattgtagttgtctggaggtaagaagacactgtggtttttagagttgctagagttcttgcattggttctttctcatctgtgagggctgatattcctttatcctttgaagttgctgacttttggatggtgctttttgtttttatgtttttgatttcccttcagggtttgactgtggtataagttgggtatagtcaattggcttcctttctggatgtcttcagagaaccaaggttcagcttggcactcctgggctgtgtcctgtaactcccaaggggctgggactgggcccctggctttttcctctggcctcttgaggtcgaccaccggctgcactgggtggaccaaggtgctcccaggctgctggcaaaacctctccatcaggctactggcaaaagcacttcctcaggggccactgttgaaagtgttctggcaggatggtgggggccactggtaaaagcactatggtgacagtcgcccgcaaaagcattccaacagaatagtggaagctacactgtgtgcctgctcccatgggagtggccaaacagggaccttggaaggggccagtagacagtgggacatgcagctcagactcaccccagtcccatgggaaacacagccctgctctctccaaatatggcagttagcaaaggtcagagccacctagaggagtatgaagagccttggtgggtgggcgcctatggccgtgttcctttgcagctttccccacaccataccccctgggctccatgtagacctaagttctgtctctgccagctctccaggcagttccccctggcaactcaaatatccaggaggactatgggatctcctgccactaggatcccagcggtttgtggtgagagtgggccattccacagttactttactcaccccttccttaggagctgttcaggaccaggaatgagtcccagcactccacagccctgtgcagggttcctagcttcttcgctcttcaaccctggttctgcatcatctctccacccactctcagaaaatcggtgattttctctcagtgcatcctctcagaagataggcttggagtatgctggtctactagatactcagatctctcttggtgggagaagctcttcctggctttgcctagttggccatcttgtcccaatcccgagggcatttttttaaaatattgttggagtgggctttgttctctcatagtttttattgtttcaaatatatatgcaacactaatagcagtatttagtaccatttttagcaacctccataaaggacatgaaatgtcatagagcgaaaattattttttgccttgtcaggttagtgtctggggcagaatgaaagaaacagatcaggctttgtctagactaagcctttcaggattcacctcattgctatacattttctttaaatgtaatttagggtattaagactctttttttttcaatctcagattccaagatgaatctagacaatatatacatataccagcttaaaggttcaatttcttttactgtattagtgagtatttctgtgcaacaagtcaaccagacgtgtataaatatttgtttctatacttgcaagaattagaatagtggcaaatttgtaagtagaacctgtgaaagttttagtagaaaactctgactcaaatgcaaaatatcttaaaccacattcaggcaacttaaaaagaaatgaaacttttactttacttaaatacaagtttctttttttttctttgagacagggtttcactcttgttgcccagcctggacagtgcaatggtgcgatcttggctcactgcaacctctgcctcccgggttcaagccattctcctgcctcagcctcctgagtagctgggattacaggcacccaccacaggcccagctaatttttgtattttcagtagagatggagtttcacaatgttggccaggctggtcttaaactcctgacctcaggtgatctgcctgcctcagcctcccaaagtgctgggattataggcgtgagccaccgcacccggccaaatatgagtttcttataatcagacctgaaaatttatactttaagcacttgagcatttgtgttgtatttgatttgtaattcagttatgagtacattggccaacataatttttttattcagaagctgacacttgtaaggtatttatgtttttgcatataataggtttcagagagaggttgctaaactgtgagagctgtcttaaggacagaaaagaccactgacatatgaatacctctcccagtattttggaaaactggttttgaggatttgttttaacatagtgaaactctaataaggaattttgtttttctgtacttattttaatcatgattttacaaataaattcttagtaatgtttgttataaaattatttttgctgattttaaaaatatgcacctaggaatttttgtaatatataatgagaaaataaataatggcaaacaagtgtatctggaatctcaccctaccagagtcatacttactcttgctctcatttattcattcagtaaacgtctactgagccccctgtgttagacaagaaagatattgtctctaccccttctcctgtatagatgtcattttactagaaagagtattaactcattttggtgattttctctcaaaaatgttctagcatgttaattattcataaactattgaagctccttatatcaagttccttttaaaagatacttaagtagaaagattgggcttgcctaaataacaaggaaagataagaaatactcctttgaaaaacaacttttaaactcagtttttaatgcttatattttttaggttcctacaaacttgatgacttttgagtagaagcctgagaaaaaaagagaggtgaactgttgcttctacgtgagcatgaggacctgataaaagagcgccagctataaaccatcctgtgccaggaagagcccagaggctctgtctcagtcgttggagttctcaaccaaaaaagcactaatttcagggaatgatttgagatattcccagagaacaaattggagttgcaaaacaaactgccatgaaccatgcttcttatctcagaactgacctgtggaaaccactgccttaaaagaatgaaaggaaaaccaacatgaaacaccaaatagtgtgtgtgaatcttctggcggtgctgtgcttggaatagatcgtagctaatttgcatttcttttaactttgtaataattttagaggggggaattgccttttttagatatgctttaaaaaggaaaaacatactcttgtggattccatcaggagctggttttgaaccgaggtgaagagacttagcagggattgtaccagcagcccacctgcaaggtttgttctccctctagtagtctgcaacctcactggctttctcacagcaagagtgtaggaatgagaaatgttagtcatgtgagttcttgggtttgtttgggattgggtgggggtgtttgttttgttttggatgaggggagaatttttttaaacactaaacttctgaaatgtagtactgtaaggggaacattatttcctgcaggaggtacaaaggctgtgtgttcatttgccagacgctttttttttaaataggttccagaaaacatggttgtttctaactagggttaaagtttagctttctatatgaattcattgttggaccacagatctgcttaagtaaagagctataatcccaacctaaacttttctgagattttacaataattagatctttttccaagttaattgggttttcccttctcccagtcataggtggtttttatcatcaagacagactgatattttgtcaggatattttcttttacagtgtttgatgtgcataatgccagagttatttttttattattcattttctctctttttgttcaatatgagattcaggatcatatttgtttaaaaggtaacacatagagatgtatgtatatattttgttataagacatacaaaataattttaagagggataaaggtgaaaatatcagattctggaaattttaagtatctaaactttatacttgtatgatttaccataaacataccaaaacatttttctgaaaatttactgtcggtctctgacatgaaaccgtattttgtcagtagttgaccaagcagttttatgagaactcttctatgcaatgatgcatttaatttctaaagtaaatgttgaattattaaaaaaaaagtttgaaggtaagatgccttagaattttaatgaaaaatgacactcaaacaaaggctatatgtcgaatgttataaactcttgagacataatgaattttagcagtggcctagagtaaggtaatgctttgtgactgatatctactaatagacttctgttactttgggcctcacataaaatttctcacattcgtattcttagagaattttatacttttttattataagtattttgcccttgagtccatgaaacttcaatagaaaatattgcttatacaataattagcttaaaatccatccaaaggaaaagagaagagctttttttgagtgttaagttttttaatttagtattctgtttggaaaagatgttaagagttcaaatatgcttcttatgtaacagaaataccattatttctggggtttagtgacacaggctggagaggacaaaagtttcctgtcctgaatgatttttcaattaatgctctaagcttaacccatgttgggtaatagaaagacatagccagcagtattactacgtagaccttgcacatcttacttttgttttgcatttttaaaaatttcttaatttgtttatttctcttcagaaatagcgtttttaacagtgtatgtgcttttttaaaaagtattgtgaatgagaaccctgtggattttttttatttcatttgtttgtcataataagctaacgtagaaatgttgtaggttaaccatatctgtggaaatatgcagttggaagtcagagcctgacatcacatagttttgccaaagggagagagctaagctggaagatgtttttgatactttcggctctaaacattaatggatgtttgcgtagagtaagatagcgttcaaatttggttaatagtttatagatagacttgtggcctctgactgactaaatttcttaacagcacagaagtcgttgtttttctgtctttaaaatttattcattcagaaaattagtcattgctttttaagattattttagcatttgaagcaaattgaaaacagaaaagtgacttaaaatagtgtaggtgaattttttatctataatttaccaaataatacctgataataattcaaagaaaatatgttaccaaaatatattaaatatataggtagttcattcgtgggaagatgaatcttcttattaagcctgccctcaattgtaaataagtgactcaaaaactcaaaatgttcatcagcattcaggtcatttgtttcacccttagccaagaagaactcattagaaattcagttataatttcaatttaagcctgtttatgataagcataatgattggcatgttatatagcctgttgaaaataactacagaatgaccttccagagcactgtttttggcctcgtgcccgctctgttcaggctctgcttgtttttcagaatatgatttttacctccagacagtaagaattgaacaagaactgatcaaacacaccttcctattttgttttcttcactatgtaaatattatttgggcaaacattacaaaaagggatccaaacaatttgagtttcagtatttttttctccctaggcatgtgcttcaatttcaaatatttttttctgtgtggaaaatgccatgtaactattgcactaccttctgtgtggactgtgttggtattggttctttctgtatatcaaaagtcagggtgtttataactgcaaagtttgtataagtggctttattcctcttctagaagatttatgaggagcctaggaagcactattggtacaggaggaaaaaagaatggaaaacatgtttacagactctagctttccttattagcttaaactggggccctcaaagagcagcctgttgatcttttggccaaatgacttgagcataagtcttttatttctttttaaggttaaatcgtaaactgtatacctttactactgaaaacaaaactatagggcatcatactaattgaaaatcaatagtaatgggttccatccattagctttttaaatgaatagatctggtattgatttccttcctgtttttttgaggcacattcctttacaaccagtgtttaaaccaccacgtaatcatcttctgcaaacaaggggtgccagtgttgcctaacagaagataatctttaataaagcaaatcctctgcttcaaaggtttttgaaataattggatccctttttgaaaaggaagatgagtttaactgtgtccaggtggagtaatagtactgctgttgcatgaatagatgatacaaagcaagtgatgaggttggtatgacttctttagtgaccttttagggtttgcttttattttcctctcttttttgtattatttctttcaaacatagtaaatatatgattttacagccaaagtggtattctgttttttctaagctttgagatacaaatattgctatttaatcacattgatgatgaattactttccatgtgaaccttctcaaaatgatttaagtacctttgattttgctcccctaaaaatggcttgtgtctaaagtgacatttttttccctatttggagggttctaatgaaagagatccaggcataaaaactcttttgcttattgaaagcaatttgattacacctatgtttcaggttatagtggggagaaaatttggtcagtgccttattatttgaagagcaattttagggcatcaagtatgacaataatcatgtgccctcttgctcctcttatttcaggagtgtgtgctatccctctctccaccagcttaatctttctcaccccaagtctaacaaagtctttacagaaacctctgtaggtgattgttgcagtcttccttggtttttgagtctttttaaacaagctcctaccctgcttctatccttttagagtaggagattaaaaataaacccaccccagtcaacctttagataagcactcttaaaaacaaatttgaagagcactcttcagccaagttcatttttattttgttgttgatgttttgagcatacatttaattgtaaggccttttggaaaagccctaaaagaataagatacaaccagaaatatttgagttttgttaaatgtactgaaatcttgtaatgaaaatccctttggccagaaatgagatttatttccatttatttttacatttaagtaacactcaaaacaaacaagtagtcacttaacctgccagttattattttcttgaaaatatacaagaaagtaaaaatatctctaatatataagttaaaggaaagttaagagactaagctagttttttcagtgaaagcaaagttggaaatattttgcttctctcagattattggaagacctagagctactggatgttaacctgaatcaagatgttcttttcacatttttttaaagggctagtatgttccagagtaggcaagtagtcattcaagccaaatgaaagagttaactggtccttgaggagtgttagcaaaatttaaattttgaccctggccatttgtactacagaagtgattatgggattaaaagaatacataattacagtgttttgggattgggctcttttttttcttaatagaaaagcagaaacttcataaataatagctgtgctttagataccagataacaaatattgtttcccctgaagatatgacctactagaactactcacatatatagtccaataattactgacttaataggtatggtaaaatagctgataataagtcagactctcaagagtttctgtaccttgattattgacaaattcattgttttacatcctactaaagaacatgtgtgtggggagggggtggggaactggttcacaacataatctgaaggagatcaaacatctgtaaggacaggtacccagtgatgataatatatctgaaaacacaagccatttttattctttatcccaattaacttgaggtactctaatgatgaagcactcgattgcactatgacctccttgagtgatgtgcagcttggttcctctctcactttttgtttctttttaatatgcaaatgtgagtgtgcgatcttcagtgtgtctgcataagctaacttaagatgaatttaagtacagttttctgaaatatttctattgaaataaattacttaaaattata

SEQ ID NO: 7372 - DNA, 386 bp, Homo sapiens
gtttgggttataagtcagcatttttaattttatctttcaaatttttaagtcttttgtaattggatttattgtcgatttattagttcagtagaaaatggtatccttgaatagttttcttttttcttaatagctgttttctgattcagtaaaatgccttgtttgcctaaaagcttttatttcttactttacctgaatttggaaatgggattttgtcaacaatgcatttatatttggggacgataaatgaacattacagagggccatcataaataaaatcaggatagcaatatacctttttaaaagagttacaacctttatatcaagacagtcattgtttgtcttaaccaaaataagtcaaaaataacagctataaaaattattttctt

SEQ ID NO: 7373 - DNA, 437 bp, Homo sapiens
ctgtaaattctaggatcagtttgttatgttccatgaaaacactgttgttatttttattggaattactttggatttataggttaatctgagaattcacagttttgaaaaatttactcctttcatctgtacacatgtctctctgttcatttagggcttttaatgtccttcagtaatgttttacagttttctcctgagtagtctcttacattttttattagtttatgtctaagtaagttagtttttctttctactatgaatgtgacttttttgttacatttcctcattgactattgtgtgtaggaatgccattggtctttatgttgattcttatatctagcaaccttgttgaactcccttacctagttataatggtttgtccaaagatctgttggaattatattagtggcaaataagaatagttgtttcttcctttccaa

SEQ ID NO: 7374 - DNA, 6585 bp, Homo sapiens
ctcttcccttgcagcctcgaagcggaggatccctgtgtcccagccgggcatggcgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacgtgagtgggcggggctggtgggagtggggggatgcacggggccacagggcttcagacttgagctctgcctccccagatcgaccgcttcatccccatcaccaagctcaagtattactttgctgtggacaccatgtatgtgggcagaaagctgggcctgctgttcttcccctacctacaccaggtcagcacccccaggggaatgtgggtctgcagtgggcctgtggggggctcaggggtgggggcaggtgcatggtggagccgggagattcgcctcgagggaggagggcctgtagcagggtgggaggggcctggctctgagggtcctgcccgtctccccatccccgcaggactgggaagtgcagtaccaacaggacaccccggtggccccccgctttgacgtcaatgccccggacctctacattccaggtttcaccctccccctaccctgcaccctcctctctcttccgggcctatatggagcgggtgtgtgggtgcctggaggcccagggcagttcttcctctggtgaccagtgtctgtgtgtctgtctcccacagcaatggctttcatcacctacgttttggtggctggtcttgcgctggggacccaggataggtaagggaggcctggggcaggccgaataaggtggggtttgggaggcccatggttggtcaggaaggtctcagttccaaggtctcagttcccctttcaggacagccccactttgctcccagttggcccaagatacagccctcagggtcactgtcagcatcaccctcgcctcttccctgtccttcctacccacatgcattgcgtcaccatcccctgtgctgggtgacccttctccatccacccttcctcttggcctctactaccagacccatcctcatcctccctctgtcatcaccagctccccactgcacccctactccagcagcagccaggatggtcctgtctgaggtgcgggcctggcccaccctgccccgccctgctatccatggctcccaatcaagccccagctcctcagcctggcactgcccctcccgctgcacgctccggtctattcctttccttgggagggctggcactgtctcctggggccttgtcacatcaactcccctctgcccaggagcgtgttcccctccactactgccgagtacctgcacatccctgctggctccattccagtatcacctcctccgggaagccttcctgccccccaggctagatcaggcccctcctcttgctcacatcgccctgttcttttcctttatggcactgaacacatctgtcattaactaactggtgaggccctggggatgtggcagaggccaagggctttgtccctgaccagctccttcctgcaggcttcagctcggtgtcccctctcctgggaagccctctctgacacctgtctcctgactgtcagcacagccccctgtgactccagccctgcctgctctgggtgtcactgtctagggatgggtctgccatcctctctggatgggatttccgtgggaataggatagcgcgcacatccatcttggtcactgccaggtgtccagccctacccaacacagagctgtccccagatgggtgctgggggtggggggtctgaaccagccaaccaagtggcggggctttgtgcctgcaggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggtgagtacccccgcccttcacgccagccccagcccttgggccttgtcctcacacagcctcctctccctcccccaggatgattggcggggtcctcatgggcctgctcttcgggaagattggctactacctggtgctgggctggtgctgcgtagccatctttgtgttcatggtgagctgggctcggggctggtgaggctgaggcacaggtgccccggaggcatccaggcatccaagcagaggatgtcaggtgtggggttcagaccagagacacattgctgaactgaggagccctggagtggctgcccggcctggggggtcaggagggcttcctggaagagggggtatcctgagccctggaagaggagacaccagccaggctgctagaggctggggatccccagcacacaggctccaggctgggctctcactctcattccactctccttacatgggagccttcctgccagaatttccctggaaggagattctctagagcccttcccactggagtccaggggtgctggtgaagagcactggggtctgcaggctgggtggaccccaagcttagttggatcctgggcaaatcacttcctttctttaaattcagtttccccttttgccgggcgcggtggctcatgcttgtaatcccagcactttgggaggccgaggcggtcggatcacgaggtcaggagatcaagaccatcctggctaacacggtgaaaccccatctctactaaaaatacaaaaaattagctgggtgtggtggtgtgtgcctgtagtcccagctactcaggaggctgaggcaggagaatcgcttgaacccaggaggtggaggttgcagtgagccgagatcgcacacctgcgctccagcctgggtgacagagcgagactccgtctcaaaaaaaaataaaaataaaaaataaactcagtttccccttttgtaaaataggatgatgatacttgcacctcaaggtgctgggaggattcactgtgagcatgtgagaagcagagggcagactgtggtggctggtgggccagggcagagccttggataaactttgacttaagtctcatcatttaaaagtttaggccaagcacgtgactcacatctgtgatcccagcactttggcaggctgaggcaggaggatcactggaggccaggagcttgataccagcctggacaacatagcaagaccccatctctaaaaaaatataaaaattagccaggcatagcagtgtgcacctgtagtcccagctactcaggaggctgaggtgggaggatcacttgagtctgggaggttgaggctgcagtaagctgaggtcacgccactgcagtcaagcctggcggacagggtgagaccctgactttttttttttttttttttttttttttgtgagacagagtctcgctctgtcgggaagctggagtgcagtggcgggatcttggctcactgcaacctccgcctcttgggttcaggagcaagtctcctgcctcagcctcctgagtagcagggactacaggcactcaccaccacgcccagctaatttttgtatttttagtagagacggggtttcatcgtgttggccaggatggtctcaatctcctgacctcgtgatccgcccgccttggcttcccaaagtgctgggattacaggcgtgagccaacgcaccaggccagagaccctgtcctttaataaaaataaagatagcatttctggcgtgtcttcagaaattgccgtgtggccagcataagggggggcagcatcctgggccacgtctcccaccccctcaggccgggtgtccaccgggaagtcccccttcacccgctccaagaccttgcctggcatttgagtatggaaccttctcagattttgcccacagggcccggggagaagcaaatcctcaccatgttaggaggtttggggaaactgaggccccgggagcagaaacctgaggctgcagagggccagggacttgtccccagctgcctggggcttctaggcagaggctggaagtatgtccgggctctcactctggcccagagggctcaaggggtaaatcccttggttcctctctctctttcccacccagatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggcgtggacagcctctccttggcctcgcgcacgaatgggcgggcccagcgctgggcagggggcagggagctggggacgggccagagtaggcaccacgctgaccagtcgcagaaggcagagaggaaggtttaatgagccctgtccagggcccttcagtggggagcctccttcttcttgcccttctccttcttgcccttctccttcttcttcactttgggcttcttggccttgcccgggatgctctcgtgctgcttggagccagcagcgtgggactgtggggccgagggcagggatgggagagaagagatggttctgggctggaagcgagacagggggaccactccccgcaccctccccgccagccccagtgcggggacgcctctctggggtgcagggcacgtgcttggggacgctggcgagagccccttaccttcacatccgtgtccgaatcgctggagctgctgctggagtcggaagagctgtggtgtccttgctggatggaggtgcggcagtgaggcggcgccccttacccagccccctgaagttggaggcctaaggcaggaccctggggtcaggggcaaccccagccttcccgcccctccgcagccggtgatgaggcgacttacctttggacccggacctgccccttgcctccgaccggccctgaactttgtggggactgagcttgggatctcccccgtggcccgcccccacaccgggcttctgggaggtgggctccagggctgtggagagaagttgggtggttggtgcaggcagcttctgggcttgagtccggccccctgcacctccagtccacactccccaggagctcacctgctcccaggtcgaactccatggcggtaagagaagttgggtcctaaggccaagggcgcctgggccctgcagaggagcggagcagggggaggagcgctgagacctgcccgttggaggaatgctgagacgccccacccaacctctgtcctggtcctcagccctgactcattgcccggcaccacccaggatttcctctgtgagaagtgggggagatggacaggtgactgcttccgccagccttggtgcctcaggggaggccgactgaggggggctctgtggatggcattcggggagctacaggtttcccccaaaagctcagatgctcgttcttgaagagggaggtgctgcccctgccttcctgcgtaccgcgacaatacagcttcctccgcggcgctttaacacgcagggcgctgctgccaggggcgtcccgtgttctaactcgctcccacagcccctccggcttggtgagcagcgtctgaggggtgaggggcatagacttggagccagcctgctgcactagatgccagctgtgtcacttagcagcaaggtgacctcagcaaagttgttttacctctgtgcctcagtttcctcatctgtaaataacagctacccatgggattgatgtgaaagtcagaggagttaatttcctagaatggtgtctggcatgaagtactgataatgtgttggttttttaaaaaataaaaggtaggtgttttaggccagtcatggtggctcacgcctgtaatcccagctgctccggaggctgaggcacgagaatcacttgaacctgggaggcagaggtttcggtgagccaagatcacaccactgcactccagcctgggcgacacagtgagactccgtctcaacaaagaaaaaaatatatagatataaaagataagtgtcaggccgggcatggtggctcacgcccagcactttgggaggccgaggcaggtggatcacctgaggtcaggagttggagaccagcctggccaacatggtgaaaccctgtctctactaaaaatacaaaatttagccagccatggtggcaggtgcctgcaatcccagctacttgggaggctgacccaggataatcacttgaacccgggaggcagaggttgcagtgagccgagattgcgccattgcactccagcctgggtgatggagcgaggctccatctcaaaaaaaaaaaaaaaaaaaaaaaaaaaaaaa

SEQ ID NO: 7375 - DNA, 246 bp, Homo sapiens
gaggcaggcagatcacgaggtcaggaaatcgagaccatcctggccaacttagtgaaaccccatctctactaaaaatacaaaaaaattagctgggcatggtggcaggcgcctgtaatcccagctactcgggaggctgagacaggagaatggcgtgaacccgggaggtggagcttgcagtgagccgagatcgcaccacggcactccagcctgggcgacagagcgagactctgtctcaaaataaataaa

SEQ ID NO: 7376 - DNA, 1918 bp, Homo sapiens
aggacctccacaaaaagtactcgtacatccgcaagaccaggcctgacggcaactgtttctatcgggctttcggattctcccacttggaggcactgctggatgacagcaaggagttgcagcggtgagaagggtgggcactgggcaccgaggcaggtgggtgtctacctcctccccgggcgagtaggatgtgtctcgagtagggtgtctccctccttcccgggcgatgggctggactctggccttgcaggcggggcagtgctgtctcggccctggcgtctgggctggtcgaggagcccatgctggcccacctttccatcccacccccaggttcaaggctgtgtctgccaagagcaaggaagacctggtgtcccagggcttcactgaattcacaattgaggatttccacaacacggtgagccctggtgcctgtcttgggctgggccatgggggaggggttcacctggtgaggaccacccatctcctccctgtcatcttgccctttctccctccgtggctgcagttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggtgccgtccccctcccctttactctcggccgggggagtgcagtgggccacagggcctggggcggggtgcggagaccagggcctgaccggcacctgtgccacaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgaccccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccgcctctgccgtccgcctgtgcctctgcccgcctgg

SEQ ID NO: 7377 - DNA, 1920 bp, Homo sapiens
aggacctccacaaaaagtactcgtacatccgcaagaccaggcctgacggcaactgtttctatcgggctttcggattctcccacttggaggcactgctggatgacagcaaggagttgcagcggtgagaagggtgggcactgggcaccgaggcaggtgggtgtctacctcctccccgggcgagtaggatgtgtctcgagtagggtgtctccctccttcccgggcgatgggctggactctggccttgccaggcggggcagtgctgtctcggccctggcgtctgggctggtcgaggagcccatgctgggcccgcctttccatcccacccccaggttcaaggctgtgtctgccaagagcaaggaagacctggtgtcccagggcttcactgaattcacaattgaggatttccacaacacggtgagccctggtgcctgtcttgggctgggccatgggggaggggttcacctggtgaggaccacccatctcctccccgtcatcttgccctttctccctccgtggctgcagttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggtgccgtccccctcccctttactctcggccgggggagtgcagtgggcccacagggcctggggcggggtgcggagaccagggcctgaccggcacctgtgccacaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccgcctctgccgtccgcctgtgcctctgcccgcctgg

SEQ ID NO: 7378 - DNA, 1836 bp, Homo sapiens
gctccatccaacacctgggccgccttccttccccccagtcagagctcagacagtaggagctgccacaacgagatctttattaggctcctcgggggcggggcgcggagggaaagaaggggtggccaggcccaggccaggctgcaggctttggcgacctctcagagctgggagcggggtcccgaaggcgggtctgagggcagagcagagtcagaggtgtctatgggcgtccccgacctcccaggctgccccgtggtttcccgccctgcttgggggtgagcgggggttagtgggcgggttagtctagggccggggccgccgcacggggcgaggccctgcttaccagtcccggtcagggtgggctgcgggagcctcaggctggaaggcagaggacagtgagagcccgcccccagggtggaccggggcaggggcgggccgtggggcggcgcggggcacgtacccacggggaagtagtgggggagccggctccggtagatgtcctcgtccttctcgaggaacacgcagatgatcagccggtccacctgcgccaggggctgctcagcctgggccgagctgccacgcctggccccaggatcctgtgactgcctgccctggtgcaggctttcacctgcctggccctgcgcccttcacggaggctcacggctgtgtgccatcacccccatctcgccaccgccagcgcccttgcgcaggagaaacagggaaggaaggggcgggcctggccctgcgctctgcaccctgactccctgggcgatgatgggggctggtcactctggccaggatgcggaccccaccctcgcccgggcccaggactcaccttgtccttgtgctgctccagccactctcgcagcgtggccagcacgatctcggcggccgcctcacaggggtagcctgaggcgggtggggcgggagtgagtcctaggctctggccccgcccactcccctgtccgccccggcccctcccggcgtctgggtccaccgcccactcctggtccttgcctttcttccagactcaccaaacacgccggtggagatgcaggggaacgcctgggcggggaggggtgagagggggttggaacattgtcactgcgccccgcctcccgccctcccccgcgggccgtccctcaccaccgagcggagccggtgctccagcagcaggtccagactgctcaggtagcagctgcggagctcggcagcctggctggcgctgggctccccgtaggcgatgggccccactgtgtggatgacgtctacggggggcgacggggtcagaccggcgggggtctacgcggtcctcagctccctcgcttccccctgccggcctgggcagaagggggcaggaaacacctttccccccaagcgctgagcctcctccgcgaaggcccccacccctgtgggccccctcgagcccgaatccgcacgcgcacagagccccgcgccccctccccacatctgtatgggcccggctgagacccgagcgcgagtgtgggcgcgaaggcgttgccccccagctccatcctcagcctccacgcacggtctcccccatgtgcttcctggggtgtgcggggtgggggccgggtcttggcccttaaggttaagaagggccccctgaggagttccccagcactcctgtgggggccgcagccctgatgtcccagtgacacacgggcgccctgtctgcgccccacagctgggggcgcgtcggggactcacacttggccgggagccgatagccgccggtgatcttggccttgccagtcttacagctctgcagggtccggcactcgtcggtaagcagggggccggcggcccgatgaatgc

SEQ ID NO: 7379 - DNA, 1837 bp, Homo sapiens
gctccatccaacacctgggccgccttccttccccccagtcagagctcagacagtaggagctgccacaacgagatctttattaggctcctcgggggcggggcgcggagggaaagaaggggtggccaggcccaggccaggctgcaggctttggcgacctctcagagctgggagcggggtcccgaaggcgggtctgagggcagagcagagtcagaggtgtctatgggcgtccccgacctcccaggctgccccgtggtttcccgccctgcttgggggtgagcgggggttagtgggcgggttagtctagggccggggccgccgcacggggcgaggccctgcttaccagtcccggtcagggtgggctgcgggagcctcaggctggaaggcagaggacagtgagagcccgcccccagggtggaccggggcaggggcgggccgtggggcggcgcggggcacgtacccacggggaagtagtgggggagccggctccggtagatgtcctcgtccttctcgaggaacacgcagatgatcagccggtccacctgcgccaggggctgctcagcctgggccgagctgccacgcctggccccaggatcctgtgactgcctgccctggtgcaggctttcacctgcctggccctgcgcccttcacggaggctcacggctgtgtgccatcacccccatctcgccaccgccaggcgcccttgcgcaggagaaacagggaaggaaggggcgggcctggccctgcgctctgcaccctgactccctgggcgatgatgggggctggtcactctggccgggatgcggaccccaccctcgcccgggcccaggactcaccttgtccttgtgctgctccagccactctcgcagcgtggccagcacgatctcggcggccgcctcacaggggtagcctgaggcgggtggggcgggagtgagtcctaggctctggccccgcccactcccctgtccgccccggcccctcccggcgtctgggtccaccgcccactcctggtccttgcctttcttccagactcaccaaacacgccggtggagatgcaggggaacgcctgggcggggaggggtgagagggggttggaacattgtcactgcgccccgcctcccgccctcccccgcgggccgtccctcaccaccgagcggagccggtgctccagcagcaggtccagactgctcaggtagcagctgcggagctcggcagcctggctggcgctgggctccccgtaggcgatgggccccactgtgtggatgacgtctacggggggcgacggggtcagaccggcgggggtctacgcggtcctcagctccctcgcttccccctgccggcctgggcagaagggggcaggaaacacctttccccccaagcgctgagcctcctccgcgaaggcccccacccctgtgggccccctcgagcccgaatccgcacgcgcacagagccccgcgccccctccccacatctgtatgggcccggctgagacccgagcgcgagtgtgggcgcgaaggcgttgccccccagctccatcctcagcctccacgcacggtctcccccatgtgcttcctggggtgtgcggggtgggggccgggtcttggcccttaaggttaagaagggccccctgaggagttccccagcactcctgtgggggccgcacccctgatgtcccagtgacacacgggcgccctgtctgcgccccacagctgggggcgcgtcggggactcacacttggccgggagccgatagccgccggtgatcttggccttgccagtcttacagctctgcagggtccggcactcgtcggtaagcagggggccggcggcccgatgaatgc

SEQ ID NO: 7380 - DNA, 491 bp, Homo sapiens
ccactcaactgttaaggccggagcctgtgcatgattaaggttattctccctctctcgcctctcgccaagtttatgcactcttcccctgtggaccatctctttcgacaaatccagcaaaaccccacccccatcctggaaaatttcttcttcaatcggggttaagtcggggatctagagaggtcgggtgtgaaaggaaaggaccttcgggcgggaaccaataccaagctaccctcctggttttcgttgtttatatacatgggagggggaaaatggtctgtatttttaaaacagaagatgtcctgccgtttctgcttctgtttttccttttttctttttttttttttttaacagccaattcttttgaagggagatagccagccaattttccatttctccttgcctacggagctcatgcaaacttccctacgctagccggctggccctgtgcaaccttcactaccacctcccgccaaccccctccgcacctactt

SEQ ID NO: 7381 - DNA, 491 bp, Homo sapiens; identical to SEQ ID NO: 7380

SEQ ID NO: 7382 - DNA, 776 bp, Homo sapiens
  misc_feature (709)..(709): n equals a,t,g, or c
  misc_feature (738)..(738): n equals a,t,g, or c
tacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgactgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgccaaaggaagagtatgagtattcaacatttccgtgtcgcccttattccctttattgcggcattgagcctgtctgtttttgctcacccagaaacgctggtgaaagtaaaagatgctgaagatcagttgggtgcacgagtggngtacatcgaactggatctcaacagcggtnagatcctcgagaggtttcgcccccgaagaacgtttttc

SEQ ID NO: 7383 - DNA, 878 bp, Homo sapiens
  misc_feature (741)..(741): n equals a,t,g, or c
gaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaaacgctgtgaaaagtaaagatgctgaagatcagttgggtgcacgagtgggttacatcgaactggatctcaacagcggtaaaaaccttgagagttttcgnccccgagaacgtttttcaatgatgagcacttttaaagttctgctatgtggcgcggtattaatccctatttacgcccgggcagaagcactcggtcgccggatacactattctagaatgacttggttgagtactaacca

SEQ ID NO: 7384 - DNA, 150 bp, Homo sapiens
cgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcgg

SEQ ID NO: 7385 - DNA, 845 bp, Homo sapiens
cccgtcgttttacaacgtcgagactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcgggatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatgggttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgg

SEQ ID NO: 7386 - DNA, 15696 bp, Homo sapiens
gacctttggggctgcagctggctgagcgccgaggggctgcggaggcagtgaccttcttaactgagccaccccacgccctgctccgggcctgcctgcatctcccacctcctccccagcgctgcctgcccctctcggagcctggggtcactcagaccaccagccaagagccttcccttgaagtccccaagcaagcactgcaattaggaaagagaaaaagcagcgtgcccagcctggaagggcatctgtttgccccgctagcaacccttttatatctagcagggctcttccagtcctgcagcacgggcccccagctatcagcggtgcaggcagtgctgtggcatcccaggctccgggcagctccgttctcatgctgaaagtgggtctccggccttagcacacacaccttgagggtcttaagaaccacattccctcatagtagaaagtactagaaaaagcgacactgccatcatcatcccaaggcaggctgctactgcctttgctgacccccggggtggcctcacggtggggacaaagctgccaggagccacagcagccacagctggggctttgcaccagcctggcttgagactgagcagtttgcagggggtggggggtgcaaaaaacaagcaaacaggctgctgctgcctccagctgcccaccacaggcctgccccaggcacctggggctctgaggcccctggggaggctgggcccagcagctgcccctggagaacacagacaaaggacttccccgcagggaactgtgccctatggagggatcagacagggctgggaacagccacagaggctgcgtgcctatggcacagcccttcctccgccgcacactccccctgggtcctcaggcccacccaagcgccgggctgcagaggaagcggggctggggaggctgcaggcatcagagacactggtggtggcggacccggccgccgggccccgtgctctcaggctagcccaggtcgtggaggctggcaggctcaggtcgggtgtgagacgtgccgtggctgcgctcagtccagcggggaggagccgttcagcccggcctccccaggaagccatatccccactcacccggtaagagaaccttgtcgtcccctttccatgctctcctaggacacgagcccaggaaccccagacccagggggaggaagggtggaggggccccaggggtcaccgtgtgcaccaggggccgtgaggggccggggcattcagctcagctctgaaccggggaagctggcacggcaaggactgcctcaggtgacgggccgtgagaggggacgggtcaggagccttcccaagccttctcctcagcccgacacccatggccatcggaggctaggatgccagacacagccatttgcagaaatcaggcacagtgactgcagctcacgtccagccaaccaagcatggggccgcagctcaggaagtcccttcccgccacaccacagcctaattcttactgggacggaggcaactcggctacgctgggcaggacgacaaacacgagacgccactgtggaatgagcaacttcggagcacggggtgacttgcttgggaccgtgcccacgtgacagccccttatgcagaggaggaaagagaagccccgagtgggaggggaacctgtccaaagtcacacggtgtgtgggtgacacagctggggtgagtcgaggctggcccctgaggcccatgctccctgaacgctggagaccactgtcggctagcagcggctctcagggaaggcctggtctccaccctcccagcctagcctcgcggaccctcgtcctccccacatcggacctgctcacctgcctggaccctgggctgccagatgcaggaagcatcaaaccccccagcctcgtgggtgcggggcagggcgcaggcagcacagcttagatgccctggtttgtccctcttgtctcctgggaagagcttgctcccgcccagctctcctgccactggcctttcagggttgggctgggcccagagtgccttttagtcgcttctcacggtggcctgatggctcaacccagtcccaaacgggcccagtgacactgccgcctgcgccccagctcaggcccccactgcaccagcaatgctagaaaaccaagccaataaaagtgatttcttttttcattaaaaaaccatttatagtcatttcatgttggttggaaatcacagaaattaggcaggaaaaaaaaacccaagggaacaaatacaaacagcacagcgttccccacagttctctgctctgctctcctgcgagccggggaaggagaggggcagcctgagctcgggcgggggctgggcctggctgcccgcggctcagctctcctcgtccagggcctccgagtccccccgtgccctctcgcgctcctgccggtcgctcccaggcctgtccaggtcgggaccctcccgtacgctgctggtgggaacagcaaaggcggtgtgaggatgccctcccgcccctgccctgcctgtagggcggttgggtgggatgggcaccgaggagtgtacccccgttgtggcacctgaggctcgagtgccgccctcctatctgcctgtcttctgccactagagaccacaaccatctccagggtccccacgctggcgccagccaggcatagcacaaggcagctgctgggtaagtgagtgactccactgagccttgtaccagacagcagcccacagtgatgggcacaggcaccgtcagatagccgggtgcccgtgctcggggcctacctacctgggccaccctggaggctcggcaagaagccaccttcccaggaggccaggggcaggcagctcaaagccctggagctgcctctctgtaggggccgccggaagtgccagccagcggggccctggggtcagctgtgaaggtgggaggcccgagtaaggacgacatccctgggacccatcccagagggactggcacaggaggagcggctcggacccagggtgcgcgtcacaccgctgccgctcaggagtccaaaccccacggcccgggacactcactcgtgcaggtcttcagaggagccacaccttggcccctcctccgagtcccgaccctcctcgtgctccttgtcctctgcgctctcccccttctgtgatgtggcctcgccattcactggggctgagagatctgggtgggacagaggggtcacaggacactgctgggctccagctgggcaccccagaacccttgcctgtcaaggactggaccaggggccaagctgagcgccgtgggtgacacatgcccatccacctggaccccagcacctgctgtccagtctgcaagctcctgacatgggatgctgcagccagccccagcccgagccacactggcctgcagaactgggggcccaagaaatgagggaacgtgggcagccctgagaaaagcccacagcagcctgggaaagacaaaggaagacaaggtcgggcacgggggctcacaatcccagcacgtgggaggccgagacgtgaggctcacttgagcccaggagttcaagaccagcctgagtaacatgccagcaaccctgtctctacaaaaaatacaaaaattagcacgtcctggcagggcgcagtggctcacgcctgtaatcccagcactttgggaggccgaggagggcggatcatgaggtccagagattgacaccatcctggataacacggtgaaaccccatctctactaaaaaatacaaaatattagcctggtgtggtgttgggtgcctgtagtcccagctcctcgggaggctgaggcaggagaatggcgtgaacccaggaggcggagcttgcagtgagccaagatcacgctactgcactccagcctgggggacagagcaagactccgtctcaaaaaaaaaaaaaaaaaaaaaaaaaattagcagggcatagtggtgtaggcctacaatcccagctcctcaggaggctgaggtggaggatggcttgcgcccaggaagtcaaggttgcagtgagctgtgattgtaccactgcactccagcctgggggacagagcgagaccccatctcagaaaaaaaagaaaaaagaaaaaaaagacactagccttcggctgccccctgggccgcaaagccccatcccaagctcgcccatcccatctccaaagggctgctctgagcacctgtaatggggccatgtcagcccagtagccccacagccagcagccccgagggtcacacctcatctcctgtcggcccaccaggcaagcaagggcacctgaggcctccgcccccgagcctccaccgactgcctctctgaacaatgcccccactctttgcccccgctgcacagagccacccccctctctgggcgtcccagggtgggagacggtggaggcgtgtgctgtcatgcactgtccccgtcacccctctggcgtgagccccaagttacctgcatgctggctgcctggcacacggtaggacctgaatgcccctcactggctgccccagggattaaagccgggtctgcacggagaccccaacaggacatgacactctggcaggtttggggcagagagtagagctgtactccccttctggaatgttctgcaaagcatctgtttcttcagctgaggagactgaggtacagggcccaccccacccgcccctcaccggtgctgggcttgtcctccgccttctcctggggggcctcctccccggccagctcctccccggccagctcctccccggccagcttctcctcggccttctccttctccatcccagccttgttcactttctgcaccgcctcgatctttgggccgaggacccgcgacttgagccgggtatagacttctgctgccttctccattacgtccttgttcgctttgtaacggcgaatctggccaccaagagaagaggcctggctcacccaagtgcagcggccctagccccggctctgaacccctcgccccagcaatgcgcccctcccgcagcccctcccgggagcacagctctgtgcagcaggcatttctttttttttttttgagacagagtctcgccctgtcacccaggctagagtgcagtggcgcgatctcggctcactgcaacctccgcctcccagcttcaagcgattctcctgcctcagcctcctgagtagctgggattacaggcgtgcgccaccacacctggctaatttttgtatctttagtagagatggggtttcaccatgttggtcaggatggtcttgatctcctgacctcgtgatccgcctgcctcagcctcccaaagtgctgggattacaggcgtgagccaccactcctggcaagcaccaggcatttctacccagcagcccacggcctcctcgctgacccagggctgtcccgacaggaacctgctgggggcctgggctcccgggcaggcacttgctcccagctcccccgactgcaccctgcgcctctgattcccccgccataccttcttcaaggtggccaccacgtctgtgttcttctggaggatctgagaggtcacctgcagggttcccagctcctctagggcattcaggcacctcttcacgtcctgcagggtggggtgggagtgagggagacggcctggccaagggatccccaggggtcccagggccccgatgggtggaggaagacatcctgggctctccttgaggggagctgtatctgcagaacagctcccctcagcccccgtccagttgacggggaactccagggatagccagatacttggggtcccaggtacgtgggggttggtcctgggggcctccacacaccacctgccgggaaagctgggtgctgcatgtcaggaccagctcccccagggcccttggccaggagaccccatgcgctcactagcaaccggaacagactcctggcccacccaactgcaggaccccggctttgcctcagtttcccgagacatctaagggagcctggcagggaggtggcagcggggactgcttggctcacaggccctgagggtcttaccgggctgtcgacctttagggcaaacttgatctcactgtgcagcttctgcagcttctcctccacggagggctctgggccaggagagagagcaccgtgtgggcccaggcagggccacagggggccagctgttcaagggcaggagcctgagagcctctggaggatttgtcatgggggccccaggtctgcaggctcagcccccacccctggaggcaccgccggccaggccggccgaggatgtgctgagcaccctctctagggacaggcgggacaggccagccacgccacggctgtccccgttcccctcagtgaactcagtgtgggcagtgctgggcagccaggcctcacctttcttcttctctaccttcctgtccatcgagaagccctcggaccgcttccgggtccgctccaccttcacgggcctgtggagaagtgctcccctcagtcgggccccgtcaccggcactctgccactgaggggctggcgcctgaaggggtggacccaaacccactgcaaaggaaacctttgggaggccctgggagctaagccgggaaacgggaggcggggaggccctgccacagcctaggcctagggcagaccagggcagccacaggctcgagctgcccaaagatacaagccttttcccgagttctcatgaaatcccaggattcttttcctcgttcacatggccaagggctggctttgtctaccagagtcagcgagctaggaaaaggccctcaagggtgacacgcgtgcaggagagaggcccattgctgaggctcggtgccatgtgctgctctgtaccccgccactgccataccggcctgccgaattctcatgggcaggtttgcccactcaaggccatttagaaagtgggctgggggaccaagcacggtggctcacgcctgtaatcccagcactttgggaggccgaggcggggggatcatgagtttaggagatagagaccatcctggccaacacggtgaagccccgtctctactaaaaatacaaaaaattagccgggtgtggtggcacacacctgtagtcccagctactttggaggctgagctaggaaaatcgcttgaacccaggaggcagaggttgcagtgagctgagatggcgccactgcactccagcctgggccacagagcaagcccaagactctgtctcaaaaaaaaacaaaaacaaaaacaaaaacgtgggctgcagccaggcacggtggctcacacttgtaatcccagcactttgggaggctgaggcgggcagatcacggggtcaggagatcgagaccagcctggccaacatgatgaaaccccgtgtctactaaagcaacaaaaattagccaggcgtggtggcgggtgcctgtaatcccagctactcgggagggctgaggcaggagaatcgcttgaacccgggaggcggaggttgcagtgagctgagatcacgccattgcactccagcctgtgcaaaagagcaagaacaagactccatctcaaaaaaaaaaaaaaaagtgagctgggagacaggctctgtctgcccaccacagggggaccaagatgcaaacccctaggccggggtgcagtttctccctcctcctctgcttgtggacattggggatggactgttctctgggatgggtcatcctgggcactacagggccctcagcagcgtccccagcctccacccgctccatgccaggagcaccccccagtcatgacaaccacagatgtccccggacgtggccgtgtctctggaggcgggatcgccctggaggagacccctgggctgggcaaagatcccactcccgcagcagcgattcctacgcagcccacacaacccaaggaccaggaacttcaaccgggtccggctccaaggctgaactcagaggtggggctgcccctgtgaggggtgagggttgtggggtgatgcggggtgcggggcccccagggtgtggaggggcagagcagggctcacttggcttgttgcttctcctcgggccgcactctcttctccttctggccaggtttcctggcgggctctgtgcttgaggactgcggcttcttcgctgatttcttggcctatagcagtcaggaagggcgcgctggagcagtgggaagaggggattacccagacccctagcccatcccactaccaggagatgcagctcgaccctttctgtcgccctccacactgtttgaaggtgctggggcaggatgggagaggagggaggacccagtgtccggtcctgagtggatcgtggggttcttggagcccaggccccattcagtggaggaacagcccccttcactcctcctgcccagcagtcctgggctgtggctgaaacgcctcctgcaccaggagttcggtgccctttctgtgatgaagggagtgacagagagagaacacggcgctgttcgtgctttccccaaagaaggcaggcctggctgaggggcaccagcacgtgggccccaggcactcagtctaggtgagactctggattcaggccacattgcctgaatctccacaagggtagagggcgtgacagggcccgcagcaccacacgtggtataggagagtcctgacagtcaccaccctaggaggcctcctacctgctcccacgctcacctgcaagctgtaccccatggcagccagagggcacccgagagcacccgagtgagggcctgtccctaccctgtccagtgccctccatggctcccacctccctcagggtcaaagcccaaatcctccctgcagcccacatggccctacccggcctgctctgtccgttccccaccgccctccttttccctctctcccctcctccctccactccagccccagaggccacctcgctgttcctccagcacgccaggcgcagtcctctgggcctgtgtgtgagctgcttctcctgcctagaatgtatcccctcccaggagtcttcgtagatcccctcccttcattcggagcctattttttttttttttttttttttttgagatggagtctcgctctggcccaggctggagtgcagtggcacaatcttggctcgctgcaacctctgcctcccaggttcacaccattctcctgcctcagcctcctgagtagctgggactacaggcacctgccacaacgcctggctaatttttttgtatttttagtagagacagggtttcaccgtgttagccaggctggtcttgatctcctcacctcgtgatccacccgccttggcctcccagagtgctgggattacaggcgtgagccactgcgcccagcccattcggagccttttacttaaacccaaacgcaagcctttggagtctactcacaccttcagggtctactctatttaaaagagaaaccccccaccccactttactcttctccttagcaccgaaaactccggacagcacgcactaccctcatgtcatctgtacagctcctccctcctttgttttgttttgagacagggtcttgctgtgtggcccaggctggagtgcagtggattgatgacagctcactgcagcctccaactcctgggctcaagcaatcctcctgcctcagcctcctgagcagccgggactatacaggcgcacaccaccacgcccagctaattttttaaggtttttatagagacagggtctctctatcttgcccaggctggtctcgagctggactcaagtaatcgtcccacttcagctgcccaaagtgctgggataacaggcgtgagccaccaagcccggccccctccctcccatgaatgtcccctcctccagggcaggagtttctgggcccacgcactgctttcttgatgggtcccggaacctgggatactgcctcctacctagtagatgctccataaacgtgtggagtgaaggcagggactcccggcgccctcccggctcacctctctctccagctcggcctcgggctcggagtcagaggaggacgggggaccccggccccggcccttgcgtccccgcttcttgacgggctcatcgtcctccctgagctcgtccccgctgctgccgccgctgccccgctcagcctccccgcggtcggcccgctcgcgcctccgctccttctcctccttctcctgctcccgcaggcgccgcagctcctcctcctgctctcgccgccgccgggcctccagctcgcgcctccgcgcctcgtcccgccgcttccactcactgatgcggtccacctcgtcgctgtcactggaggcggagggggcggttggggacctccgttcctccctcaggagcccgccctgcccctcagccgatggaggagccgccagaggggaccccagccccagcacccacctgtcactgctggagctggacggaggccgttcaggcttcggtttccgccctcgcggcttcgggagaggcttctccgctacaggaagaggaggagggggtgaccttcccttccagggctccaaggtgaccaggggactgcctgggagcgccccggcaggggccaggccaagagatgtgcgagcacgagggccctacctggcttcctgcccctcggaggcttcttcacagacacatcggagtcggaggaggaggaggaagaggaggaggaggacgccgaccgcgccatggccaccggctcaggcttggccccgtccgaatcggccttggagtcggagtcggaggctgatggcgccttctggggagaagcagggacaggcgtgagcatcaggagccccaccgtgagaagcggggcgcaccaggccagaggaggctcccgcacccctgcagccgccaggctctgcgggcctcggctcagggcccggctccgaatcccctcccacccacaaaacccacctccaccccaagtgaaaaccgggatcccaggcggccctgggcacgccgggcagctgctggcccttcccctcatcttcctcagtgaaccgggtacatcagaagcccgggtttcccagtggggacatctttttctttatgcaaaatcttgtgcggaggccacatcagacaagctgccgtgctctaccgcctccacccgagtaccctgccaaacacacacgccacacacagacaccacacacacaccacacacacaccacacacagacaacacacacaccacacacacacacagacaacacacataccacacagataccacacaccacaccacacacaccgcacagacacagacaacacacacaccacgcacacaccacacacagacaacacacaccacacagacacagataacacacacaccacacacagacaacacacacaccacacaccacacagataacacacacacaccacacacagacaacacacacaccacacagataccacacaccacacacagataacacacacgcaccacacacaaccacacacacactacacacagacaccacacaccacagacaactcacacgcaccacacacacacaccacacacacagatacacaccacacagacaccacacacacaccacagataacacacaccacaccacacacaccacacacacacagacaacacacacaccacacagataacacacacagaccacacataacacacagaccagaaacacacaccagacacaccatagacacagacacaccagacacacaaacacccaacacacatacaccacacacaccacacaccacacacagacaacacataccacacaccacagacaacacacataccagacacacacaccacacagacaacacacacaaacaaaacacacaccatacacagataacacacagacaacacacataccacaaaccatacacatggacacaccagacacacaaacacacacaacacagacaccacacacagacacacaaacacagacacatagatacatgaacagtatgcacacatggacacacaggcacacacacaggcaccacatatactcacataggaacacagaggcacaacacatagacgcagaggagaggtacagcacacacacacacaggcatacaggcacagggacacaggcaccagaaacacacacacaggcacgacatgtgcacacacgacacacacatcacacatgcacaatctacacacacactgcacacatacacacctacatggtcacaaacatgcatacacacaagtacacacacacacatgcacgtcgacacacgtgcacagagacagaacacacacacacaatccgctcatatacacactggcacacacctctctcctctcttctgtgtccctctcgcgctcttgctttctcactctctcactctcatgcaggcgcgtcaggactgcttccctcccttctgatgccagcatcccagaatgcccctttccaaaccagatggtgggctcctggaggcagtgcggccataacgaggtgccacgctcagggcagaggcggtcccctcgggtaccctgcagtccgtgtcccaccccctccagaaatggcccgccctgccctggggacagcactggagaccgcagaggtgccccacgagtgggcatgggaaacaaagtcaagtgcacgctaccttttttttccgtccccccagagggcccctccgtggcgcccggaccgctgctttcttctcaggtgtgaagtcctgggggagagaagtgagctgaactggggcccactggcagccaccacgcttccctgccatcccaaggagccactggcccacctggtcgctggtcttctccgactcagatgagctttccgagttctcctcttcggatggggacacgctggcctgatccaggtcgctggaggcctttcgggctcgtttcgagaccgacatctggaaggggaacggcctgaatgctcagtgatgggaaggccgggctcctggcaggaagcccccagctgactgcccaccacccacgacagctgagctctggaacctctctggcgggccaggaaccctctgagaacctgatcaaaccagggatcttgaaccttgaggacattatgcttggtgaaagaagccagtcacaaaaagacaaactcttataggaggtccctagggccatcagactcacagagacagaaagtaggatgaggggcaccagggctgcgccggggggggtgggggggtgggggggtgggggggtgggtggtgggagtgagtgtttcatgggacagcatttcagcttgggaagacgagaaagttctggagatgatggtggtgatggttgcacaaccacgtgaatgtgcttaatgctgctgaacggggcacttaaaaatggctaattttggccaggcacggtggctcacacctgtaatcccagcactttgggaggctgaggcgagcagatcacctgaggtcgggagtttgagaccagcctgaccaacatggagaaaccccatctctactgaaaaacaaaattagctgggtgtggtggcgtatgcctgtaatcccacctacacaggaggccgaggcaggataatcgcttgaacctgggaggcagaggttgcggtgagccgagattgcgccatcacactccagcctgggtgacaagagtgaaactccatcccccacccgccaaaaaaaaaaaagagaaaaaaaagaaataatccttccttggctcagaaacccctcatatactacaggtattttttccaaattctctctgttctttgcattttccaagttatctactataaatatggcttatcattttagaatcagaaaataatacaaagtacacgtgactctatcaaaagaatttgctgctagaatctggtcctttgtttctacacccaaatagtgagaaatggtcaaaaggcaggacagagaatatacccaggagaatggaacacacacatctgcacaaaactctgtacagaaacgttcacggcagcctgatctggaatggcccaaaagtggaaacaacccaaatggccagcgacatgtggatcaacacaccgtgttccctccacacaccggaatctgacccggccaggaaaaggaagggaggcagccaggcgcggtggctcacgcctgtcatcccagcactctgggaggccgaggcaggctgatcaggaggtcaggagttcgagaccagcctggccaacatggagaaaccccgtctctaccaaaaacacaaaattagccggacgtggtagcgggcccctgtaatcccagttactcaggaggctgaggcaaaagaattgcttgaacccgggaggtggaggatgcagtgagcagagatcatgccattgcactccagcctgggcgacagaactagagtccgtctcaaaataaataaataaatgaaacgaatggagctgacccgggctgcagtgcggatgcaccctgaggacgtcacgcttggtgaaggaaggcggacacaaaggctatgcagtgtgtgaccccatttctatgaaatgcccaggacaggcccctccacagaggcaggaaggggatgtgtgggtgccaggggccagaggaggggatgcggaggatcagctgatggggaccaggtttctttttggggtgacggaaatctcctggaataatggtaatggttgcacaattccgtgaacacactaaaaaccactgaggtgtatattcaggaaggatgaatctcatggtgtatggactataactcaattttttttaaatgcatactgaaaaacaattatattaaagaaagggaccaggccaggcaccatggctaacgcctgtaatcccagcactttgggaggccgaagcgggcggatcatgaggtcaggagatcaagaccagcctggccaacatggtgaaaccctgtctctactaaaatacgaaaaattagccgggcgtggtggtggatgcctgtaatctcagctacttcggaggctgaagcaggggaatcacttgaacccaggaggtggagattgcagtgagctgagatcgtgccaccgcactccagcctggcaacagaatgagactccgtctcaaaaaaaaaaaaatatggtggtggtgcccataatcccagctactggggaggctcaggcaggataattgctggaacccagtggcagagggtgcagtgagccaagatcgtgccactgcactcccgcctgggtgacagagggaactccatctcaaaaaaaaaaaaagaaaggtggccaggcgcagtggctcaagactgtaatcccagcactttgagagaccgaggcaggcagatcacctgaggtcaggagttcaagaccaacttggggacctggtgaatccccgtctctaacaaaaatacaaaaattagccaagtgcggtggcaggtgcctgtaatcccagctactagggaggctgaggcagaagaattgcttgaacctgggaggcggaggttgcagcgagtcgagatcacgccactgcactccagcctgggcgacagagtaagaccttgtctcaaaaaaaaaaaaaaaaaaagggcaggagagcaagctgccaggcgagacatcagggcaaggggatgaagggccagcccaccttggtcctcccctacctttagcgcaggcgtcttcctcttcaggccactgttgtcgctactcttgtctgagtctgagtcgctctccatcctgtcgctggcagctgtggcggttaccgctgtgacggccatgaccccccggtcctcatcgtcctcgtcagcgtcactgccgtcggcggggttggcctcgggggcctcgctgtcggaggagctcactggctgtggg

SEQ ID NO: 7387 - DNA, 4408 bp, Homo sapiens
gggccaaaggtgctgtcggcggaacaggggagctacttcgttcgtttaggtgacctgggtcccagcttccgccagcgggcatttgaacacgcggtgagccacctgcagcacggccagttccaagccagggacactctggcccagctccaggactgcttcaggctggtaagagcttccccctgctgctgccccgtccccagggcacttcttagaacccctgcccaggactcacccagctgcagatactgactgagcacctaggagatgatgctgtcagcgtcaccaatggtcatggctctgtactcatggggcttgcctcctggcaagggggacggagctagatcagatccttaaagacagcgggtaggctgggtgcggtggctcacgcctgtaaccccagcaatttgggaggccgaggcgggtgggtcacttgaggtcaggagttcgagaccagcctgaccaacacagagaaaccccgtctctactaaaaatacaaaaattggctgggagtggtggcaggcgcctgtaatcccagctacttgggaggctgaggcaggagaatctgggaggcgaggttgaacccgggaggcggaggttgcagtgagccaagatggtgccactgcactccagcctgggcgacagagcaagactctgtctcaaaaaaataaagacggtggggacacaaagacagcaaaacaatctgtgtgcagagggggatgtgggctgggcaggaaggccgtccctctgggccctgtcctgaccgatggggagacagctctgcaaagcccccaaaagcagggacaggacagcaagctaccggggagcaagctgggtgtgttcggggaatggaaaggcggcgctgtggctgggtaaagtgaagccaggatgggatccagggagcccgcagggcctggggctgcaacgcacgcaggaaaggacccaacgcaacatgactcggatgcatccaggggtcatgcaccctggccagagtcgtccacccctcccactggccccgctctcttcctctggcctaggttctcccctttggcaatgtggacgttggggccggatcgtgctctggggtgggatcatcctggtccctgcagggagctgagcagcgtccctggcctccagtctccccgtccccagtcctgagggccaacatttcctctagaagctgttgtgcagcccgggaggcagaaatctcacaggactgctctaggggtttatgttttggagacagtgagacagggtcttgctctgccacccaggctggactacagtggcttgatcatggcccactgcagcttcaacctactggggtcaagagatcctcccacctcagcctcccaagcagctggacaactggcatgcaccaccacgcccagcttagtatttgttgttgtatttttagtagagattagattttgctatgttgcccaggctggtcttaaactcctgggttcaagtgatcctcctgcctcagcctctgggtgcacactaccaaacctggttaaattttttgtagagatggggcctccctatgtagcccaggctggtcttgagcttctgcgctcccgcgatcctcttgccttggcctcccaaagtgctgggatgacaggcgtgagccaccgtgcccagcagtcacaggttttacatgttggtggacagcagtcccaccccggcgggccgtgagaaaccttgagatgccgccctcggtcaggattcctggcgtgcagcctaggccactgtgttttccatcaacatccggggtttgtgacaagccgcagtttgagggtctaacccagggttctcagtgtggatgacctgcctccaggggacactagtccatgtctggggacatctgtggttgtcacaactgggggaagcccctggtggagagtagggacactgctcagcaccctgcagtgcccagggtggccccaccccagagaaccatctagcccccgtgtccacagtgccaagggcaagtctgtcctagggaccctcaggacacctcatgtcactgtggccacccccagatgcacagtcgctgccgtgcctctggcacgcggtacaatggcgcagttggaaggcgttcctgtaaacgccatggaggaatgaaggaatgggcccaccctcgcagcacgctgcaagcggctgatcacaaagcattttcccacctttgaatcctcacagcaaagtagcctgggccagaactcagcccaggcactcttcagaaggggagaaggaggccacaggaagagaagagctttgctcagggccacacgtgaaggatgctgggctgggaaatgggatgtggtgtgtgactcatcatgtctcacttgttcctttaagtgctactgaagaccctggatatccaggcctgcccttggggggtggggggcgccatggttggggaagacaattcacagatgaatatatagggcgtcgcgttggatgatgcttggaaaatggaacatgtaccaggataaggaagtggctgtgctggggctggtcaccctgaagaggggacacttgaagtcaggtctaaatgacagagagggagtgcgtcagaatgggcaggagtgtgatctgagcggagggcacggcccgtgcaaaggccctggggcaggactgtcccggcatgttggaggaataggaaggaggcctgggaggctggagccgagtgaggaggggatggggcaggttgggccggacctgggcttcgaccccaagggagttgggagccctggagggctctgggcagaggagcggcctgatccaaggtgggtttcatttaaaaggatcactctgatgggggaggtcaggccaccgggtgggggcgagggccagaggagacagtgggacgtaaacccaggcaagtgctgccgggcctcaggagtcacgctgtggtggtgagaagtagctgggctctgggtgtttcgaagtcagagctgcccgggtccgatgtgggaggtgagagaagaccccaagagacccctgaggcttgtaacctgagcagacaaggagagcaggggggctgaggggaggccgggcgggttgcagagtggatattaggagcctggccttggacagggtgaggggagatgcctggtgggcaccgaggggacgcgtctgcatatgcagctggcttcaggtctccagcactggcgcggcgagggctgggagggcgacagcagtctggagtcgatattttgacggcgtgccgcatccctaccagccattgagatgatgaggaagatggggccctgtggacagggtggggcgtgggtgccacgtgctggggacacagcaacaacgaggacagagtcctgagtgttcccctgccaggggcggataaacaccaagtcaatgaacaccaaagccgcacgctgtgctcccgaggagaggggcagatgtgacgggagggactggggctgccacaccatgggccaggaaggtctcaccaagggtcacctggagctgaggccgaacgcggaccttgtgaagggcccgggaagcaggctcccggctgagtgggcagtgtgtgcaaaggccctggggcagaagcctgctggagtggccggagggcagaatggagccagtgtggcctcagtggagacagcagtggggtgccatgggagatgaggccagaggtgtcccaggggccagcccaccaaggccatggtgaggagctgggttttatcttaagggtactgggcagccacaggtttaggggtgaggagtgacacgaccccacagacactgtgttacgtgcactccctgatgacctcatggggaagtttgaactattgcctctttctgcaagacaacacgcccactgtggtacaactgacttggaactcgtggcctttctcccaggactgtgaatgtgcccaggtccctgggggagggggaggtgggggttgtgaaaggtcatttgccaagaagccatcatttccccactgtactctctctccagattgaaaaggcccagcaggctccagaagggcagccacgtctggaccagggctcaggtgccagtgcggaggacgctgctgtccaggaggtgggtctggcacagggctagggtccccccaccccgcccatgggtctccactcaccttgcgccttcctcccacaggagcgggatgccggggttctgtccagggtctgcggccttctccggcagctgcacacggcctacagtggcctggtctccagcctccagggcctgcccgccgagctccagcagccagtggggcgggcgcggcacagcctctgtgagctctatggcatcgtggcctcagctggctctgtagaggagctgcccgcagagcggctggtgcagagccgcgagggtgtgcaccaggcttggcaggggttagagcagctgctggagggc

SEQ ID NO: 7388 - DNA, 385 bp, Homo sapiens
tttttaagtcattcaattatcaggaggaagaagccaagctaggacaagacctctgggcttctaccatccaggcactgctatttctcctacactcaaaatgcccgctcaggcagtgacagccacagaaatcacaaacacctatctgatgcttcttatgtgccaggcacgtgaccgggtcacacactgagccaacgtttgctgagcagtcatgagtgtcgggcactgggccgggggcatcaagaacacagaagtgaccgtggcatctcccttgcccctgggagctggttttctagcgggagaccctgaacattgccatttaaacacagacaattccaaatcgtggtgacaggcaggaagaaaacacgggcgtatggttgtaaggatt

SEQ ID NO: 7389 - DNA, 833 bp, Homo sapiens
gaatatatttgtggtttccttcagctcgatgtctgaagattctcacaggttcagggactattccaagtttgcaacctgtgtgtggattttgaaacaaatacagacaacttatgagacggtttctttgctgggcttcttgcttgacacagttttctgaaacatggctctggcaggcttttttcttccatggacacattgctgccgtttatcactgaagttcctctgtggagttaccaggagctaatatttggatgatgtacttttcttgcagaaaatattagcaaatgttgcagaaactgtgctttaaaaacttttaaaaggggaatggattcccagtttaaaaataagcaaaagaaaggataaacatgatttcattgatggtgtgcaactgctttagaacatcagatattttgtgatgtgaaatgggatgatactctattttacaaaatgtgtactgcttatagaaaatgtatttactgtaccactaagccaaacttaggtgttgctttgtttccttaaaatattttttgagtcgctgtggctgccccacagatgatgggggagtaggcattctttctgcccagagcacttgttctcttcctccacccttttggttgttattgtagcatcttgactttcagcttaacacatcccaacttaagcagaagcccttttgccttctctctctttaaaactagatccatagaaattatttttattacagtaatagggcaagatagttttatgtcatatataaactggaattatgtagtgttagtagtagttatgtctcctgaaaggaaccagttgattataaagaagaaaagttaggg

SEQ ID NO: 7390 - DNA, 833 bp, Homo sapiens; identical to SEQ ID NO: 7389

SEQ ID NO: 7391 - DNA, 358 bp, Homo sapiens
tgattgaaactttaaacccttcccttaagttcccctaaaaacctccctgtgcctagtaaggttttgcatgtgtgaggagggtgaaggtatttggaccttggagaaactttgcaatttgaaatctgcctatgcagttgtacaccagaaatgaacatggtcaatgccatattgtgctctttgtctttttcttctaccaagattcctcacccctaggagacgttggttaatataggcatttcggtttggttaatctgatcatgagtgcccgtgagcatggcatgaggcatgattgaagcagttataaaaatttggctcagagttaagccctataatttgttttaaagaattacctcttcag

SEQ ID NO: 7392 - DNA, 147 bp, Homo sapiens; identical to SEQ ID NO: 6794

SEQ ID NO: 7393 - DNA, 141 bp, Homo sapiens
cagctactcgggaggctgaggcaggagaatggcgtgaacctgggaggcagagcttgcagtgagccgagacagcgccactgcactccagcctgggtgaaagagcgagactccgtctcaaaaaaaaaaaaaaaaaaaaaattt

SEQ ID NO: 7394 - DNA, 183 bp, Homo sapiens
aatacaaaaaattagccgggtgtggtggcgggcgcctgtagtcccagctactcgggaggctgaggcaggagaatggcgtgaacccgggaggtggagcttgcagtgagctgagatcgtgccactgcactccagcctgggcgacagagcgagactccgtctcaaaaaaaacccacaaacaacaaa

SEQ ID NO: 7395 - DNA, 162 bp, Homo sapiens; identical to SEQ ID NO: 6214

SEQ ID NO: 7396 - DNA, 193 bp, Homo sapiens
aaaaattagccgggcgtggtggcgggcgcctgtagtcccagctactcgagaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaagatcagaaaaaaata

SEQ ID NO: 7397 - DNA, 153 bp, Homo sapiens; identical to SEQ ID NO: 6795

SEQ ID NO: 7398 - DNA, 203 bp, Homo sapiens
ccatctctactaaaaatacaaaaaattagccgggcatggtggcgggcgcctgtagtcccagctactcgggaggctgaggcaggagaatggcgtgaacccgggaggcggagcttgcagtgagccgagatctcgccactgcactccagcctgggcgacagagcgagactccgtctcaaaaaaaaaaaaaaagaaagacatgtaaa

SEQ ID NO: 7399 - DNA, 150 bp, Homo sapiens
ggcgcctgtagtcccagctactcgggaggctgaggcaggagaatggcgtgaacccgggaggcggagcttgcagtgagctgagatcgcgccactgcactccagcctgggcgacagagcgagactctgtctcaaaaaaaaaaaagaattggc

SEQ ID NO: 7400 - DNA, 142 bp, Homo sapiens
cccagctactcaggaggctgaggcaggagaatggcgtgaacccgggaggcggagcttgcagtgagccgagatcccgccactgcactccagcctgggcgacagagcgagactccgtctcaaaaaaaaaaaaaaaaaaaatgga

SEQ ID NO: 7401 - DNA, 105 bp, Homo sapiens
  misc_feature (81)..(81): n equals a,t,g, or c
acccgggaggcggagcttgcagtgagccgagaccgcgccactgcactccagcctgggagacagagcgagactgcgtctcanaaaaaaaaaaaaaaaaaaaaaaaa

SEQ ID NO: 7402 - DNA, 142 bp, Homo sapiens
cctcagctactcgggaggctgaggcaggagaatggcgtgaacccggggggtggagcttgcagtgagccaagatcgcgccactgcactccagcctgggtgacagagcgagactccgtctcaaaaaaaaaaaaaaaaaaactta

SEQ ID NO: 7403 - DNA, 368 bp, Homo sapiens; identical to SEQ ID NO: 6222

SEQ ID NO: 7404 - DNA, 4704 bp, Homo sapiens
tattattatactttaagtttcagggtacatgtgcacaatgtgcaggtttgttacacatgtatacatgtgccatgttggtgtgctgcacccatcaactcgtcatttagcattagatatatctcctaatgctatccctccccactccccctaccccacaacagtccccggtgtgtgatgttccccttcctgtgtccatgtgttctcattgttcaattctcatctatgagtgagaacatgtgctgtttggttttttgtccttgcaatagtttgctgagaatgatggtttccagcttcatccatgtccctacaaaggacatgaactcatccttttttatggctgcatagtattccatggtgtatatgtgccacattttcttaatccagtctatcattgttggacatttcggttggttccaagtctctgctattgtgaatagtgccgcaataaacatacatgtgcatgtgtctttatagcagcatgatttacaatcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctcagcacctgttgtttcctgactttttaatgatctccattctaactgttgtgagatggtatctcattgtggttttgatttgcatttctgatgatggccagtgatgatgagcattttttcatgtgttttttggctgcataaatgtcttcttctgagaagtatctgttcatatcctttgcccactttttgatggggttgtttgtttttttcttgtaaatttgtttgagttcattgtagattctggatattagccctttgtcagatgagtaggttgcaaaaactttctcccattctgtaggttgcctgttcactctgatggtggtttcttttgctgtgcagaagctcttcagtttaattagatcccatttgtcaattttggcttttgttgccattgcttttggtgttttagacatgaagttcttacccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagcaggttttcccagcaccatttattaaatagggaatcctttccccattgcttgtttttgtcaggtttgtcaaagatcagatagttgtagatatgtgacattatttctgagggctctgttctgttccattggtctatatctctgttttggtaccagtaccatgctgttttggttaccatagccttgtagtatagtttgaagtcaggtagtgtgatgcctccagctttgttcttttggcttaggattgacttggcaatgtgggctcttttttggttccatatgaactttaaagtagttttttccaattctgtgaagaaagtcattggtagcttgatgggaatggcactgaatctttaaatgaccttgggcagtatggccattttcacgatattgattcttcctacccatgagcatggaatgttcttccatttgtttgtatccccttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagatgatggggttttctagatatacaatcatgtcatctgcaaacagggacaatttgacttcttcttttcgtaattgaatgccctttatttccttctcctgcttgattgccctggccagaacttccacactatgttgaataggagtggtgagagagggcatccctgtcttgtgccagttttcaaagggaatgcttccagtttttgcccattcagtatgatattggctgtgggtttgtcatagctagctcttattattttgagatacatcacatcaatacctaatttattgagagtttttagcatgaagcattgttgaattttgtcaaaggctttttctgcatccattgagataatcatgtggtttttgtctttggttctgtttatatgctggattacgtttattgattttcgtatgttgaaccagccttgcatcccagggaggaagcccactagatcatggtggataaactttttgatgtgctgctgtatttggtttgccagtattttattgaggatttttgcatcaatgttcatcaaggatattggtctaaaattctcttttttggttgtgtctctgccaggctttggtatcaggatgattctggccacataaaatgagttagggaggattccctctttttctattgattggaatagtttcagaaggaatggtaccagctcctccttgtacctctggtagaattcggctgtgaatccatctgttcctggactttttttggttggtaagctattgattatttcctcaatttcagtgcctgttattggtatattcagagattcaacttcttcctggtttagtcttgggaggatgtatgtgtcaaggaatttatccatttcttctagattttgtagtttatttgcatagaggtgtttatagtattctctgatggtagtttgtatttctgtgggatcggtggtgatatcccctttatcattttttattgcgtctatttgattcttctctcttttcttctttattagtcttgctgtctatcaattttgttgatcttttcaaaaaaccagctcctgaattcattaattttttgaagggttttttgtgtctctatttccttcagttcttctctgatcttagttatttcttgccttctgctagcttttgaatgtgtttgctcttgcttctctagttcttttaattgtgatgttagggtgtcaattttagatctttcctgctttctcttttgggcatttagtgctataaatttccctctacacactgctttgaatgtgtcccagagattctggtatgttgtctttgttctcattggtttcaaagaacacctttatttctgccttcatttcgttatgtacccagcagtcattcaggagcaggttgttcagtttccatgtagttgagtggttttgagtgagtttcttaatcctgagttctagtttgattgcactgtggtctgagagacagtttgttataatttctgttctttgacatttgctgaggagtgctttacttccaactatgtcaattttggaataggtgtggtgtggtgctgaaaagaatgtatattctgttgatttggggtggagagttctgtagatgtctattagttccgcttggtttagagctgagttcaattcctgggtatccttgttaactttctgtcttgttgatctgtctaatgttgacagtggggtgttaaagtctctgattattattgtgtaggagtctaagtctctttgtagttcactaaggacttgctttatgaatctgggtgctcctgtattgggtgcatatatatttaggacagtttgcttttcttgttgaattgatccctttaccattatgtaatggccttctttgtctcttttgatctttgttggtttaaagtctgttttatcagagactaggattgcaatccctgcctttttctgttttccatttgcttggtagatcttcctccatccctttattttgagcctatgtgtgtgtctgcacgtgagatgggtttcctgaatacagcacactgatgggtcttgactctttatccaatttgccagtctgtgtcttttaattggagcatttagcctatttacattcaaagttagtattgttatatgtgaatttgatcctgtcattattatgtcagttggttattttgctcattagttgatgcagtttcttcctagcctcgatggtctttacaatttggcatgtttttgcagtggctggtactggttgttcctttccatgtttagtgcttcttccttcaggagctcttttaggacaggcctggtggtgacaaaatctctcagcatttgcttgtctgtaaagtattttatttctccttcacttatgaagcttagtttggctggatatgaaattctgggttgaaaattcttttctttaagaatgttgaatattgccccccactctcttctggcttgtagagtttctgccaagagatcagctgttagtctgatgtgcttccctttgtgggtaacccgacctttctctctggctgcccttaacattttttccttcatttcaactttggtgaatctggcaattatgtgtcttggagttgctcttctcgaggattatctctgtggtgttctctgtatttcctgaatttgaatgttggcctgccttgctagattggggaagttctcctggataatatcctgcagagtgttttccaacttggttccattctccccgtcactttcaggtacaccaaacagacgtaggtttggtcttttcacatagtcccatatttcttggaggctttgtttctttttattcttttttctct

SEQ ID NO: 7405 - DNA, 2523 bp, Homo sapiens
atttttataccattttacaggtgaggaaatttaccaagtttaaataatttacccacagtcacagtaaagtccccaacctcaggtagtttataatgaagtggaggagacaagatgcataaagaagtgactattaatagtaattttaaaacagctattacaaatcagcataaaattatatgccatgcagttaacgaatgtcctgaattaaaaagagtgtctctactgctggaggcttcaataattaaacaaaataatgtatgttaatttgaacacagtgcatgatgcgttattatatttacttctattattattaattatggataagatgtggatgggtgcagagagagagtaggaagaggtacctcgtatatagaatctggaaaaaaaaggtagaattgtggacgacagtaggggtggccagaatatagtttgtatagcatagtgataggagataagattagactggtagattgtagctttatcttagaaggctttgtatgtcatgctgaaatataactgagccttccacaggctaaatggctaaattcgttgtgcggcattccatcctctgcttaagtggcttctggtgacagggctctcacagaaagcctcattaggaacagatttttttcctttggaggatttttttatattaggaatcaccttttattgaagcaaatccatctcactgtagatttcactccttgaaattaggcaaacaatgtagttacatagagtgaatctgcaggtcagacatttgaggatggctgtcatgcttctctaggttttttcataacctgggctactattaccagttccttcacccaaactatattaagcttgacactgaattcctctcttttaagtcagtttgtctggcagctctcctggaattaaattttgattctttcagatgactacacattaaatggtgatggattgggttttgttatttccagactatatatttttgtttcatctataattcctagcattgcttggtcataattttttttcttagaaccgtgattatatacattattaattagttttaaaaatcaaatccgcaagggtaatttaatcccagaatgaaaatgacctctatataagtatttcaaaaatcatttatttgtaatgagtaaaaatgttgaaaataaggcttacttttattatttgaatatggtaattatgtaattatccttttaatatgttaaggttatattctgtgccttagagtatgctaagcactttatacataattatcttatttaagcctcgtagaaatcttatgagcaaaatgttactcggtacacttaaagtacaggtaactgaggcttagagatgtaaaataatttgtccaccacagtgcttttaaaagatgctcgtaaccactatattgtaatttcaaaccctgattccattaatgctttttgttgtgttgcctttactgataattgtgttcaatattcccatgagggaggcagtctttgactttttatttatgataaagattattaaagtgcttaaagttttttattgtatagcgtgttttatcatcaaacaggttttagttttttaagttaaactgatcaaaaataataaaagctgatggctctatgacacttgcatttgagagaacaagaatagggagcaatatttcaagaaaatcattcttactgtttttcaaaactgtttagtgtcagagatgccccaagaccactcctaggtttattgtttcgatagaaggacttacaggattagtatatagttgcactcctgactaagatttattatagcaaaagaatacacagcaagattagcaaaggaaaaaggtgcatgggaccaagtctggaggaaatgagtctcgaactcctgacctcaggtgatctgccagccttggcctcccaaagtgctgggattacaggcatgtgccactgcacccagcctgaaagtattacttttaagaattgttattatactttacttgaaagaaataaccactgctatagtattatatcataccaaagcatatattttataatttgggctacctagaattattattttttttttggaaatgatgttatatgtagttataaatcacaaatgacttggtaataaaggccatatgatcttcaaaaccaaactggaactagcatagataagacctgctgtttaaacaggtaactcttggttgagagaagataatggcagtcttgtctcttttttccctttattatgaatgcataacactgggtgttctgttaggcaagggttgtttcttgtttattgttttgtggccagtgcatagcacaaccaacgtttggcatatagtaggtgcttaaatatttatgaatgagtgagtatgtgagtagaaggagtaactgggctgggaatgatggctcacacctgtaatcccagtgctttcggaaactgaagtgggatgattgcttgaggccaggagttcaagaccagcctgaggagcatagtgagacccctgtgtctacaaaaaaaaaaaaaaaa

SEQ ID NO: 7406 - DNA, 2523 bp, Homo sapiens; identical to SEQ ID NO: 7405

SEQ ID NO: 7407 - DNA, 186 bp, Homo sapiens
actctcaggagccttctccgcagttggcttcctcggtagcttccacacggagcatgcccgagagcctggacagcccaacctctggcagaccaggggttaccagcctcacagctgcagctgccttcaagcctgtaggatccactggcgtcatcaagtcaccaagctggcaacggccaaaccaaggag

SEQ ID NO: 7408 - DNA, 931 bp, Homo sapiens
gttttgattcatcatttttatttgactcactagcagccatctgttagttacaatttaactttcaaggatctgcgtaatttgttttttgttaatgaagtgctataaacagcattatgaaggttttctcttttaatcttgaaaggaaaaaaatccgtctctaaaaaagcaatcacaaagaagaggaaaactgtcataaagtcacctactgtaccagagtttcaggtaaatgtttcaactttgtctcgaaatttttcaattttttgtttcagtgttcatatcattcctcgagagtttggctgaattccaagaaactgtagcacacttacttgtaatgaaatgtttctgacagtgacttttctccctgcaagtgcagatgtaaccaagatttaatctgctagtatttcgtaatttttacctctatttttgtcttttaataataaaaacccttttttatatcttaatctctactagtacatttcctagaagcagtttaatagaaataatatatatatactatatagtatatgtgtgtgtgtgtgtatgtatatatatataatacataaaagcaaatgtgtgaatgaaactcttccaagaacaaatcataatttggagatggtaatagtgcctagatagttcgttttcatttatttgggcactgtagaaataaatggtagatttattaacttggaaaacaaatctttcaactcttagctgtatatgatcttcagagagaatattaagtaaaggttaattgaaatggtctttaaacatttctgtggaaagaaaaagtaattatctgtactgccatatgattaagtgaagagttttttatttgtagctaatactaagcagagaatctcaccctaattaatgcttttattttctattttataaaagatgtattttcttcaataaacactttctttaaaaa

SEQ ID NO: 7409 - DNA, 931 bp, Homo sapiens; identical to SEQ ID NO: 7408

SEQ ID NO: 7410 - DNA, 931 bp, Homo sapiens; identical to SEQ ID NO: 7408

SEQ ID NO: 7411 - DNA, 1062 bp, Homo sapiens
tccacctcagcctcccgagtagctgggaccataggcacacaccaccatgcctcgctaatttttgtattttttgtagagacagggtctcgccatgttgcccaagctggtctcgaactcctgggctcaagcaatcctcccacctcagcctcccaaagtgctgggattataggcatgcatcaacatgcccagcctgttttttgttttaatctgttattgagtaaggtgcaatttgtggctccatatacagggacaggttgcaaaacaggtactgagccgtgtgtatccttcaggtccaagcagcttctaaactgtgtctatctctgttcaggtccctggaactctcctgggcagcaagctcacaagagaccgacctctgtggccttcgaagcgggttgctgttagacacaccttttagaagctacattcatagtatctcaaaagacagacataaggggtactcggtatggccaccactcactcccacaacacagccaccatttcccacccagaatttcctgtgaaatgtgctcattttaaaacagcacacatcctgagaattgcaaagttgggcatagagatcaatacaaattagacttctttttagatacgctctacgctctgcagagccctctggggtctccaagggctgggacctgctggataaaactggatgaaactaagttgctgcttctttggtgcccttgaatggactttcttggctgcagtgacgttaggtccgcttcctagccgcgtgctgctctgccatcggggatgctaaagtcggggagggccaggaagcctttctttgcttggaagtttttgtttctccttcgcctgctaggttgggataatccgttgggaagtctctgagcgtctttaaacataaaatctagtttcaaaggtttaaattcccaagttgccccctaagttacatgttgcttaggcttggttgctatctgtatggtataaataattccatttagaaattaagaaattatgggctgcatttttgatgccagtggctctgtagtatcccccaaccaccaaaaaaaaaaaaaaaag

SEQ ID NO: 7412 - DNA, 1062 bp, Homo sapiens; identical to SEQ ID NO: 7411

SEQ ID NO: 7413 - DNA, 124 bp, Homo sapiens
atggagtctcactctgtcacccaggctggagtgcagtggcgtgatctcggctcactgcaacctccgcctcccaggttcacgcaattctcctgcctcagcctcccaagtagcttggactacaggc

SEQ ID NO: 7414 - DNA, 512 bp, Homo sapiens
gtctttggacatgctgtcttgtgtggctgagacgtagatcaagagaaatttgtaagaaagacaataaggtacaaaaatcgccgaagctaatgtcaagatggagataaatagatctatatttgccatatatggtagtaaaagaaaagtctgtgcaaatttgctcgacatttatggacttctatgattcatctaccagggccagcagctccagccaagagatatagaatgtcttcaactgtatttctttcctaaattgtttcattacaaagaagccatgttgtgtattcagaagaaaattccaggaccgcatgaaagtcactatttgggaacaggcctgagaaagcttgcttagaggaattccaaaagtattcaaaaggcagttattgaccaaacacataataattctctaagcatcaacaattttccatagatccaagctcacatatacagcgtattttctgtggctagtcactccagaaatagagggttctctgctttcttgactgattgac

SEQ ID NO: 7415 - DNA, 512 bp, Homo sapiens; identical to SEQ ID NO: 7414

SEQ ID NO: 7416 - DNA, 128 bp, Homo sapiens
tgggatggagtctcactctgtcacccaggctggagtgcagtggcgtgatctcggctcactgcaacctccgcctcccaggttcacgcaattctcctgcctcagcctcccaagtagcttggactacaggc

SEQ ID NO: 7417 - DNA, 5823 bp, Homo sapiens
ttgacataaataaggtagtagtttaaagggaaagtaatgattagcaaaacttatgaagacaggagcgatcaacgcacattaaatagtgtgtaaattacctaatcctaggcttgctgaatcttcagacacgtatatacataatatatttttgtgtcacaaaccagtcactctgtgttttctatatgaagagaaaataggtttgtgttaagaaatgatctctgaatgttcaagaaaataatactatgggcttgcttacatgggtggaagagcaaagaactcctcaaatcataaatgacaggactaagttatttggacgagaaaacaaacaaactcaaaatgacatttatgagagcttatgaagtgaatggatgatttggttgtgattctgtaaaggtaatgaattggaaagacagtgtttcctcttctgcatgtctaaggtacacagcaagcaggagcagattcctcctcataagcattcactccactcagagccatgtagccagcacttcgtcctgagttttatctctcagttttaaccacatatttttttgctagttggctttttttaatatttgaaaaattatatattattttttcccattgaatttttgaaatgttttcattaagttgaggtataacatatatatatgttatatatatatgttatatatatatgttttatatatgttatatatatgttttatatatatgttatatatatatatgttttatatatatgttatatatatatgttttatatatatatatgttatatatatatgttttatatatatatatatatatttttttttttttttttgagacagagtcttgctctgtcgcccaggctggagcacagtggtgcaatctcagttcactgcaagctttacctcctgggttcaaatgattctcctgccacagcctctagagtagctgggactacaggcatatgccaccacacctggctaattttggtatttttagcagagatggggtttcaccatgttggccaggctggtctgaaactcctcctggcctcaagtgatctgctcacctcagcctcccaaagtgctgggattacaggtgtgagccaccgagcccagctgaggtataacattattgatatggtttggctctgtgtccccacccaaatcttatcttgaattgtattcccataattcccacatgttatgggagggacccagtgagagataatttgaatcatgagggcggtttcctccatactgttctcatggtagtgaatatgtctcatgagatctgatggttttatcagatctttctgcttttgcatcttcctcattttctcttgccaccaccatgtaagaagggccttttgcctcccgccatgattctgaggcctccccagccatgtggaactgtaagtccaattaaacctctttttcttcccagtcttgggtatgtctttatcagcagtgtgaaaatggactaatacaataaattggtaccgagagtggggtgtttctgaaaagatacctgaaaatgtggaaacaactttggaactgggtatcaggcagaagttgaaagagtgtggaaggctcagaagaagacaggaaaatgtgggaaagtttggaacctcctagaaacttgttgattggctttgaaaaaaaaaaatgctgatagtgatatgaataataaagtccaggttgaggttgtctcagatggacatgaggaacttcttgggaacaggagcaaaggtgactcttgttatgttttagcaaagagactggtggcattttgcccctgcccttgaaaggatgatttagggtatctggcagaagaaatttctaagcagcaaacagagcattcaagaggtgacttgggtgctgttaaaggcattccattttaaaaaggaaacagagcataaaagttcagaaaatttgcagcctgacgatgcagtagaaaagaaaaacacattttctgaggagaaattcaagctggctgaagaaatttgcataagtgtcaaggagccaaatggtaatccccaagacaatggggaaaatgtctccaggacatgtcataggtcttcacagcagtccctcctatcatagacctggaagtctaggaggaaaaactggtttcatgggccaggcccagggtccttatctgtttgcagcctaggcacttggtgccctgtgtcgtaggcagaaggggcttgccttgtctcatatgagactttggactatggacttttgggttaatgctgaaatgagttaagactttgggggactgttgggaaggcatgactggttttgaaatgtgaggacatgagatttggaggagcaagaggtggaatgatatggtttggctgtgtccccacccaaatctcatcttgaattgtattcccataattgccacatgttataggagggacccggtgggagataatttgaatcatggggggcagtttcccccatactgttcttgtggtagtgtataagtctcacaagatctgaaggttttatcaggggtttccgcttttgcatcttcctcattttctcttgtcaccaccatgtaagaagggcctttatcctcccaccatgatcctgaggccttcccacacatgtggaactggactacgtccaattaaacctctttttcttcccagtctcgggtatgtctttatcagcagtgtgaaaatggactaatacatatatatataaagtaaaattgactattttcagtgaataggtctttgagctttgacaaatgcctccaagttgttataaccaccaccacactcaacatatagagcagaccaggtgttgtggctcatgcctgtaatcccagcactttgggaggctgaggtgggtggatgtcttgggcccaggagtttgagaccagcctgggcaacacagtgagacaccattcctaccaaaaatacaaaaattagctgggcatggtggcacacatctgtagttccagctacttgggaagctgagatgggaggatcacttgagcccaagaggcagaggttgcagtgagccaaggttgtgccactgcactccagcctaggtaatagagcaggactctgtctcaaaaaaaaaaaaagatataaaacagtttcctcactcccaaaatttccctattcctcttgttagcagcttctactcctactcccaaactctagcaaaccactgatttgttttttgtacctatagttttgctaaaatatcatacaaatgaaatcaaacagcatgtagcctttttagtatggcttctttcacttgttataaaataataaaaattcatttatgttgctatgtgttttaatagttcattgctttctatttctgaatagtcttgcattgtatggatgtcctacggttgtttatccattagccagttgaagaacatttggttgttgccagtttgggtgattataaacccactctaaacattcatattcaagtttttgtatgagcatttaagttttcatttctttgatgtaaaatcctaggaatgggatcgtgggctctatatgataagtttattttaactttataattaaccaccaaatttttccaaagtgaaatattatcttgtactgccattgacaatgtatgagagtccttactgctccacatctttgttagtacttagtattgtcagtttttgttttgcttttagacattttaatagatgtctggtattaactcatttgcactttcttaatgactaataatgttgaatatgtgcttatttaccatccatacgtcttcttttataaaatatctattcaactcttttgaccatttttaactgtattgtttttcttattgttgagttttgagagtttggatatgtcctagatatgagtcctttgtcagaaatgtgttttgtaaatattttctgccaggctgtagcttgcattttcagtctcttaacagtgtctttcacagaacaaaagtttttaatttttctgaagtccagttttacctatttttatttatgcttttaatgtcatatctaagaaatatttgcctaacatagggtcacaactatttaccctatgttttcttctggaagtttcataggtttgtgttttatatttagacctatgatccatttttagttcatttttatagaaagaacaaggtgtgagtcaagatttactttttgtatatcaatgtccaatcatttcagatcaatattgaaaagactatactgtctttactgaattacctttgaccatgtatgtataagtctatttctagactctctattctgcccccatttatctatgtgtctgttctttcatcaatgtgacactgtcttgattacttaggtaagtcctggaatgcaatattctgagttctttaactttgttcttctttgtctgctttggctattctagtgcctctgactttccatatacattttacaaacagtttattgatatttattttaaaaatcctaaaggagttttgatttggatttgtggaatctctgtatcagtttgttcagaattgatatctcaacaatatttagtctttgtgttaataaacacagtatatgtctctatttaggtctcctttgattttttcaagagtgcttgtagttttaagcatatgagtggttcacattgatagtatctaagaatttcatgtttgtggtgttactgtaaatgacacagtgttttaatgtttgtcttcagttgcccattgctagtatacaaatttgtatattgtctttgtatcctgcaatctttctaaaactcactcatgagttctagtagctttgtagtagtttcctgaagattttaagtctaaaatgttaaggaaaaaatacattttaaaccaagaataaaaattctattgcatattttaaaatcaggattgcaaggacaaagattgtctctgattatgcagttctatttacaggatgatataggtggcttagcgggccaagctttgactctcaaacatgtgggtgttgaatccttatccacttgctgctgcatgtgatctgagatgccttgactacgttatgggcttttccatcaaagtctatgctttaacaacagaaagcatcttccagacatatcatagggatgagcaagtacaattcatgtgaaatcattcagagatataaagttcaggataataatactagtgtcgtccagaaaaatcaggaagtcttctcttgtagagcacatgacctgtcatgatatagcccgtagcaggattcgtccatacatacccccaaaggcattaccacatcaccgtggaataaggctgcaatactagacaccacagtgctcctgataagggcccggcttgtataaaaatggttagagtggcaggaagttgttataactggaataattcttatggcagctatgtctccaaaaatattacgaagcaagaaaaacatttggctggaggtgtgcgaactgagattctcagggcgtaggagctgtgtgtagaacagaggccaaaggagtagtcatacccggggtggatcaaaggaagaagcagaggaggtagacagatggaggtggcttggctacaaagaagtgtggagtttctttcccttcctcttgagatccaccaagacacagatttccagctttgcaaaagcagaaagcaggcagaaggaagatctccagtccgcggggaacggcagcacttttaaaactttgagattgatgagtggttaattagaccctcagccactcctatggtaagtcatgatggatgccaagacagcagtaaggggttgtgattttctttgttttcttccttgtgcaccaaagacacagagatggagctggtctcttgt

SEQ ID NO: 7418 - DNA, 355 bp, Homo sapiens
gagccaccacccagccttttcattgattctttaattgacagttaatagacatactcatgtcccttatatctaaagttataaccaaagcttttaacttcttctcggattgtccttatctagtaatgaactagtcaggaccccaacaatgagcaggtggcaggctcaaggccatttacagaggatttgtttctaacagtgctcattgcaaaggtgcaggcaggacagggggtggccacgaggaacggtgcacagtgcaagagcccagggcttgtagtggcacagctgtcactaccatgagcccaaagggacaggccaaggaagagagtgccagagcccaggaggagagaggagcctc

SEQ ID NO: 7419 - DNA, 36192 bp, Homo sapiens
cttcctcagttcccttaaagcacagcccagggaaacctcctcacagttttcatccagccacgggccagcatgtctgggggcaaatacgtagactcggaggtaggcatccgtgggggggcgccggctcgggcgtgcggggagtgtccgcttctgctatctgcctctccaaatatcccgactgctgccctggccccagccctctctccacttcggagcactcctctggcgttggcaccgctgaggaatgggcctgggcggggaggtgaagagaagccaggaatgttttatgttttcctaatggagagggggcctagggagcccctgagctaggaggacacggaaaaggggattggggtcctgagattgggtctgttgggcccaggacgcgttttctggatgggtctaggatgctcccttgtcgcgggacccccgcggtccggccctgcctgctgggggttcgaagaggtggagtgcagggtggaggtgttatttacccgagtcctggggacagtccccgggactctccgccaggcgcccagaccggcaggtcccgcaggcggcgcgcggtgtgtttgcactttccaaagttcttgaaccatctcaagaactccttctgcatcttggcgtctggcaggggtgttccgagagaggtagacctcccctccccaaactgccaccatcacttccaacgccctccacgcgctggagctctgcccgggtgtggaaacctcgtcttccaacacgtagctgcccttcagccacccgcccgcagcctgggagtgccctgagggtgggtcgggggagctgcgcaggtgagactgagttctaggacatttagggggtctggtgcctggctccgccaaaaatggggactttcgggattgtgatcatcacggcggattgagcagggagagccgtggagggacaagagagggccgaggcagggtggggggcgcgggcaggtgcgagggggatgcggccaagaagcagcgataaagggaacattccacgggtcgggcggctgctgttggatcttagataaagctggaagggattaccggggcaggggtaatagggaccggggacgggaacgcgaaacaggtgaagcgctcagggcgagagcgactcggcttagggagtccgggagaagcctgcggctgccccctcgccgccgaggtcctgcgggtcctgcgggtcctgcgtgctgagccggggcgtgcgcgggcgggggccttcggaccgcgcggcggggcctgccctgacccctggcggcgggcgggggaggcaggcgcgccctgcagagtacagaggggtgtggtgtcctctgcgagatcctcttaaaaagctggctacgcgcaggcggtttctgtgcacggagccgtagctgtcggagcggttagttcgatttcgagctcgaggtttcccccgccgccaggctgacttctcatcgcttgtttttctttttgcatttttcctcccaccgccgttgccgccctccccgtcctggccgtccgccctccgccctctgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaaggtaagccaaggcgaccaacagggaagggctgggacagctctcctctggcagttagcccgtgcatccttctttagcattgccgtgtacgcacaccccaccccgccccctacacgcgcacacacacacacacacagagttttgtgggtttgatgtgtgggagctcccgcagtcggcagaaacgttacatctcccttcccccatctccccccaatagttagttcagctgaaattcagctaaagtgagttttgtagaagttcctataactacacttttatcctagcaaatgagcctattgacctcagcaacagacggcccatactccttgggacggtgagatggttcctatccattcccaggttgaaagtctagtgacaggtccccactgcacgtggcattaagacagtcagataattgtgtcaggtcttgtgctgaggatgagtcagaatacaagatgggcatgttcccccaactaaaacgatgggaagtgattttcttaaaaatactacagtggatggaaatgcctaggactaaagacaaagaaaatacgtacttattcatatacatatgaaagttactttaactagactaacaagtcacttgtgcacaactaagcaaatttacaaaaccaaaaacaatgtatgcctcttggtttcttctatctatggacacctgcacttagatgtggaaagctgcttctttagtagctacctgggtcagcctgccctgagctaatggcacattcaggttggagttccttttcatactttcaggatgtgcttggtgagattaaaaataattggactgggttattggccagacttagatctgactcagtggtcagttttaaattatcattgttattagattttgacccttttagccaatctagtgggaggaatttattgcctaaacacatctggattgggatatcatgggctagagccatccttggcaaagggttttctctgagaaatggagggctaaggaaaaatcctggctcagggactgcagtgtgaagatctactcctatacaacccccagcaatcaatgaggcggatgagcaatttccacccaccacgcctgctatctatggatgggaggagctatagttcacaaaccgtttacattcatgaataatatatttcaaaaggggaaacagtttaatctgtaactggaagggaaaaaaaaactgtcagaattgactcccttggcttcctggagtaggaaaaaggaaaattggagcatttgcagctttttttgactagctggattatggaatatttaaaagcaacagcaacaaaagtaccttataaactagaaaatagaattgctaaaaaactatttactaaaaacattaccttaaagggagaggatatttgtgttttcccccacccccacccttctcatgtggctttgaacaagaaggagagttgccaggaaaagaggcagatttcagagagggctggcttcactggatcctccctgttgttccactgcactgtgagtgagattccctggagcaagcgaatctcccgggatgagtcagagaggccaacagtgtggatgtgggtctccacacatagcatgactaagttgagaaagaaaggccccactgggaaaagagacttcaacacagatggaaaaaaaacataacaggcttggaggaaatagcagtttacaaaacagcatttcaaagagcaagtgtggggatcctcaaattaaagaaattaaaagaaaaagctagagcaagctcctgctagcctaaagaaaccaaaccctgactacttgctcatagaactgtgagcaaaacaagacagtcaaaccaaaaaatccacctagaaaagaatttggcagtctcactcagatgcctggcctagaggggacttcagagaatgccctacagagagacaccaagactacaaatgcaaattctgcccaaagagtgcctggccgatgaacagggtcctatctacatcttatggagactcctattttataaatatgtatcctcaagtccaagcacaaacaaaataacagaaacagggatgattctctcccagtttccatgacagtaaataataaatttccctaaattttactttcaacaacatagactttttttatttttatttttatttatttatttatttattttttgagacggagtctcactctgtcacccaggctggagtgcagtggcatgatctgggatcactgcaacctccacctcccaggttcaagcaattcttctgtctcagcctcctgagtagctgggactacaagtgcacgccaccatgccgggttaatatttgtatttttagtggagacggggtttcaccatgttggccaggctggtcttgaactcctgacctcaagtgatccactggtcttggcctcccaaagtgttgggattacagatgtgagccactacacctggccaacaacacagacttcttaaaaaaatcatgacaataattttgggtgcttcttaaaagcacccaaagctttactgctaatgcatggtagcttaaaacttcacataataagaaagaaccagtggccaatggaatctactgttaaaggtacccaatcaagtaaggaaaagttggtcctaaaagcaagcagccctgtaaaagctgctctgtccaatatggtaatcactagccatttgtgtttccatttaaatttcaagtaattaatatcaagtaaaatttaaaattcagttccttagtcacactagccacgttgtgagtgtgcaacaggtaaagctagtggcacagacatagaacatttccatcagcacagaaatctctattggacagtgccagattagggtgttctctgcattgtaaaagcatccccttgccaagttaaagaaaacaacaacaaaactctagagaagaaatgaaaccccagtttcatttctggagaggaaagaaaactcatgtgtggcatgagtttatattcaagaaggtgcagcattattacctattttactagtaataatgacacacattatagtatacaatccagttccaataaaattaatttctcatcttactaaaagcttgctgctccacattatgagacaatttacccaaatatagacatttacccaaaaatattaagtagcttgtgaatactttttaaaatttcctttaattaaagtggtcacaaactcaaacccttcattctccctctgagatttctgtgtcatcttttgttcacattgttattcacatgtttattatgtacttattttgattttctagataaataaaatggcttcaaatctataattctgataaaattagccatcaattaatttatttattaaacccatgcaatatgctagattagatgctttgctatgtaattcctacaataaatcctagcaatcacaaagattacagttagtgagacgacatgcacacaggtaaaaagtgtttttaaaaaatacatacatacaaccaaaacagtaagtcactgctacatggaaactgattggtcctttttcctttttttttttttgccttgactgccaggaagcagtttcaaatctatagctggattttaagtttcattaattcatgttcccacatatggttctgtattttcacttcccccttttaactgacatactgtcttatgtgatctctactgtaagccttctcatcattttggaaacagaccaaatataatatatatgataaggaatcaaaagtaaatacagtagtgttgaatattgcataacaaaaaggtttttaaatagggaatggtatcaatatgaagtgttagggagacccagccatgaaaaggatagcagggtcagagaaggaggatgtattgcagctggtttaatggagaatggtatgaaggaggtgcagtttgaattgggtcatggaggacagatggattgcaaatagctggggcaaaagcacaggaaggcattctaaacgagccaggcatggagacaagaatgtctcccacaagggagttgtagtagctcaatcagactgggatttgagatttcatgtggcagagtggtaggtgataaaggtgaaaagactgatcatagtaaaatgcggagtctgtaaatccagcactcatgataagtttggacatcatgtcaacagtggacagccataaatgactgcaagcatcggtgtggtataatgaaggtgacgtttttgtaaaatgactctggtgaaggtacagaaggtaatgaaaagtagccagtctagttgagcagaaaagagttcagatgtaattgcatcatggtccagatgtgaaatgaagacaatgcgaagtggcattgtggatcgaaacatacatgcacaaaatgacagaattttagaatttgaagggatcatcatggttaccaggctggcctccaattcctcttttgtaatattaatagaaattaagggctaacaagtttaaaatgttatccatctttttacatagttactgcccaaagtgaatattttgaaatgtatcattaaagaagaatagataagattatgtgattcaccatggactattgtcatgagaggaaaaatgtgtttagatgattctgttagcactgagacaaatcaggatatctgaaaggaggtctttgttgaaaaacagaaatatgcattcataacttgcttttctaaaattggaatgtaatgattcttaaatatgcacagacacaaatttttctttaacagtcaagaaaatgcacgcaggtgataatcagatcagttttggttatagtacaaaggtttaatgcctccgtgatccctttcaacttgaaagcattctagagcaattggtgattaatatcagtataacagtcatttataaaattattatttatttgatatacatctaatcaaagcataagatttatttttattattattattatactttaagttttagggtacatgtgcacaatgtgcaggttagttacatatgtatacatgtgccatgctggtgcgctgcacccactaactcgttgtctagcattaggtttaaaagatcagattgtctcggcaccatgttaatatctttttctgttggcattagtattagttttgcttgtgtatttgtttaggagatagcttcacaagttggtgattgatattctaccatgtatgaagtcatgcgtggaattcagaatccccagcttgtaaaattgcattatgatcatctttagtgggaaattgttctcagaatactgagcaaaggatgataccaaaatggcagctattattcattcttaagcatatgaaatgctttcaggttcaacccaaaattacatacattttaaatgcttactaaaagagtcttttccctcctccatctattaactgcaatcaaaaaacttcggttttaactgaacatgatttcatattatttattaaaatttaaggcaaggtgcaccaagtacccttgaattatgaaaagcttcatgatgtgggatattctttcagttaacggcagggttggctacacttttaaggggttcaaagtaggaacagctgcaatagtgagctgcatctggaaagtccagtaatttgaaaaaccacctgtttatgtatcctgcccactcaagtccataaaataacagacactttcatattccaaatgaaactgctttttagtttgccctacttttaaacataactctttgtgatggaatgaccagaaacagctggtctctaagaggacagggctatgtgcgctcacctgcggggttggaccttccataatccccctggctgtggggaaagttgagggctgctgtctttatacaaagatggtttattccaagatacacacactcttcttccacaccctggagaccttgcatatttagtatcttctttaccataatctgaggccctagagaaaaagatttgcaaactatacttgttttaaaacaactttctaaaaaagacactctcagcccctagaaattatgcctaacacatagatgctcagaggcaacctgttgtagtgcaagaggattgtgccaagattagaaaacaaatatttgcaacttttgtaactgtcttctctaaaacttgaatgtggtgattctaaagtaaagaccgacacaaaattctttttctttagcagtcaggaaaaggcatgcatgaagtaatcagatcaggtgtggtttcagcataatggcctaatgctttcatgatctctttcaactggaaagcgttctagtcccactggacaccaaggaggaagaagggacggaaaatattaggcccataggtttatcttcctcagtagtccacgagatttgagcttatatgtagggagcaaaattgtttgtctaaaagcagttaataaatgccccaaaaaggctgggcgcagtgactcactcctgtaatcccagcactttgggagctcaagattggtggatcatgaggttaggagagcaagatcatcctggccaacacggtgaaaccccatctctatgaaaaatacaaaaattagctgggtgtggtagcgcgtgtttaatcccagctactggggaagctgaggcaggagaatggcttgaacccaggaggccaagattgcagtgagccaagattgcgccactgcactccagcctggtgacacagcgagactccgtctcaaaaaataaaataaataaaataaaataaaataaaataaaataaaataaaataaaataaaataaaataaaataaaaataaaatgaacgccccaaaaatattttgggcaaactattttgtgtttcttttctttatttatttatttcttttgagacaaaatcttgctctgttgccccggctggagtgcaatggcacaatcttggctcactgtatcctcaacctcctgggctcaagcaactcctgagtaactgggaccacagggatgtgccacaattcccggctaattgttttagccaggatataaatgctgcctacatagagtttgtagctatctccttgactttctttatgcagattccttcacaaacttttgatggattcctttaccaaattctactgtctgttaaaatcttctatctttatatctttagtccaaacaacacgtcatttataaaccttaaaattgtttctgggcaaataaacaaggcaaaataggaatatatatttttaggcaatttacttctgttttggtctcataaaaaattgtaattaaattgtagaaaatatttcaattcctctttaatatcctctcctcacatactggctctcaacttctaatcctcctattgaaacattgattgggaggccaaggcaggcggatcaactgaggtcaggagtttgagaccagcctggccaacatggtgaaaccctgtctctactaaaaatacaaaagattagctgggcatggtggcatgcacctgtagtcccagctactttggtggctgaggcacgagaatcgctttaacccgggaggcagaagttacagtgtgccaagatcaagccactgaactccagcctgggcgacagagtgagactccatcacaaaaaaataaaaataaaaattgaaatttgcagcctttttaaaaccccatagcctctttataaacccaaaagcactatcaaatttggcgaggtgtcaaaagaatcagaggaatgtttacaaatacagatgcctgggcccacctcagatatatatatatatatatatatatatatatatattttttttttttttttttttttgagacgatgtcttgctctgtcacccaggctggagtgcagtggcatgatctcagctcactgcaagctccgtctcccgggttcacgccattctcctgcctcagcctcccaagtagctgggactacaggcgcccgccaccacggctggctaattttttctattttttagtagagacagggtgtcaccgtgttagccaggatggtctcaatctcctgaccttgtgatccgctcgcctcggcctctcaaagtgctgggattacaggcgtgagccactgcacccggcccagatatattaaattagaatatctagaggtggagcctgagtatctgtatttttcagagtttcaaatgatcgttcttcaaatgattacactgtgaagtcagatttagaaatgactgtacccaaggttggctaaaagatacacaccctggttgattctacctgaagagagcaaataagatacacagcaaagttgtagatgttttccctgccagtagaatacttgcgggttaggccatttaaaaccctgccagagagttttgaaacactgtggagggctcccaaatcaacttgctcaatggttctccatcccttcaggctacttgggcttaaagccaactgcaagcttagagcctcagagtgacctaggaatggggtgaccatatattctaggttgtctcatacagactagccagcactactcagccgcaagtaatagcatccaggcatgctcagaagtgtcccatttggaggaaaaaaacaatattgtcacaaatgaattggcaatggcctgtctctgattcttatacctggaatatactggaagtccctactcatgctattttctagcagaataggcaaaatttctacattccaggcatgtcaggcctttccctgattcctttctctaatgtcactcgtctgctgtcttttatcacagccattaaactgcaccctaacttaaagaggatcccttatgttccaatctactcatccctcagatctttctttctctgaaacacagggttaatgagactgacatccttccatcacatattttctcagctactcagtaaaagatgtaaatgtttaaaatagtttaaactatttttcagttagtccaggaaacataaaatggcatgcttgcacataaaccattgtttagggtgggggaagtgtttttaattttgccttaaaggaaatctgcatgatccacaggctatgcaactaccaagggaattagttggtagaacagaattacacctgcacagaatacaaatttcctgcctttcatgggaactatgttgatgtttcagatatgaaatacatcttgttttctttattgaacctcgagaagatgtctcttgttggtcattatttcatggcaggggaagtacatattcctaaagacacaaccgagtttccctttaaccatcattagttgggctggccattaagaaccagacgcttttattttcaaagagacttaagttttgatgttgtacatatgtgcctaatattctatctcatagcaatttaaaggtgacgttttaaaaagctgcattcagtgtataaacttctcctgatcccagcaaggatgttgtgatgattttatttaaaaaggtaagttgtgtctagatatggcagtgggtcatctcatgcatggtgcagatgtcaaacacaattacattttcttatttgcaatgactaaaaaaagaagctgagcccaagcagtgagaaagtaggagattgggaggacaagaagcaaaggaaaaaagtaacatgagcaccgttctccctgtcctgccacttgctccattatggactgggctgcgatatctcatatcccagctccacaactcccaacaaccatttatgtgcatggtgcttccatgtgtgatgacccaatcaggctcaggtgtggactgagtagttaaattataacccttgtctctgaagagtttagggcttagtggggaaacagacatgtaaacaaacctgagtgaggtcatgtaatcaaaggacaggccacagtcaaccacaaagaagagagttctcagcagtctccaaagccgaacatatgtttaccaggaacagggtcccagcagagggagcaacaggagcaaccagagccttgaggggtcgtggcctgttctgggcaccagcagtggatcaatgtggccagagccagggatactagcagaagccagagcagcagggccttccttgtccagcaaaggcatttgtctctttgtaggccacagcgacccacagagggctttttaggccagaaaaaagccattaaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagccattaaaaagggagtcatgtctcttgttggtcattatttcatggcaggggaactacatattcttaaagacacaaccatttcctcttaatcctcattagctgtgctggcaattaaaaaaccaaaagtttttactttcaagaagatttaaataacttctgagggtgtacatatgtgcttaatattctgtctcacagtaatttaaaagtgaagttttgaaaagctgcatcctgcgcttgtcagaaccatgtctgatgagatatcccctttaaagggctctcggtgcaatggggcaaatcaagggggtttgtgcaagtgggagtgagacaggagatggggtgcttcttccagcactccctataggctgactgagtgacaaagatcattttactgacacctccaatggccctatgagatgggtactattattattatcaccatcatattccttttgcagataaggaaactcaggcttagcagattgccagaacaacacaggcaggaagtggtagagtcagggtttgaacccaggtagtgaaactccaaagcccggattcttaaccactgtcctccagtgcctctctgtaataagtcatgatcccagaagccattggtgtggccacaatatggaaagagatgacagtgtcctcacactgggtgagcagcttatggtgattccagacatgatctctgttgggagtgacaggtctgagcttctaggatcagaccctagatcttggcaagtggtttgaggaaagagaaggaccaatgtaaaaccccaggcttcaaggaatgtggatgctgggcagggaggattaagccccaaagaccagaaatggggtacacagggcaggtgtggccagagtagaactagagtagaacttccagtgactagaaatagaaccagacacgttgcagtggtggataaggtagaatcgcttaagtctttaaagtgcccctgatcacccaagttggccagagaccctggggtggggctgattctgtctggatatacggggaggggtaagcatgaggaaaggaagcaggtcctgacaggtactttgcactaaacagctccttataaggttctcaatttgcctgctcaatttctacagacatttgtgggaccacaccagtacattgtaaaagcaggaaacaattgagaaaaacctgagttttatgttggtaggagaaatgcctatggaatatggcaaatcgtttctctgagacttcctccctagtaattacatatttgttctcaaaaacaaatgccagaaggaagaagcagatttaatagtgcattttacaaggcaccattaatctctaagaagaacaattaaaatgtctcagcaatcatggttcactgtatatcttttctatcttcttagaagtaatatatggctggaaatgggcataccaaaatatgtcaaggaagtggaattgcgttcattagatttcaccactaattattttagttagcttcacagatctctcttccttgcttgttcttgagagcgaggctttttagtaggaagagaaattgtctaaaacgattaataaccacaaattcaccaaactattttgggtaagtccctctatttctctaggtctaaagctaggaataagagtcattctcatataatgtactgtcccagaaagggcattatattagtctgttttcacgctgctgataaagacatatccgggattgggtgatgtatttaaaaaaagaggtttaatggactcacagttccacatgcctggggaggcttcacaatcatggaggaaggtgaaaggcacatcttacatggtggcagacaagacagaattgagagccaatcaaaaggggaaaccccttataaaagcatcagatttcgtgggacttatcactaccacaagaacagtatgggggaaccgccaccatgattcaattatctcccacaaaatgggaaaattatgggaactacaattcaagatgagatttgggtggggacacagccaaaccatatcaggcattcaaccaatatttgggaagcaccagccctgcaccaggcacggagcacgtcatgagtcctgccgtaccacagcctgcctgacagacctcagtcatcctctggagcttgcctctgacatctggacctcctcagaatcagcatctcttctccttgcccccgccatcctttgtttttatctctgctgtggcattcatcaaagccttccaactatcctgcgtcactgtccttcagtgtcctctctcctctcccttccttctcaccccactttgtgcctgtatccttcaagcagagcaatggcaccctcacttctgtggctgcccagtgccccatgcagagtcagacatcagaaaatagatgctgaattcagttgacactctgaaattctttttaaagtaagttaatgtgtgctttgaatgaaaagacactgggattacattattgagtgtctttcttcctttgccacttttgtccctattggccatatttgaaaatcttgttggaaaaaaaaattcaagaacttaataaataaattcaaaaacatttagtctatttacttaggtgaagagaaaactcattctaatatgtgtgtatatttaaaatatttgttatttagactttttttttaagtctccaggttgaggaggacacaaatatatcctcctaaaccttccagtaagcaagctgtggcatccagatgatctcctgggtcatgggggataaggctaatctcctaggtgtctggcagacaggacaggcaaattcccagaatgccaaaatataccatctgctgctgtttggcattgcccttaagtccagagtgtggaggctgggggtgggtctctggctacaggagaagtcccctggcaagggaggggtgaaaggagtgcctgttgaaccccccatctatccccgcactatggcaagattgagaggaatgactagatcagggaatggcccgaaagaaaaatccaaaacctcccaaccctggacaaggccacagctttgagaaaccgaagcctctgcttccttctctttggctttactgcttctagatgcaaatacacagagctctgagattttgtgtgctgggaggtgataactgttaaccctctattccaatagcacagaaatttctctttgcctcagaagtggtttctcatagatctcagatctcttttcaggaaaaagaaaaacaacaacaataacaacacattaatgactctgaaagagtcagacaccattaattccattattggtgtctgtgccaagtgaaatgaacgtcagctcttttcccagatatgtttccttcttttgcctcctataataagagatgattttactgtaataatataagactcatcaatttgactccaaatagctttcctatcaacaggctaagtgtaaaataccaggatcattattcagttgagaatagatagaactaggaagtagccatcaaaaaagaatgatgaggtgcattgtggatttggggtgtaacttggtatctaacatacagccagaatcacagtcatagcacacttaatattttatcagaaacttgcgtgaacaagttaagaggactctcaacttaaaaatgacaccaattgcaatgatcttgttaacatttgtgatgaaaataatagcaaagtgacttagacaaattacaatagcccataaaaataagataaagtttaacacaaagtaagatgatgttaaaagacttgaaataaaacagatatgttaagtaggcaacacataggtaagcatataaaaacaagaagataccaggatagagctgtcatttttgtgggagcctgtgatgtggaaaaccaagatgcctggtgagtataatggatatggaaaccccccttgtaataattccacagttccaaggggccaaggtctccaggttgagtcactattgtaaacacacccatagatgaatccacatgccatacctccttgagtaagtggggactcaaactaggtctgtcaattgttccagaaaattaagcatctaaataatttaatgataatttaaaagaagcacaatgaaatatttcaaggaatgtcacatacaagattctgtacctcttctgctttggttagactcattcagaataggttcctgctttgatcttaagagggaggtagagattctggagaagccctagggaagagcaaaaggaaaggaataaggagccaagaggaaacccagggtaaggctgaggagggactgtttcgtgtaggtgatttattggaagggttggaaggaaacatggaatgacaattacctttggttattgtcaggttagtatgagacttacaagaaaagcactgctcagacgcaattaccattcaagataagaaataataggaaaggctagcacacttagctttttatttaaaaaagtgttaggtaggctgagcacggtggctcactcctgtaatcccagcactttgggaggccaaggtggatagatgacttgagcccagaagcttgagaccagcctggacaacatggtgaaacctcatgtctacaaaaaaatacaaaaattagccaggcatgatggcatgcacctgtagtctcagctacttggggggccaagaggtgggaagattgcttgagcccaggaagtcgaggctgcagtgagccatgattgtgccactgcatgacagcctgggcaaccgagtgagagcctgcctcaaaaaaaaaaaaaaaaaaagtgttaggtgacatgagagaagatcttccaagtaataagagtggctaatcccaggaatgtgtcaccagaggttattttgtaatagtcgtgtgttaaattccttatttgtctatataacttctcaaatccttctgcctctacagttatagtttaactggcgcataacagccttcacacacagcctcataattaaacatagacatacatatgaacactttcccctatgccagcaggatacttggtttgtttaggggcaaagaggaattgatgtggcgttgtttcaatcagtggttgaaaatgcaagtggtaaacattgaaaaatagaacactgcaaaaggcatgcattgtatataccaaaaggtcagcatgaagcattatctgtatggcaagcctgcccatccactccctcctacacgttgcatattcacacagttttgcagcttgtataaacccctattgtgatagaaactcatgaaagagtgtggtctctgcgaaagctggctgttctgtgaatttagaccagtggttcttcaccctggctgcaaatcatctggggaacatttaaaaacactgttttaaacaccccaaccctagaaattctgatttaattggtctgtggtggggcccagaactctgtattctttttttaaggctctcaggtgctgctaatgtatagctaaaattgggtctggtttagactctcagaatttcttaataattaaacactttatcatgacaagactttcaggaccttaaaggccacagtggggtagttatcatttcactaggtcctcatctggggaggtccttggcatttttactggaatatatttgtcactcaaatttctattacaaaaaattctttcttgcacactgctttagcaactacatgagatatactttgtacatagcacaaatctcatatcacttatgtaatccagctctgtggttccttcctttcctttgcctgtttatttttaattcttcccaagaggaagcttagccagttagaacaccagagtatcatccccctcccccttttcccacctgagttcatggcttagacatactaggaatgaagctgacaacatgcactagtttttttcgaaattatgcagcaaaattcccaaagtgcgagtggccacagagatcttcacagggcccagggacaggcagacatcattctttctccagttcctggcacagaaaagagaccttaggttactgagaagataccagtccctcctcagagcagacaaggaaactgagcctcagaatgaaagactgaatttcagtcctttcttgaacatggacctccagggttatattgggccttggaaaaggcacttacactctggactgtagtttcttcatctataaaatcaagaggcagaaacagacaatctctaagttgcctttatttataaaattccgagattctagttgaccagtattcatacaagagttgaagcctgtaagagtgcagaaagcccacacaaagagacagtggaagacctctcatcagtagtatttttattaccctcttcctaggttttaccagtcaacatcctcactgttaatatacagaccgtggtatttaattaaatcatctttgaaatactgagctatcaacagatggcatgctgaatgcaaaaggaccacaaataaatatttggtactgaagaagatcaagagttggagttcatttcccattctgatctgggctcagaactctgtggtcttccctctaatcatccttgccaccaaattggctgtatctgttctaagatggatcagaaaatcagttccaaagttggctacaaactttcaggtttgggttttgttttgtttttttgttttgttttgttttgtttttgcaaccagccaattcatcttagttcacatgacagagaagtgcataattacttgcaactttagttagagcagtggccttaagaaggtctagctaaataaaaagtgctcagactttctgagtgctgacagttgtcaaattcacctagttcacatggccccatttctatcgtttgttttgttttgtttttgttttttaacagcccatctgtgagcaataggatcagatgactaagagctacagggcagaaacactgttacttagagtcaaattttcccattacctagctgtaaagagtttgtttctctctgactcatataaagtttaccatttaggcccctgcatgattttaattccatcacttaacaccccagccatatgattctgaaggtaaacatgaaggcgtttgaattccagaccacctaaacattcttaaggaaatcatcatctccacgggcagagctatgccaaaatctgtaggttttaactcaaatttcatgataagcaaaaattgaattaatttgtcttccattttgttcacctttttgccaaaattatgcctggattagaataaataaattcaatcaatgaatgcaatcactaattcttacgccagataataacacattcagaattctcctttccctgggagattttatcaggttagtgttcttgtaaacaggagaaagagaaaaatataacttagtaaatagcagtattcactaattcattcatttattcaacaaatattaatttactacctactacattccagggagcttagagtctagtatcagaaataataaccacacacacacatacacacacactacattaaataaggatgtgataggctagatgaaataaataaataaataaaaggtccaggtgagaaaagaaggtgggggctagaaagaagtcattgaagaaaaaacatttaggttaaaacattatgaataacttagagtgagccaagtgcagagtgctgaaggagtgctccaggcaaaatcaacagcaaatggggagtccttgatgtagaaaagggtttgaggaattgtcctgggagaaatactcaagattccagtctgaattctagaggttagtgatttagagaggcaagtacgaaaatgacttcctctcttaccttaaaagtaagtgcaccatagaaggaaatcacccttccttggtaataattcctgagtgagcctgagaagccagaggccatctctattttataggcactgtccccttttcagttacccatggctagctcattgaccttgtcctggtcgtttcctcatttcacttactccatcctcaaaacgtagacgcttcataaatattgtataaatgaatgaactcacaaagtcacagtacagcaaggcaaaagtgcctgcaataaacaagcattctaggctagaaatatttctcaacttcaaattgtgtcttattacattgtattccgattttctagagtggtagttctcagtcaagggaaagtttttcttcccttccaggggatatttggcattgtctggagatagttttagttgtcacgatttgggggatgcttctggctcaacttgggtagagaagcggggatgcttataatcatcctacagtgcacaggacagtacccccacccacactccagtaatgaagaatcattagacctaaaatgttaatggtgtccaggtagaaaaaccctgttgtagaggttggggactgcgtcttgacagccacattatacagtgtatcaaacaattctgtataatgggctgtaattatccttgcctagattttgcaagaaccctagtgtgtatctttttcctcacttgccaagcaatgttcaaacctgcagagatttatttcattcattttctgtgtgtttagtaaacagactagaagcactggaggaaaaaatattccagcaatgaggtaagacgaaagctattagtaaccctagtttaacttagctgaatagtaggaaacaacctctaccgtgaggaagtgtattgtagaaactgaaaagacgctaatgatgtttaaaaagctgtagttcaaacaaatgtgcatgcagaccaatgggtagactgaaaatgatgaagacatttccgtttcttgtgtctttgatagaaaagaaagagcttttattttctttagtgtggcaatcattcagatttgtcccatgacatgcccagaaggttgaagaataacaaactcccaagtgtaaacacagaatttagcgaagaatccaggcctctggatgaatccctgtaattgcatgtttggataaaataagattttcatacattaaacaaggtaggatttttctatctgggacggaactttcaacacttggaggggttgtagttatttctcctcaaagatggcaaacatgagtgccccgagttatccctcctctctgttcaagttcgctaactaatcacccagtatccatgctatcgctggcccttctgtggcctatttttatactgttcactgttcagtgtcacttgtttggtaacactcaacatcaacatgtgctaccaaattgacaccagaggacaaaaaagaatcaagatatgtacagcctgctttgtactgagccagctgccactagatgttttttgtgataatgaacacgtgaggccatgtggacgcgagagatggctccgggttccctcagacggctcacagccagctggtctgcagtgcggttttagattccgatgtgggaaccccataaaaaagaatatgcaggccaggcgtggtggctcatgcctgtaatcccagcaatttgggagcctgaggcgggtggatcacctgaggtcaggagttcgagaccagcctcgccaacatggtgaaatcctgcctctactaaaaataaaaaaaaaaaaaattagtcaggtgtggtggcggatgcctgtaatcccagctacttgggaggctgaggcaggagaatcgcttgaacctgggaggcagaggttgcagtgagcaaagatcgcaccattgcacttcagactgggcaacaagaatgagactctgtcacaaaaaaaaaaaaaaaaagtctgcaggctgcataaagaggtatgaaaatgttccagaaatcccaaatcctatccctgaggttcattttggtgagggaatgtgtgtgcattttctagggcttccctaaaaaagtatcacaagctggatggcctaaagctacagaaatttcttggggacaaatttcatgattctggaagctagaggtccaaaatcaaggtgtcagcaaggctatgctttttctgaagcctatagggaaggccttccttgtctctcctagtttctggtggtttgctggcaatgtttggcattctgtggattgcagctacataactccactctgcctccatcattaatggccttctgcctgagtgttttcatatgaccatcttcatataaggacaccagtcatatttgatgagggttccaccctactccagtatgacctcatcttcactaactacatctgcaatgaccctatatccaaataaagtcacattctgagtgtctggggattagaacttcaacagagcttgttgaagggggcacaattcaatgcataacaggatggaaactagaaacgggtatgtttttatcagtgtagaaagatttagcttaatttttcaaagtgtaataaaaaccccaggaaaactcatactccctcctaagaagagcaaaagatggagaaacccgatggttaccttcaaacaaaaggaaaggaggaataagatgaaaaggaattaatccaaagcaaagagagtggcttatatggaatgttggtgcaactttctctgacacatctgtgcactcatcagctggggcatcatctccctggggtacatttggtcactgtgtgcctcatggtaataaactccagaagcctcattgacttgctagagatgagctcatccttcttgcttgcttaatggcaaaatacaaaataagcagtcactgacatggaacgatttcaggaatgccaaaaggttctccttttccaaaatatctcttccatcttcccaatactgttactgacatcactaacacctctccacttccggttgagacacctgggccagagctcctgatgtggcaggcagtgccctaaacgttttgcataaattaactgatgcccagagcaacaaccctaagatataggtactatcataccgcatcttacagataagaaacttaggcacaaagaggtttagtagtttagatgagataaccctgatgagcagagattcgaacccagcctccatgctattaaccaggacatcatattgcctttcatacatgctcttcaaaggcaacacagtaatcgattatcacactcactcacatctgattgtcacatttttcagatctgctctcctagcagagaatgaagcctaaggtatccttgtttctcaaagtgtcctccccagaccagctgcatcaaaatgaggggatgaggtgcaaatgcctggaccctgcccttggagcactgattcataatctcaagtcccaagaatctgcattttaacaagcatccccagaaatttcttaagtatactaatgtatgggaaccactgacactaaagaaatggaataaggggaacgtacaatgttacagtaaaccaggaaaagccagaaagacatgacaacacagtgaggactctggtagccaatggtcagtcaaatgcccaggggccctggccagaagagagttaggttgctgaggagtaagagtgatgctgaatgtggaggcttgagagcagaaggaagccagccagctatatcctcttgcttggatcacacaccctttccttggtggaaatggttatttgcagagttagagaaggcatgttttacagtttggatggcaggtatggatgtagacaataaagagcaaccagagtccatgggttcagaaatccccatgtgtttctgtttgaatgagacgcttgcataaacagcacaaggagtttggggtggggttaaagagaatggtgtggtatagggagagctgaatgaggaactgagagagcaaaatcctgtgtttggttcaatcactgattacaacctccctgaggctcggtctcctaatctgtaaaatggggggaaataatacctgccttgcaggtcctcacacacagggcatgatgtgaatccactgaggcatatagcactgtgtaacatgagttattgctattccaaggcccgtaaaaggctcttgccttggaatatatctgccacaccaatgcctgcagtccattaatgacacataaaggacactggagataacgatgtcccttgttctatgcatccctcccacccatgccagaaaagaaaacacagtcacctgaagtcattctaaagagtatgcctgcctcttttcctgcacagacacatatacacagacacgcacatacacagaccatgcacatacacacacatgggaaaacatgaggaaaagtggagacaagaggcaccaaaggacaaagtcacttttgtcgcctgtcccttccccagcagggctgggcctgggctgcttctcctgcctcctccctgaagccccctcctcatcatattccagtgcgtgtccaccactttggggccaggtctacacaactgcagtgattcaggtcacgggagaaaacccaaacaagcacaaaacatgcttcaacctatattttctaaattgtttttctttaaaggtgaagacttctgagcttgaattatccccttgtcagtgggctttccatgctgtccaagtgacctaagtgataatcaacctccatttcattttgagaatggttgtggtattttagagctatggtgaataagaaaatcatttaaaataaaatgatttttatttatttattgtttttatttattttatcttaaatgaattttaaatcatttaaaataaaataatgggataaaagaggatgctaaaaataataaatatatatgtatcaaagtgtgcttgtaataccaggcaaagaattaataagagataatattatggttggtgaaatgttatgtatggctacatcctttcaatgagcatttatagttcctttaaaatatgcctactgaagaaatatttacatgctaattaacatgtgcatagtaccactaggtattatagaggataccagatgtttgtagtagacacagaccttgccctaagtcctggtcttgatgtagtcactttttagtcactacaggtgactacatttagtcactacaagtgaccttccttcaatggggaaataaaggactttacaaaagacgtagaagacaattcttaatataaaagtgatttagatcttcacaagtttgtgaagagaagcagatgagtgaaatagaacactatcaatgtaaaatattattctgaggcctctgtaatgactgggaagcaacaagagggaggtcatttcagagagagaggctctaggttccaagctggatgctcaggtcagtgactgcaggtcccctccacacccatcaccccacaccctaaccctcttcagttgctcacaaaggtagataaatacccacatttttgccctcttccatcttgaaaccctggaaacccttgcttccgccaggggaggttacttagtatctgtcaccccaagggaaccaacgtcgaagcccaagaataagagtcaatactcctaccagaggtttacatttttcccaggggtctaggtggatattcctgggaacccccgtcaacacaggcatctacagtacaatccaggcctcctgttttcagcaggggctgcaagagcactgcagccttttccccagaggtgtcagtttggcccagtaaagattgcccctgagaaaacacatgggcaattagagcaaagttcctatgttctggtaacatttaattgtgctatttctcaacctcctctgcacccacacactcacacacaacatttattccactgacttcaaaggaagctcaacgtgttaaaaatatgtgtgggaacaaagaagggagtttgaaattggtctaaactctgtataactgggtttgacacgtacattaggattttacaagtatgtatttaatctttttttaaaaaaagcgtttacatagggttcagaataatgacaataaatcaacatttctattgtccatttgtgtgttttcatagtaaataatgctcatttatccttaaccagtaatacatacttatgggcttaaattagcaaaagcctctcaaaaagtagctccactcatttatccaccagtgtccagatgccatccagcacatgaggagctcccagaaaggagcagggaacaaactagggctgtcaggagtggaggagaaagaatggcatatgcaaaaaggagctgtaattaaatccaagggaacatggcacactctagtcttttgcacgagacaaagggcaatcctggtaaaaatacagatccccaggccccaccccaaagagtctgatctgattctgaaatggggccggagaatctgcattttaacaagcaccttcaccaggtgatccttttgctgagaacccctgagaaatgagaaccctgtgctagtgctgaatggagcattatattccagagttgaagtttggtgatcagttttccagatggagctggtccttggtgcatacctgggtataaatccaagccaattcaggtatatgagctgatatttcaaccgaaacactatctatagcctaaattttttctaatattctgtttggtatgaattctagaaagttgtaaatgctatatttccttctcatctatttctggactttgtcccaagaccaaatcccagggcatctgatagacattcattgcatacatttttctgtaaacatgaaaactgaattgtctaatagaaaagggcaaggaagtagaaaataagaaatcatcatcagaagtggtttgttttggaattatattgtccagctgcataacaaatcacccccaaaattgagtcgcttagaacaacaaacattgatcctccacagtttctgtgtgttaggaatcaaagtgatttaatttaatggttctgctcagggtctctcgggggctgcaatccaggtctcaggctgggatcctttcaaggctgagctggggaaagatccatgtctaagctcactcacatggccgatggcgggattcagttcctcttaggctgtcagactgagggcctccgtgtctcagtggttttagccagagccctctctcagttcctttccacatgggcctctccacagggcaactcacaacatggcagctggtttccagtagagcaagcgagtgagagaacaagaaaggcaagcaaggtgaatgtcccagtcttttgtaacctcatctcagaagtgttaacccatcacttttgccatgttttattatttagaagcaaatcactaagtccagcccacaattagagggatggcattacacaagggaatgaacaccagcagacagggtcattgaaagccatcttagatgctgtctatcgcatctaagtgtgatttttccagatgaaaagaatatattaatttgtttcagtcttagtcgatgtgccatcccatttgtgctttgctaaaacttgtatcaatgtaaagcaaacattttctgatacaatttaggtagtgtattgtggtaatagagaccagtagtgttgaaaagatatgttgaggtcagaaattaagctcatgtttctaaaagaggagatatgtacaactactatgcaagccaacaggaaagagtgttttaagaatgctttctgctacaggtaactaaaaacctaaacagctgtggctttaaaataaaggtatatctaagtcacataagcaaaagtctaggggtgggcagctgctggcattgcttcagtagcttgataatggcaaaagcagcatctcttctatttccttggccttctaatcatgcatgtcacctcacaatcacaacataggcaacacctcatattctaagcaagatgaaaagggcaaagagtcatgccatatgcctctgtctcttttcataaggaagacaaagcttccctggaagtcccctctagcagatttcacttagatctcattggccagaactgagtcacatgcctgccttaaaccaatcactcaccaagaagactaacattatcatggcaagtctaaaccaactgtgactcatctctgaaatcaaaggattattaccattacccgaatccatcaggatcctgttggcagagaagtgggactgtaaattttgagcaggcaacaaacaagtcttctgtaaacttcttatgtgttgttttttatgtgttctatatatccagtagaatcacaatttccaataacagtctaaaaagatattttccaatagaaacagaatgtgtaagatcattacttatgaaatcccaaatgtacttaaggtttccttcttgaaaattccttattcaaaataaaatgtccagattttgaaacccagaaaagattctatattttaaaaatcctgtgcacatgtaaactgtttttcaaatattgccttcagatacattgaacagaatgaaatcttctgagatttactacatcagccaagtattatcaaaacaaacaggacagattgcttttcttgacgtctgctgcttgatttgtgttaactcatgtttctgaaattgtagtatcataagccaatgctgcacaaaggtatttcatgtcatttataaaaatctagtaatgtaaactgttaactccttataaagcatctgttgacacacaaaaatatcactgaagtgcatttatgcctttcttctttaggtctgcataatacttccctccagaaggccaagttgttccataaattacagaacagaaagttggttgtgggaggaatagctcaacctcatctgaggcatcccactctaagaaactaatggcacctacacctcttgggcattgagtttttaagcccatttttaattcttgttctgctcatattctaagtgagcacataaagtgctgctccaagcaagaccagcccttgtagaagggcaagtgcagtcagtcccctaggaaacgggactggggagtgatcgtttcaatgagagataaatcaaactgatgctaaacatgaacaatgagcccattagagattgtgagaaagaggcatcatcatccactcaacaataggcctgtgggacctcttgatagcctgaggatgtttaatttcaggtgcaggtatccagaatgtagcagctagactgatcaaggatgtgtgatgacagcaagcagtagtggaagagcccaggagagttcctaagcctgaattgcaatcctgtgctgccataaaatgggaagatatacttggtccagtcatctgacagctttggtcatcaatttctctatctcatatgtgactctattgctttaagaatccctttagctttaaatatctatgaatctgctgaagcagctgtgctttgattgatgtggatctctgaactcccttaaatacaaagaccaattatttagccgagctttgttggattcagtgcattctgaatacatgtcaaaatatacttggatttgtaaaaaatattccttcctgtttttttcaccatagatagatgtacaaaaatgtccgtgttcacaccgtggaaaggacatttctcataaactcacacagagatacctttcaagtcaatgccttagaaagcaatgagagatttaaaggagacctagagatatgaatggagtaggcagagaaggtatgtgaggagaatgatgtaacttcctagggaaaaagtatgaagcacaaggctggacatagacctgggaatcaggaaattagagttctaattgcagcttttccattgattcacttgggatcttgagaatatctgtctcattttaatcattctgggccacagtttccatatctgtcaattagagtaagagtccctggctgggtgcccaggattgtgagaacataccattcagagccataaaaatgcaatcagtaccaataatgtactagtaccagtacctaggatgcaaaacatcctagatactaggtgtcctaacttaaagtggaaacattaacaagagtaattctttgaatcatcaaactgggaatattttaggaagcatatctatctgggtgaaaactaagcaaataagacaattgtaaaggcttgtgatctcaggaatacaaaggcaaaaatgcgcagacttgaaatatgacaagttctagttttgtcacttagcatctctgtgaccttggataatttcttaacccccggcagtattctcatctgtaaaatgggaataatgacatgcacttcagtggtttgtggtgaagattattacaaatagaaattagctcttttgagccactggtggggtttaaattcccagcccttatgtgctttgcagctgttagttcctcttattacaattgtctatttaaaaacctagtcacagcccggtgcagtagctcacgtctgtaatcccaacactttgggaggccaaggcaggagaactgcttgagctcaggcgttcaacatcagcctaggcaacatagtgagaccctctcatctctacaaaaagcaaaaaattagccagtgatgcatggctgtagtcccagctattctgagggctgaagttggaggattgcttgagcccaggaggtcaaggctgcagtgggcagtgatcatgccgctgcactctagcctggatgacagagcaagaacctgtctccaaaaaaagaaaggaaggaaggaaggaaggaaggaaggaggaaagaaaagaaagaaagaaagaaagaaagaaagaaagaaagagagagagagagagagagagagagaaagaaagaaagaaagaaagaaagaaagaaagaaagaaagaaagaaagaaagaaagaaagagaaagaaagaaagaagggagggagggagggagaggagagaaagaaaaaggaaggaaggaaggaagagagagagagagagagaaagacctagtcaccaaaagcaagagattttttaaatgctactattttttgggcatttactaatcatattgctatgctctgcacccaagctaagtaatttaaataaattatctcatgtactcctctaaaactaattactgctgtgtaaatggaggtagaaagaaactaagctttatttctgcctctattgtttctttaacctgccttgcttcctttttcagttgcacctaattggctgtacttttagttttctttaaaactgccttaaatttcaaagactaaagcagcaataactaactgaatatatttatataacatgttatttttgtcatgttgctttccacccctggagacctgctctaaattcacttggacgtttgaggataaatcatgctcactagcagtttctgaaaatgcagtttcactgaaaatgcaggcatccagaaatttagtaagcaacttaaaagaaagtgtaagaatctcctatgtattcattgaaaaataatttgaatttatgcttagaaaaatagaattattattaagaaatcttacacactcatgtttttaaatatcttcactaaggaccaattgtgtatatggtgtaacactgtcctcaaagaacatgccgggagaattgttgcagttaccagagggttaaatttggcaaactcttttttattaacgtgccttttaattatgaaatagcatactcaccttagataaaatttgaaaaccatttttgtaaagtggtacaatattgaagaaagttgataactttcagaccagatttaagcctcaaatctacctctcttttacctggacaactcattagcatttctgaacctcacattttttctataaagtgagaatactatattatagagttgttgtcagttaaatgagaacagtgtctgatcacaactagtcaacaaatgttcacaactcttcccctcctaggaaaagaatctcaaggcagacctgcttcgggtctgctctgtaaagaggtaggaatcctctgctcccggtaaattgcttcctaaccttctttggtaatagactattttttaataaaggtgatggatcatttcccattatacactcaaaatgtgtgtccatttcagggcagtcatggatgaccattgcccatcttttgaccccagattaagaacacctgctgtagtattttaattctgccttcaaatcctcttacaaaacaaagacatctttaaaaaataaaattctttaggtgtcttgcagttgaatgcaggaaaaccagagccccttatttttgatagttttgggaagaatgcagtgtcagaacacaaacccataatagacaaataatttgcacagaaacttcataaaagtattgacctgatttgccatgtatttgccaccttttaaaacacacaactaaatgtttaccctgtgtctagatccaaatgggtgaagaaaaatgagtgacaatacatctacttaagctcacttacataattgtggccatgccgtttttttcacattacattattagaacattggacaataagtcaagaaacagaatgttctacaaaataaactttaaaaattggtaagcatcatgtgctttttccagaagacattttattttgttgaatcaaaggtggctctttggcactgagtagctccgtggagtcatggcagtcctcattccctaatcctgagcctgcctgagtcgctgctgtcagtcatccacttgttgggatttcaaactgcattaaatcccctcctatagctgtcactgccaagcagttgcactggctctgtcctacctttctgttggtaattctgtttttaatcctgtgcttcagtgtagtttatataaatctttacagagggataaaacttcctgtaattaattgtttgggtgaacatgtacctgggagagctattgggaaaggggccaaatttgcattccagctcctttcatccccacccttgagctaaccaagtcctgtggattcttcccttagcatctctggaaccttcttttcttttcttttttttatgaccacctttccagtcctggcccttcaaacttgagtgacagcaacagtctccctgccttgagtctctttcctccttctcccagtgtgcatacggttgtcaaactcatcttgataaactactgcatcgattgtggctacactcccctgctcccacatcttccatagaccccactgtctgtaaaataatattcagtctggcctcaacctgtctttccagcctcggtgacacaggtctattctgcctgagacacttactatgacacccttgcttgttcctggggctttgacacatttccaacgtcccattgttcttcctctccaaatcagccaattgcccaagccctgctcaaatctcccacctcatgaagccttcttgatgcctcccagcacaccatgatctaatttcctgaagtaattatgctaattgggcatttgaagaattgttaaccgattatcaactaactgccccttaacattgcatgtgtagttgtcttcaaaggcagttaaattatgtcatgttccttacattgtactgagtgcctcgtatccttatccatgtttgggggttttactttaagtcaagaaatttaatcacatccatttggttttctctagagctgtagttctcaaccttttgtgtggtagagaaacacctagagaacatgtttaaaaatatcctgggttccacccttgagagataataaggtccaaggggaacccaaatatctgtgtttcaggtcagcttattggctcatcctattataccaactcctcagaaggccaaggtgggtggattccttgatctcaggcgttcaagaccagcctgggcaatatcgtgagactccatctcttaaaaaaaaaaaaaaaaaggattagccaagtgtggtggcatgaacctgtggtcccagctacttaagaggctgaggcagacagattgcttgagcctgggaagtcgaagctgcagtgagccatgatcatgccactgcactccagcctgggtgacagagcaagaccctgtctcaaaaaaataaaaatgaaaaaaatctgtgttcccaagttccaagtgatgctgatgctgctggttgcctttaagcatctcacaaagaacgaactcataaatgctaatacagtatatgtctatggatactgaatagtgggttttttttctcttttcttctattctgtgctcatgttgtgtcacttcttccttttagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaacagtca

SEQ ID NO: 7420 - DNA, 36192 bp, Homo sapiens; identical to SEQ ID NO: 7419

SEQ ID NO: 7421 - DNA, 3119 bp, Homo sapiens
atgtccaaatcactacttgtaggattttctacatgaacttttttctaggactttggttactatacatattgtatattttaagaattctttatacaattttaatatactgcaatactgcagtttttgacaatttggattccatttggtatatgaatttttgcattcattattgaataactcttttaatatttttgagcaatgattatactgctttaccttgtgtcactttttttttttttaggaaaaactcatgttccagtatatttctcttacagagtgaagtcattacagcactgtatttctgtgttgacatttgttggcagtgtgctaagtaatgttttttaaagcacaggcttgaggactatggtttacatcctgttggaaacattccaaatgggacttgtgtattatacccaggaggctctcatatataccatcttggcatctgtactgatgaataagttataatgaacagttaaaaatgctcattgaaaattaaataaaacaaaaaggcagttatttcatgcttggtcaaaaacatcaatacctttccaattaacactgagaaattaaggttaagattctccttttgtactgggaaacaggctggaggactatggtcctcaagtttagaccaagaggactatggtctcaaggttcaccatgagaaatgtgttgaacattttagtatgctctattgtataatttttttggagggggggatggagtttcgctgttgttgcccaggctggagtgcaatagcacgatcttggctcaccgcaacctctgcctaccgggttcaagtgattcttgtgcctcagcctcctgagtagctgggattataggcatgcaccaccatgcccagctaattttgtatttttattagagacagggtttctccgtgttggtcaggctggtctcaaactcctgacctcaggtgatctgcctgtcttggcctccggcgtaacactttttaagaccagtgtaacagaaagagaatgtagccattctagccaccgttaaaagatacacagtgaggtgttgtgttttgtttttttaatgatgaaaagttacacattttttggagagaaaagtcttagctgaaggtaaatcaatggaaaaatgaaatttatttttaatattactactatatgaattatctttttttaaacttgtagataaaagtgttccagtaatcagaaaatcctcaagaaaattgacttcattatttggaaggaaaattagtattttttttaatattatatggaccatctgattatattttatttattcatctatttatggtatgtatgtataattctatattacactgtcaaatataaaatattgttatatgagtagaaatcacttaaattttttttgtgtttgtgaatttgaaacagtgtaagaaatcacttttaagaaaacatttttagaactccctcgtttttttttttttctttttgaaacagggtctcactctattgcccaggctggagtgcactggcgtgatctcggctcactgcaccttctgcctaccgagttcaagcgattcttgtgcttcagcctcctgagtagtcttttactatagggcctgcccccgccatgcctggctaatttttgtatttttgtagagacagggtttcaccatgttgcccagtctgttctcaaactcgtgagctagagctactcgcccacctggatgtcccaaagtgctagattccatgggtgagtcaccatgcttggccacattttagtattctaataaacagttggtcatcagaactttaaaatggtagcctacagaaacatacaattttgaatttaacagagtttcagtaaatatttccagaattaatgaagcatgttagctttaattttttcaattgtgagagaagtacatttataaaaattaagaggttaagaggttatagttataagggaaaaaacttctgtatcgattaactcctaaaatatcagtaccagcatggaattatagcaccaccttgtggttaacatgccagtattttaccttttgttaaaacaagtgatttcccatcaaacaggataatattttttcccttttgaaaaattcaattttaaaaagaaacatttttgaagttttcttatggaagatagaaaaaaagttaagtctctttctaccctttctttttttctttatatagtgcagatatacacacagagaagggacttaaaacatttctaatctcctagtttatatacagtgtgcaaaatataagtaagtatatattgaaaatataaaatatttcatatatgttatcaggtggaaatttagaatccaaattttcttaaactttaataacttgtctaacaactctctaatagggactaaaaatcaactcaatatatcatacatttacacttacaaagagtctttatctagacaacataatttttggaaaaataaagcaaattcaactttattggagttattggacagatcagcaaattgttattttaaaaagttttcttgtttaggcaatttggtaagtggtttctagttataaactagccactgttgattaacttgagaaggtgaagcaggggagttctgaagagattacctagagctacataaccctaagttaagtaaaattttcactttcattcttttcattctctcataaactggttgaaaaaacactgtactaccaacaaaggtgtcagttggttgtgctgccctgtctatgttatgctctgaataggtctcggtaaagattatatggaaatactataaagaatacataaggtaaaatactagtcagaaagggttcagaagaagttagcatcaactgtatgaaaattctaggtaaagctaagtactattgagttggaaaaaagtaattctatcatgtttgcttgttttcctgctactgtttttaatgtgatgttgtaatatattttaaaaataaaacttgaaaacgttgggactttgtttcatgccattcattactcataactttagataactgatacactcttcaggaagcataaaaattaatataaccttctcaattttataaactacaacactttttgagctcaaataacattgtaactttgatttttacttttta

SEQ ID NO: 7422 - DNA, 216 bp, Homo sapiens
aatacggtgaaaccctgtctctactaaaaatacaaaaaattagccgggcgtggtagctggcgcctgtagtcccagctactcgggaggctgaggcaggagaatggcgtgaacccgggaggcggagcttgcagtgagccgagatcgcgccactgcactcctgcctgggcgacagagcgagactccgtctcaaaaaaaaaaaaaaaaaaagaaaagaat

SEQ ID NO: 7423 - DNA, 1542 bp, Homo sapiens
ctgcctcatctcctcccagagtgtgccggggcagataacttagttgttctgagagaggtgaccccctctcagtgtccatgagtcccagatgaattggccaagtcctagaaatagaggggctgcagagcggggaggaagaggtcccaatgaccagcccttgactgccaccgtttgtcactggccccctggccctgttcccgtgatcccagtcagatgccacatttttataataaaactagggctgagcaggaaggcgctggcaggagttcattaccttgcttattttcaaactcttcctaacccttctgtcctggttgttgtttgacctgaaagatgaagagaacactgctgtcttctgtcatctgtctttctgcttcacctgcacagggccaagccccgtggcagtgcccagcggtcactggggacagtgctgaggttacttatcctgagaaacccttgcacggcctgtcccgcagagaaaagacagcccttccgggtccctggtttggtctgagtcgtgggaaaggaccctagggcatcacaatcgcagcctgtaccctgcagctcacagagtcaatcagtttggttttatttgcatttgaacagaaaccttgagaaaaagaaagccaatttgtttatcttctaggggataaaaataggcaagtgtggcagccctgtggccacgcaggtcagacactgcagcagtgacactggggttttattaatcaataggatgtagctcacttgttctgtccttttaaaaaaaaaagcccaccctggagaagagatgcttggcccagctcctacacaagggcagcagtcatctccggtccagggagctcttctggaggtttttgcaagtagattctagagaactgagagaacaagaagtcttccccactctgggcacatggaatcttcattcaaagagtttggtttgaattgagagctctcagttttgcatatcaggtaactatgatgtgaaaagatgaagcggcctctttacctctcagagtcagcccagaccctcttcgcctcccctcctctcagagaagctccctcgtccctttctcctccttttgactagagctagtgggtggagagagtaactgaacgggaatttcttagtgttattctctatcaataatatattttaattgtcagtgctatagactgggtggctgggggttgggagctggtggctcttgaaaatcaccaagtggcagaaaggaagttataggaagaacataaaggcttagtgccagtggtgtcaggtaatgcatattgatacctcaactaaaagaacatttggggctttattaaaattgactaattcttccaaagatagcagctaaaggaggacttagatgaatagaggagggaggaggcttgcaggacggtgaagccctttgcttccagctctctgcctgctcagccattgctccgtccctctgcagttagattattccttgcagatagcaatcaactggaaggaagtgtctgtgtctaatttgcatgagattatttaaaacaacaacaaaa

SEQ ID NO: 7424 - DNA, 856 bp, Homo sapiens
gggaaaattatcttcatttgcagccagcggctgacaaggcacacgaaccaccaggtttataaaattccgtagtgtaccagtgaccatcagcctgtgctgacatcgcagatgctgctttcttctctaatggctgattatgaactggttaaaacaatgtctttcccaccagggctccgaaaggggttccccttcctgtttagtcggagcgatcggcagtcactacacaggctggaacctgagaggcacaaactcagggcgggggtattctctgttgttgcctggcttgcctgttggtcctgtccctgttcttcttggaaggtgaaattatgggtaaagcagtccctttgcagcaagcaccccctctctagctccactctactgaccttcagcttttgtctttggaaggtggtacgtgatgcgctgtgaaccctggaagcattttcatccagcccaccaatctgttgagagcatggtgctatcagggcaacccggtggctcttcagacttcccagtggtgaggctgtgcctgcccttggccagctccactgtgtgaagagggtaaagaggggaacagctgcagttttaaatggggatagtcctcaactcctcagcacagagaagggaaaaaagagtccagggctgtttagaaaagttcgggcattttcctttgactagctgtggtagggcatgaaaagtttgaggggtggctgcagtcaactcatatgccagtatggtgcagggcggagctgtgctttaaagcattaatgtgcaccatctattagcccctaggcatggagtatgaggcaccatccttttgaagatgctgatcctcagaacctccttgtacttcatctac

SEQ ID NO: 7425 - DNA, 1044 bp, Homo sapiens
taagaccaacacatgggactgctatacatggttcttctcaaatccattgttttcttttctggtgtaagtgaagaattgaaggcttatggggtcggtctacagaccgttattgagttcctacagaatacccggttctgggcttggcgctggatcagtcaggccctgttgggtcttgcactcaaatgacaaacgtacaaggcttacaccgtgtgtcagatggcaatggtgaagcagcatcagggagttggggaggagaggtggactgctttttttattggagggaggtcaagaaggatgcctgaataaggtaacatttgagcagagtcctaaagacagtgaggggacaaatcatcagactagcaggggaaaaagaactccaggtggggggaacagcaacggcaaaggctgtgaggtagaaacgcaataacgtgtttgaggaataaggaggccagggtggctggaatggaggttagcaagggaatgagggtagggggcaggttctgcggggcttttgttaggatttctcttggaggaaaggcttattaccacagtgactgagagtgctgccattagcctatgaccctcagctgtcagcttgttcagaggtggcttagctgcagatggctggcttcccacatccgatgactgaccacagtagggatatgagggtctgaccatttctgcccaatgctgtccaactctgatgggccattccagttccaaggctccctgcgggactgatggaggctgttcatgggactgtatccctccctggcttctccctctgcccagttctcatgcctttccttcctttccactggtattgatcccaagggtacatgcttagtgccatctcaggactcagtttctccatttagtgtgattgaactacgtgcatttgccagccctgtagtcccagctactaaagaggattgcttgagcccaggagttcgaggctggaatgagctatgattgcaccactggactccagcctgggcaacatagcaagactccgtctctctaaaaaaagaaaaaaaaaaaagg

SEQ ID NO: 7426 - DNA, 286 bp, Homo sapiens
ctctctctctttttttttttttttttgagacagagtcttgctctgtcacccaggctggagtgcagtggtgcaatctcggctcactgcaacctccgccttccaggttcaagcgattctcctgcctcagcctcccgaatagctgggactacaggcgcccgccacctcgcccggctaattttttgtatttttagtagagacggggtttcaccgtgttaaccaggatggtctcgatctcctgacctcatgatccacccgcctcggcctcccaaagttctgagattacagg

SEQ ID NO: 7427 - DNA, 1982 bp, Homo sapiens
gggcaagtacacgtaccctgcactccgggaggaggccccaagggaacacgtggagagcttcttccaggtacttgggagtgggtaggctggagggccctggagtgaagggaagaaggccaagaaccagcagggaactcacctgacttctgtctgcctctctcttgccatccctcctgttctccctgcctgaccaccttcttgcagaagatggacagaaacaaggatggtgtggtgaccattgaggaattcattgagtcttgtcaaaaggtacagctccctgccctctacattaccctgacctggactcaggcctgatttagtaatgcagggaaaagcttctttgggaagaataccaccttcccacctcacccccatatttcaatcctattcctttgtgggaggcttaccccttccctacctcaggtctctctgggcatctccttcctctgtgcttttgaatgtccccgtctgtgactcagtgtccctctcactgtctctgataagctccttctctttctctctcttcaatctgcctcgctcacatcatggccacaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgca

SEQ ID NO: 7428 - DNA, 1982 bp, Homo sapiens; identical to SEQ ID NO: 7427

SEQ ID NO: 7429 - DNA, 302 bp, Homo sapiens
gggccgggcgcagtggctcacacctgtaatgccagcactttgggaggctgaggtgggcagatcacgaggtcaggagattgagaccatcctggataacacagtgaaaccctgtctctactaaaaatacaaaaaattagccgggcatggtggcaggcgcctgtagtcccagctactcgggaggctgaggcaggagaatggcgtgaacccaggaggcggagcttgcagtgagccgagatcgtgccactgcactccagcctgggtgacagagcgagactccatctcagaaaaaaaaaaccaaagaa

SEQ ID NO: 7430 - DNA, 544 bp, Homo sapiens
tcagtttcgttccatgttttttatttgtgcactgggaaagaagtcttccctcccatcacatgagccacgtggtgagtcctctggaggcttgaagattatccccctccctgggagtcttgggccatggagggtgggggcggtgaacggaaggggattttgtctctgccctcagcctggtgccctctccttccaggaatgtcccagcggaattgtcaatgaggagaacttcaagcagatttactcccagttctttcctcaaggaggtgaggggacaaggcccaaggggaagcagttgtccttctctaggctgagggagggagggattctggaggagctgggaatgccaaggtgatggggggtatggggagctccttagagggaggaagtcctctcctgtgtggaagccaacttctccacactcaccctgcagactccagcacctatgccacttttctcttcaatgcctttgacaccaaccatgatggctcggtcagttttgaggtgagctgggcgaggtgggccagggaagcctgtttcctggagt

SEQ ID NO: 7431 - DNA, 544 bp, Homo sapiens; identical to SEQ ID NO: 7430

SEQ ID NO: 7432 - DNA, 302 bp, Homo sapiens; identical to SEQ ID NO: 7429

SEQ ID NO: 7433 - DNA, 14161 bp, Homo sapiens
tcacttttctaacaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtatgattattgaaattcaatttttttttcaagatttaaaccaggcaaaaggcaagaatgacagtattgcatatcatctgttttatggtctgttcagtttatagccccttaaaataataattggttttacatctttttaaaggagaggtgaaaaggataacttctgtgtattcccgataaatgtatcattctctcgagtagtccatagctgaagtcttggaatcatatttgactttatcacttatccgttatattgagtcagtagacaagtctttttaaatccttgctttgaaaagtctgttgttcctgtctctttctattttcacacagtttatcacttcacaattcgattgttacaatagcttagtaactaatatttctgcctccaagatctgatcccccccaaatccacctggcatacgctggccgatgaaatctcttatttaacccttttatattgttacttcctgttgattgcctgttgcctatagaatcaaattcaaactccttgcctggccttctatagtctagtctgaatttttgcctgccagcggttggtagcataaactctggctcaaatcaaagtttcttcttattcagtgctctggactctgtttatttccatagtcgatttcccccacgaggttatcctgtccctgatttcttacctttctgccaagactcagctcaggtctcacttcctccatgtaaccttcaaccattttagccttattccttctgctctaaattactatgaggaaacttattctcccagcccttatttatgctgcaaaagtggcttattgccttctattacttattattttacatatgtccttagtgaggttagtccctcaacagcagaagccatatattacatggtcatgggtcacttaactgcaggcatacattctgagaaatgtgccattaggtgattttgtcatctttggaacttacacaaacctaggtggtatagcctactgcacacaaaggctgtaatggtatagtctcttgctccagccaacatcgtacatgtaatctgttaacaaaaatgctgcccagcacatgactgtacttgtgtagatctggcatctggctttatagcaccaaacttacgttagacacataacggatgcttagtaaaatatgtatgaattgaagtacatacttgcagcttttagcttaatttgcagaatccagtgctttttcgtatttcttatcagatgcattcctaactaaatagtcgcttatgttttttaatagaaaggaaactattaatacatttgaaatcttgcccagttttgtcaagggcctgtttttgtgttattattggcaaatccaatcttcctgtgggaaataaaaattgaaaagggaagaagttaatctgtagagtttgtctcagcttcaaacctgtgattttcactactcattcagcagtaagaagtcatagtgttctagaaagatttaggaaagtagtaataatttgatgatgaagataatagaagcaaagtatcagatacaagtttattatagtaatataagtattagttaaaggttctgatgagggttgtcgaaacctgatgaaaaaggatgattataataaacacgtcaaatgttaaccagtaagacctggttatgaataagcaagttttttattttgaaactgaaattaacatttaatatactggtggccaaaagcgccgtgtttaaaaatgggtcagagactggtgtacttcacatgacactagtaaaaatgtgattttactatgggttttactccttttcttccaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacaggtatgtatatgtgtgcttacatcttgggaggaggtaaatggaagcagagattgactattggtaagctggggtctagattcatatgacctgtgtttctgcatctcctcggccttttcctcctccttcccttatacttaaaatttcaaagcagggaagtggataagtttcacatacatttggaccagcaaattttcctgttgttctcagatatgtatgtaaatcttttaaccaaagaatatgctgtgctttttaagatatcgataaacattataaataaatgtttaagacactgatgtatagtactagcaaagcaagatgttatttaaaactatctctgcatatacatgcagtgtctgctggttaccatgaataacttttcatttctattttcatggtaactgcaaatgttatattgtgtattacaccttccctgagaagtgaatgcttggctgggcacagtggctagtactttgggaggccaaggcaagaggaccgcttgagttcaggggttcaagaccagcctgggcaatgtagtaagaccctgtctctacaaaaaaaaaaatttaaaaattagctaggcatagtggcgcgtgcttgtggtctagctactcaggaagctagaggtgagaggatctcttcagcccaggaagttaaggctgcagtgagccgtgatccagcctgggcttcagcctgggcaacagcaaaaccccatctcaaagaacaaaaaaagaaaatagaagcaaatgctatttctgcatttgctgtaacaagtagtgcagacatgtcatgaaacattcaaaagtataagaagaaattatgcaaatttcctatttcaatttctagagataatcactgtaagcatgaactgatttaaatttaaatataaaacaaaagccgggcaagttggctcctacctgtaatcccagcactttaggaggccaaggtgggtggatcacctgaggtagggagttcgagaccagcctggccaacatggtgaaaccccatctctactaaaaatacaaaaattagccggggatggcattgcatgcctgtagtcccagtcccagctacttgagaggctgaggcaggagaatcacttgaacctgagagagacagaggttgcagtgagccaagatcgtatcacggcactccagcttgggtgacaaagtgagactccatctcaaaaaataaaataaataaatataaaacatataataaaactccataattcttaaattatgaaagcccagagttgtcaagaatgtaataaattctctcttagactgctcgtgggaatataatttggttataactttccctgtgtaatcctgacagtcttttttctcagccatgattttggacactgccgtgattaatttgaaaggacgatactttgcctggacttgttaaaagaaaatgtgaatttaaaagatgttaaattttaattaaggttgtttttaattgttttgaagcaacatagtcttcattaataataaaattgctggacagaatgatttttaaaagacagcctatcagttttaatgaagtatctagtttttaaaatgggtgcgttagtagagcttttatatatttttcccttcctccttccttcctttctttctgaaaagttactagaaaagaaataatagtgaacaaaactgatctagaagaaaagatggaaggcacataaaacactaggaatgaaataaggcataattataactatgcaggagctcgtgtatcacaagaacaggtgcagctttagtgcactaagtttgaaaagctgaatgaagcttactatagtaaaataccagttattaaaattggcttgcagaaattcgtccaatataagtaaacaaccaatagcaaccaggtgtaaatagttttataggctaattctaccaaacctttaaggaacatataatttctgtgttctagaacttgggaaaagatggagagttcaaaactcacaccgtatgcctagtataacctcaatgccaaaccagacgtggcacgcacagaaaaataaaatcagaccaaagtcatttggaaaaaaaattcctatatttatgattcaaaactcagttattttataaaataataatattaagtggataaagaaacgccagttgtactatcagctaaacattagaaaccttctcatcaggccaggtgaggtggctcatgcctgtaatcccagcactttgggaggccaaggcgggcggatcacctgaggttgggagttcaagaccagcctggccaacatggagaaaccctgtctctactaaaaatacaaaattagccaggcatggtggcacatgtctgtaaacccagctactcaggaggctcaggcaggagaattgcttgaacccggaaggcggaggttgcggtgagccgagatcacgccattgcactgggcaacaagagcgaaactccgtctcaaaaaaaaaaaaaaaaaaaatcaaaatcagaaagaaaatgcttgttaaaacttacgttattctctctgattcagaatacctagagcatggacttgaaactaggtagtttacaaaaaacaaaacagaaaacatttgtattattccattttattttagaagtcctggccaatgcactaagcaataaaaagaattaaaacgtataaacattgagaagaaaaaacaaaaatagttttgcaaatgacttgattatgtacttagaaaatatgaaggaactgaaaatttattgtagccagtaacaggaatcagagtgtttgctgtaagagaaacaaaaaattgtatatatcagcaataaccaacagaagctgtaatgacagctgggtacagtggcatgcacctgtaatcctagcttcccaggaggctgaggcaggaggattgcttgggcccaggagttcatggctgcattgcgcagtgatcaaggctgtgaatagctactgctctccatcctcagcagcacagcaagactccatctctacagaaagaaaagaaaggagggaagtggggagggagaaaaaaaagaaagaaagaaatttaatggtaggtaccaaggatggggataccattgaccagagaaaaggaagggagggagggaggggaaaaaaaaaaaaagaaatttaatggtgggtccccaaggatggggataccattgaccagagaaggggtaaagaagaaaaaatgatggacaaaatatgtttaaatgttggcactatttggactgacacttttaaccattatttactctttgttaactgtttggagttagtaaaacaaatacattctcttttgttaattcatacatagatattctgcctccatggtggcctctctccatccatagacacactggatcatataagagccctggatcgtttacaggaagttccacatgaggtaaacttaatttaaaaaagaagaagaaaggaaaagaaaatataaccacattttgaggatgataaagtatgactgataataatttgtaacatgtacttatttttcttggccagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggaggtatgtactttcctgacagaatgatctttatttcagattagtatatacttctgtaataaggcattatgacttaactaagaaacattcctcaccatttattacctaggtgaaaagaggaaaaacttgctggttttagcaagtagggaaagcactagtagaccagagcagaattataactcatttttgaaattgagacttagaaaaaagttacaaaaatagtaccccataattccctgtatgcttcattcagattcctgactgtaaatattttactatatttgctttatcattttgtgtctctcttcctcttcacccctcacactttcttctgaaccatttgaatatctgttgcagacagatactcctttactaccaactttctatgtgtattttgtaaaattaaggacacactgtcacataaccaccgtatagttatcacagttgggaaatttgtgttcatatagtactgttatttaatatgaacactttattcaaattttgctaattgtctcactaatgtctttaatagcaaaatttaattttttgtgcatactgtatgtgcatagtcgaatccaaagattaggttgtattcattctactttgatgtggaaatcctccgattttcattgttttccacattcttgacattttggaagagtaggagcattttatcttacagaaatatccctcagttggggtttgcctgatgttttccttgcagttagggattcaatgtatgcatttttggcagtcatgacatagaaagatggtgtgtcctcctccgtgcattgtatcaagtggtcctaaaatctgcttgtctcaatgctggtggtggcaactttaattgcttagttaagatgatgtctgccagatttctccactataatattaactgttatacaactactaagggaacataaacaacataatccctgcagaccagtagggagtggcttcaagatgtttagagaaaacttcgccagcccagtagaaacaagggagcatgataaaaaaaacacaaatttacatagtaaaaataaatttaattatatcagtgattataagaaagagactaaaattttagcctgaaagagactcttagattggataaataatcaaaatttagctgttatttgggatgtacctaaaacataaatgattggctggacaaagtggctcatgcctataatcccagcactttgggaggccgaggtgggaggatctcttgagtcttggagtttcagaccagcctgggcaacatagtgagacctcatctctatataaaaaaaaaaaaaaagtcaaaaagttagctgggcatggtggcatatgtctattgtcccagctactcaggaggctgaggtgagagggtcacttgaggccaggaggttgaggctgcagtgagctatgatcgtaccgctgcactccagcctgggcaaaagggtgagaccttgtctcaaaaaaacgaggaaaaagaaaaagacaccacaaactagaggtaagagttggaaaatggtatattggtatatcaagtaattaatcaaaatatcaaaaatatagctaatgagctggcgtggtggctcgtgcctctattcccagcactttgggaggctgaggcaagcggattgctggagctcaggagttcgagaccagcctgggcaacatggtgagatcctgtctctactaaaatacaaaaaattaacctggtgtggtggcacgcacctgtagtcccaactactcggggctgaggcaggagaattgcttgaacccaggagttggaggttgcagtgagtctagatcgcaccactgcactccagcctgggcaacacaggatgtgtgtgtgtgtgtatatacacacatacatacactaatgtatgtatatatatgtatacatatatacacacatgtatgtgtgtatacatatatgcacacgtatatatacacatatacacacgtatacatatatgcgcacacatacatgtatacatacatatatacgtgtatgtatatacacatgtatatacacatgtatacatatatgcacacacatatatacatatatacacgtatatatacatatgtatatacacatacattaattagcatgtatgtatacacactatatataatactatagctaataatatgaatgagataggctctaataaaaggtattattagaaataaagagattattgatgaaaactggcccagttctctaggaagaaagtattctaaatttgtatttacctagtaatagcttcaaaatatataaagaaaaaattggcataattcatgagggaaaattgagaaattaattatgattgtgggagaaattcagtacacatccttgccaagatttcaagcatagatacggcaaaacaacaattagcgagctgcatttaacagactcctaggcccacgaattgcacagtattctttacaggtacacaaactattaaagatggagaccttatatagtaatatagacgactacatttccacagagagtacctgtagtttttgagtttagttttttttaaatgtgtctgtgtcaaaatcataatattataatgaaataatgaatttgtttttatcctgcagggatacaattggtgtcatgatcggaatgtggttaccattttcagtgcacccaattactgttatcgttgtgggaaccaggctgctatcatggaattagatgacactttaaaatattccttgtgagtaactgtaaattttaattgtatatactttcagaaggaaaattttaaatgttaaaaatagaagatttctgtttctgaaattggatgaggagtatagcaaagcccctctccagcaaaaataaccattagctggagaacattatttttaaaaaataatttttcaaagcttttggaaattgtcctaagggcatacagcaggtggagaaacagttaattcaagaaaacctactaaatctcagtaataatagccgtagtctgtggcatttgagctatgacttgccccctccaactcctcccagatccctctcacagaaacgactacaggcgctctacgctgggttggtatagtcaggaggctaagggattccccctcttcatcagctcccagggctggggctgtgggttcactcccagagatcagatgccagcatatctcacctctcctagtctggagttacaaaagctctactcctggtagacacagtcaagcaggctgaggcccccttccctgccccagctcctggggcagaagctctgctccaggcatgcatggcagatgagaatgctgggtttcccaatgctgttaccccagcacctgcttataaaccaggtggtatcactgagcctgcactggcacagaagttctgctcaggaggaaaggcaggtcacagaagttcctcagctctgcctcagaggacttatcttacttaggtgatggagaattccaaatctgagtgctttgtggaaagcagtagatgtcatggtggagaccaattaagagggctgtaatagctcccatgatactaggagcaacatacaaaagagcagagcaacatgttgttcaacaaatagcaccagggaaaaagccaagaagagcccttctgggatcacagtcagccctgggggacaagaaggctgtgcacatgcactagccatacccactcaggagcagtcaagagtaggatgtggggtattcatataatattttcaagccacacatagattgtactgagttgaataatgtccccccaaaaaaattcatgtccacccagaacctcaaaatgtgatgttatttggaaataggatctttacagatataattattaaagatgagattgtactggattagggtgggcctaaatccaattcgaatgggattttagtaagaggaaaagaaacacacacaggggagaatgctgtgtgaagccagagattcaagtgatgcatctaccagctaaggattgccagagccatcagaagctagggagaggctaggaaggatttttcctagagccttcagagagagcgtggtcctcccagcatcttgctttcagacttgtagcctccagaactgtgagaggataaatccccgttgtataagctatacagttcggtaatttgttacggcagccccaggaaatggataagtagattgatcaacaaatggtgtaaccatcactagtatgtgaggcttaaacacaacctctcatcattgactgaacgacattcagttactctgatccaggagcacctcctaggtagtcaggctttaaaataaaatcacactcatccctgacagtctggcagaatatgtgcatgcccaaggttataccctctctggactgagtgcagtatgaagatccaactattagtccctggctgaatgggaagccaaaatataaactccttcagctttgatagcaatctgcaagtcacataacatttccggtggccattagggtgagctttaagatctaactggccaagggggcttaagtacaatctttgatcagtaagtggcttatgcctacccagagacagcccctcagtagccaggctgtgaaagattaaaagaagtaaaaacggtcaggcacggtggctcatgcctgtaatcccagcactttgggaagccgaggtgggcggatcacctgaggtcgggagttcaagaccagcctgaccaacatggagaaacccagtctctattaaaaatacaaaattagttgggtgtggtggcgcatgcctgtaatcccagctactcaggaggctgaggcaggagaatcgcttgaacctgggaggcggcggcgatcacgccattgcagtccagcctgggcaacaaaagtgaaactcaaaaaaaaaaaaaaaaagtaaaaacatccgagcagggccacaggggctgcacactatgggggaagtagactttacagttagttcagctaagtcactaaacaaaaataataaaccaccaaaaagacaagatcagtccccaaggacatgaattccagagctactgcaatatgttatctataatgtccaatttttcaaccacagattataagacatggaaagaacaaggaagtgtgacctctacacaggaaaaaactaagcaacagaaactgtttctcttggatagaacaactaggcaggagatgaaggcaggagaagacttgagcaacactgtaaactgactgtatacctcatgtctgtaaaacaacacccaacaacagcagaatactttcctctcaagtaaacatgaaacatagtcatatgctagactgtaaaacatgcctcaggcaatttaagaagattagattcttaaaaggatattctccaaacacaaggaaatgaaattagaaatcattaacatggctggatgctgtggctcacacaagtaatcccaacactttgggaagccaaagtaggaggatcacttgaggccagcctgggcaacatagggagaccccgtctctacaaaaaaatttaaaaattagccaggtatggtgccaagcacctgtagtctcagctgtatgggaggctgagatggaggatcacttgagcccagttgatcaaggctgcaatgagctatgatcacagcactacactacagcctaggcaacagagcaaagaccctgtctcagaaagaaaaaaacaaaaaaaaaaacaagaagatttgaaatcagtaacctatctttatacttgaggacctagaaaaagcagagtaaactaaacctgatgtaagcttatgaaacgaggtttagagtagaaataaacaaacagtagaaaatcattacagaaaaatcaacaaaacccaaagttgatgctttgaaaagccttaactagactggccaagaaaaaaaggagtaaagactcacattaccaaatcactagagaccttactgaaataaaaaggattataagggaatacaataaataactatatgccagcaaattcagtaactttgataaaacgtactaattcctaaaaagaaactactgaaactgactcaagaaatatgaaatctgaatgacctttcaaatgtgaaaatattgagccagcatggtggctcacacctataaatcccagctttgggaggccaagctgagaggattgcttgagactaggagtttgagaccagcctggacaacatagcaggaccttgtccctatttaatttaaaagaatataaataaatgagtgaaaaagttaaaactccccacaaataaaaggccaagcccaattggcttcattgatgaagtccaccaaatgtttaaagaaaggaattggccaggtgcggtggctctaaccagtaatcctagcactttgggaagccaaggcaggcagattgagcccaggattcaagatcagcctgggtaacatggtaaaaccctgtatctacaaagaatacaaaaattaacctggtgtggtggctcagcctatagtctcagctactcaggaagctgaagtgggaggatcacctgagcccagggaggttgaggctacagtgagccatgatcacaccactgcactccagcttgggcaacagagtgagaccctgtctcaaaaataaaaacgagttaatgccaatccttcacaaacacttccaaaaaacagaagaggaggactactgcattcattctgtcacacctgcactattatccttgataccaaaagtagacaaaggcaaaaacagaccagcatttgttacgaatacagatataaaattttccaacatacgtaccagcaacctggatctagcaatatgtaaaaagattatacaccatgagcaagtgggatttatcccaggaatgctaggttggttcaaaacatgaaaatcaatataataaaccatattaatattaagggattaaaaaacacatgatcatctcaatagaggcacaaaaataattggaaaaatccactagccagaaacactcaagaaaatagtgatattaggcctggcgcggtggctcacgcctgtaatcccagcactttgggaggccgaagcgggtggatcatgaggtcaggagatgagaccatcctggctaacacggtgaaaccccgtctctactaaaaaaaaataagaaaattagccgggcatggtaatgggttcctgtagtcccagctactcaggaggctgaggcaggagaatggtatgaacccaggaggcggagcttgcaataagccgagatcgtgccagtgcactccagcctgggcgacagagcaagactctgcctcaaaaaaaaaaaaaaaaaaagtgatattattattattattaaataatattaaacaattattgtttaattatttaaacttgatattatttaatctttaattatttaagcttttaaataataataacatttagaaattgttatgccaggcaccaaaccagacattctgtcttcttaaattttcaccatagccctatgaagcagttagttggaatgggagcatctgcagtgatttgcccatggccattccagccgtaagtgatgtagtcatggtgggaaagcaggactgctgtttctactacagtgtcttgttctttattcatttgttttctttgcaaagtcagatcctttatttgcttccttttttgccatttacagccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaacattca

SEQ ID NO: 7434 - DNA, 767 bp, Homo sapiens
agaacatttcatttgccagtgtttaagcataaattctgtacttcagggccacctaatggtattttctaacttaattctataaatataaaataattggaataaagaaattcaaggttggcctatgaattggtgtaagaatgtttgttcacacaagaatttgcataatttgtgacttttttctttcattgacctttttaaacttgtgaataataagattattctttttaaaacacagaccttctgccttgaagatttgcctattctggacatttcatgtaaatggaattgtacattatgtgatcatttgtgactgacttcttgcacttaccataatgtcttcaaagttgtagcatgtatcagtacttcatttcttcatagctgagtgactattccattgtatgaatatgttatgtccattcatcggttgatcaatatctggtggtttctactttttggctgttattaataatgctgccatgaacatgtataaactggatttcatttctcttgagtatatacctaggagtggaactgctggattacatggtaattttaggtttaactttggaggaactgccagacagttttccacagcagctgcaccattttgcatttccaccagcagtgtatgagggttccagtttatccacatgtttgcaacacttattaactgtcttttttattatagcctttctaatgaaagtgttatctcgtggtttggttttcacatacgcttttataaggcacttttcaagtgtttttttccc

SEQ ID NO: 7435 - DNA, 473 bp, Homo sapiens
ttttttggggggacagggtctcactttgggttgccccaggctggagtgcaatggcccaatcacaactcactgcagccttgacaataaatcagttttagaatattttcatgatttcagtctctctcttgacctgtgttgattttcattgccaccaaccagccccaggcaaccactaatctacttctgtctacagatttactacttctggacagctcatatcagtggaatcacataaattgtttttgtgcaggtttttcactagcgtgtcctgaagttcctccatgtcgtatttaacagttcattcttttattcctaagcagcttgccatggtgtgaatataacacatttctctctatgcattcatcagttgatgtgtccatttgaaacatttaggctatttccaatttttagttattaaagtaattattgtcatggttgctcaatttggtaaatttaccaagaatctttaaatt

SEQ ID NO: 7436 - DNA, 1204 bp, Homo sapiens
ggccgcagccacagcttgcacgttgcgccgggtgtgtctgtgcgtgccagctgcatctttgcgtaccatgtgtgcaaggctgtgtttggctgagtgttcatgtgggccgtgattgtgggcatgtttctgagtgtctgagtgatgcctgctggtgtgggctggtgggtgtgtctgcatgtgcgtgtgtgtctggggagtttcaaaggagaaagagggactcaccatcacgctggctcagccttaaaaaggtaggacatcctgacacgtgctgcaacatggatggaccttaaggacattgtgctgagtgaaacaagccagaggcaaaggaacaaacatgtgatttctcccagatgaggtttccggaggaggcagatctgtatggacagaaggtagcatggtggttgccggggcagggggaggagagaatggagaattagtgtttaatggggacagagtttcagttggggaaggtgaaaaggttctggagctggatgatggtgatggttggacaacactgtgcatgcacttaataccactgagctggacacctaaaaatgcttacaatggtaaatttcatgtatattttactacaatttttaaaaaattggctgggcgtggtggcttatgcctgtaatcccaacactttgggaggccaaggcgggaggattgcttgagctcaggagttcaacaccagcctgggcaatatggtgaaaccccgactctacgaaatatacaaaaattagcctggtgtggtggcttgcacctctaatcccacctactcagtaggctaaggcacaagaatctcttgaacctgggaggtggaggttgcagtaagccgagatcatgccactgcaacccagtctgggcgacagagcaagactctgtctcaaaaaataaaagataaataaaaaaattagaggccaggtgtggctcacacctgtactctcaacactttgggaggctgaggtgggaggatcgcttgaagtcaggcatttaagacatgcctaggcaacatagtgagaccttgactctacaaaaaaattcaaaagttaatgagacatggtggcatgtgcctgtagtcctagctgctggggaggctgaggtgggaggatcacttacgaccaggatttcaaggctgcagtgagctgtgattgcatcactgcactccagcctggtgacagagtgaggccctgtctcaaaaaaa

SEQ ID NO: 7437 - DNA, 1204 bp, Homo sapiens; identical to SEQ ID NO: 7436

SEQ ID NO: 7438 - DNA, 1204 bp, Homo sapiens
ggccgcagccacagcttgcacgttgcgccgggtgtgtctgtgcgtgccagctgcatctttgcgtaccatgtgtgcaaggctgtgtttggctgagtgttcatgtgggccgtgattgtgggcatgtttctgagtgtctgagtgatgcctgctggtgtgggctggtgggtgtgtctgcatgtgcgtgtgtgtctggggagtttcaaaggagaaagagggactcaccatcacgctggctcagccttaaaaaggtaggacatcctgacacgtgctgcaacatggatggaccttaaggacattgtgctgagtgaaacaagccagaggcaaaggaacaaacatgtgatttctcccagatgaggtttctggaggaggcagatctgtatggacagaaggtagcatggtggttgccggggcagggggaggagagaatggagaattagtgtttaatggggacagagtttcagttggggaaggtgaaaaggttctggagctggatgatggtgatggttggacaacactgtgcatgcacttaataccactgagctggacacctaaaaatgcttacaatggtaaatttcatgtatattttactacaatttttaaaaaattggctgggcgtggtggcttatgcctgtaatcccaacactttgggaggccaaggcgggaggattgcttgagctcaggagttcaacaccagcctgggcaatatggtgaaaccccgactctacgaaatatacaaaaattagcctggtgtggtggcttgcacctctaatcccacctactcagtaggctaaggcacaagaatctcttgaacctgggaggtggaggttgcagtaagccgagatcatgccactgcaacccagtctgggcgacagagcaagactctgtctcaaaaaataaaagataaataaaaaaattagaggccaggtgtggctcacacctgtactctcaacactttgggaggctgaggtgggaggatcgcttgaagtcaggcatttaagacatgcctaggcaacatagtgagaccttgactctacaaaaaaattcaaaagttaatgagacatggtggcatgtgcctgtagtcctagctgctggggaggctgaggtgggaggatcacttacgaccaggatttcaaggctgcagtgagctgtgattgcatcactgcactccagcctggtgacagagtgaggccctgtctcaaaaaaa

SEQ ID NO: 7439 - DNA, 504 bp, Homo sapiens
caactgggaggcctcccttctccagacccatggggacaacaccacccagctactggttctataagctgctgtatggctctggctagcccattcagagaaagcctctgaaagtacaaggaaaaaaatcagtccaagagctgtgaacaattagtgagccgattacaataccaagaccacaggcagacctggaaggctaagtgagcccaggtgtgaagttcaagcttactttacttctgggccacttcctggctggtctctttccctggcccttatctttctcctggtctgtcttctcttctcaccccctttctttactctttcttccttctcctgcatcgtactccacccccactccagctattacacagaatcgcgagaatgttggattattcattttatttatgatgttttcttttttgtaaaaatagagacaaggtctcactatgtggcccaggctggtcttgaactcctggcctcaagcaatcctcgtgccttggcctctta

SEQ ID NO: 7440 - DNA, 332 bp, Homo sapiens
caactgggaggcctcccttctccagacccatggggacaacaccacccagctactggttctataagctgctgtatggctctggctagcccattcagagaaagcctctgaaagtacaaggaaaaaaatcagtccaagagctgtgaacaattagtgagccgattacaataccaagaccacaggcagacctggaaggctaagtgagcccaggtgtgaagttcaagcttactttacttctgggccacttcctggctggtctctttccctggcccttatctttctcctggtctgtcttctcttctcaccccctttctttactctttcttccttctcct

SEQ ID NO: 7441 - DNA, 332 bp, Homo sapiens; identical to SEQ ID NO: 7440

SEQ ID NO: 7442 - DNA, 5669 bp, Homo sapiens
ggatcaacaactgcgtgggaagccggaattattggtgaggggcacagaggggatggccggcacgggccaggcttgggggaatttggaagggaggggtctgtgggcaggggtcatcgtgttgaaagggtggagggtcctcttggggccgcgtccctgtcctgatgtggtggcgcttggtgcctgcgtgccccggcctcctgtctggctctggggctgtggtgcagccgtccctggacaagctcatccgcatagagtaagtccctggaggccccccgggggcacttgcggggccacgctggctgaggcctcctgaccacgctgtcctgggctgggctgccttctctccacccaggctgaggctcatccagcacaagggtggggccacggaagggcagtgggcacccagcgcagatgggcgagaggtgtttcccctgagcatggtcgaggctcacagatgagaggtgtttccctgagcacggtggaggctcatagacgagaggtgtttcccctgagcacggtggagatgcaaggaagagagatgtttccctgagcacggtggaggcttacagatgagaggtgtttccactgagcatggtggaggctcacaggcgagaggtctttcccctgagcacggtggaggcgcaaggatgagaggtgtttccactgaggatggtggaggtgcaagaacgagaggtgtttcccctgagcacggtggaggctcacagatgagacgtgtttcccctgagcacggtggaggctcatagacgagaggtgtttcccctgagcacggtggaggctcaagaacgagaggtgtttcccctgagcatggtggaggctcaaggacgagaggtgtttcccctgagcatggtggaggctcacaggcgagaggtatttcccctgagcacggtggaggcgcaaggatgagaggtgtttccactgaggatggtggaggtgcaagaacgagaggtgtttcccctgagcacggtggagactcacagatgagacgtgtttcccctgagcacggtggaggctcaagaacgagaggttgtttcccctgagcacggtggaggctcatagatgagaggtgtttcccctgagcacagtggaggatccagggactctcaaggccccgtgtgctgagccccggctgtctgcagcactgtattgtgaagatcaccagggaaaagaaccacgcctgctccccagctactctgtgctgacctgaaagaggccttggtgtgcgtgggagtggggaccaacgttgcctggtgtcacaggacgcaccgggcggtccctgccctgcctccctgccatcccgtctggagcacagcatgtgtccagagaggctgagcagcccggcagggacagagaggttgcatgaccgcacagcgagtccagaggctgcgtgagatggtaggggccggggagacccaccggcctcctcccctggagaagagcagctccacgatggccaaggtggggccagctcctctggctcatgctagccccaggtgccacttccttctggactcattctgctctggtgcctcgagctggctcaatctggcgggtcctggtggggaaggtgagggggtgagggcccacaggcaggtggcaaggagagggtctgccttcctcaggaggggtgctggagagggaccacgtgggtgccaagtgtagacaccgcctgggtgtgggaaaggggcatcaggagagcagggccggggtcatgggcgccctcagctccaggcagcagccaacgccggcatctgtgccaacctcgcttctgtcccttcatccgccagaggcggagagagcaacggcattgagagcaagatgaggaaagttgaggagctgatggcagagcccccgcgagggaggccgagctgatggcggagcccccatggggaggcccagctgatggcagagcccctgtgagggaggctgcatacttcgtagtgataagagaggaagggggacggaaagaaggcaggcggcgctggtgtcctgggaagactgtgagcgctggcctcggactctgcaggttaaacacaggcagcaggggcaggaggctgtgctaaccaagaggagaatgtccctgggtggctgcggggagaggaggccccgcgtgaatggctctgccccatcctgtgggcttttgtctctgtggtcttagagacccgccttctttcctggatgaagaggggagtcctgtccagacagtaggatgaagatgaggggtctttactccccacaagtgggctcaagcccaggaggactgggggcagggtagggcgtgtccgctgcctggaggggctgctgcttgggaaacctaagctgtgagagggaaggcagtatgagggagcagcagtcagggagccgctcatgcctggagccacccgtcacccctggattatccagaagactcttggagggaggaggagcgcggggaaggcagctgtgccctaactgcctcttcggaggactgcggcattcatgctctggcctccagttgaaaatagaaaaagggatttaaacaagcttaggtgaacataatacaatggaaaggattaaaggaggttaaaggatacttttaaaaaaatatcatcatggcagaaagaccaagggaagatggtttagtcaaagtatgttccaggaactgctgcccagaattggtttttgtggatggattattctctgcatcttttgagcaaagacgagagactgggagtggatttggtctcacgtctacagcatggacatcgcttttggctcagatttgcacgagacccttggagaaggggggactgcagccgaggtgtggccgggctcctccagggcctcctcagcccgagttccctttgggtgcagagatccaggtccctgagcctgcaggccctcctgggtgccacggcactctcgtggctctccccttccctggcttcagtgcctttgcccagcatggtgccatggagaccccagcacagaccatgctcagggccccccgagtggaccgagcccgcgtgctccttggctggtagggaggcctgtctgcatcaggtggagtcgggaggtgcgggcagaggccccagagctgtgacactggagacgccgtgtgaccctcatgctccgctggtaggcttgggcgagtcgcaccgcatctctgacctcactttccccactcgtgaaaagggctggttccccctcctcacaacctccttgttccttgtggggattaaaggcaatcacgtttgcaagaagcgctgcctgaattgtcgggcggtgtgctggtgggaatgtcccacggccacccctctccagcgagaggcctggagacctgggggggcgtcacaggacggcacagagacaggagcctgagcttccaggcgcggtcgggagcagggtttgaggccagcgttgggcggtggccaggcgccctcaagtggacgcccacactgacctgtcacctccaccctgcgggctccagatgccctgcgcgtccccacccctgcgccccccacacctgccctgcatgcccccgcccctgccccagatgccctgcgtgtccctgcccctgcctctgcaccccccacctgccctgcatgcccccgcccctgcctcagatgccctgcgtgtccctgcccctgcctccccgcccccacacctgtcccacatgccccgcatgcccctgccgctgtgccccccacgcccgcccctgcccaccccgtgcacaccccctgcccccgtgccccccacacctgcccctgcgcccccactgctcccacgtccccacccccatgcctgcctgtgtgtctcccggcaggttcttcttcagcactgtggcctcggccacagctggcatgctctgcctgatcgccatcctgctgtatgtcctcgtccagtacctcgtgaaccccggggtgctccgcacggaccccaggtatgaaggtacgtggccgccgctctcaaggggcctcatcctcgcctccagccgtctttccgggtggtagtatcgggtctggggtggtcggcccctcttgtcccagggagaggccggggcaggcagccccatgcaggctctgacctggcccgacggcagcagcccagtgttcatacagcccagcagcccccagcgcgcgggaggcaggctcggggagggcgctggccacgctgctctgtagatgctgccaggtcgtgtcaggcgagagacagtggggtccacctctgcccctgccctccgcagtcatccctgtagcacctgtcacaccatcctgtggggccatgtagttgtgggagggtgggggtgcccatcctgcaggagcagcccatggggagggagagtggaggcagcgctgagggtgctgggctgtaggctgcggtgcgctgaggcccttggccaagtgggcccggagcctgggcctcgggaaccgatgctcacactgagccactggagagacgtggcggtgaggactgtgggctccagaggcgagtccacgcctaacccagatcccgtgatgccagcatcctcgggaaatgggcctgtggctgtgacttaatatctgaggtgggagggtcgtgctgggatgtcccagggggcccaaatccagccacgagtgtgcttgtaagagaaaggagagacacagaggggaggtggcctcgtgaggatggaggcaggggtggagtcacacagccacagcccggggtcgccgggagccacaggagctggcaaaattgggaagacctccctggaccctgcggaggcagcgtgcccaactgtcctgcagctggacgtcagagccctgcctgcctcagactgcaagagtctgctggagaagctgcccccacccgccaccatttgatgtatttattgcagcagcgccaggaccctgaccaggaggacctgggccagagaagcccctcggggtgcaggacaagactgccagtctcagccccaggcatggctgcacccgcactgcacacagcccgggtggcgagacagggaggacttgcctgcccttgttccagaacattccggagccaacacggtgtgacatttttttcaaggatgagctttgccagctccacgtggaagtccctaaagctcctccttccacttcgaagcgtgactgatgcctccagggcctcacagccgcttctgaagcacttcctgaaagccagctccaccctggcgaggccctgacctcagcggacccaagcccaggacgatgcctgttgcgttcttctcccccagtagcaagtcaccttccccagcagcctccatgttgtctgggctctccctgtgggggatgccaggggagagtgagagagcagaggtggccaagatggcatgtgctgccttctctcctggaacatgctgcttccacagggcagtgccagtgtctccgtgtgaattcattgattgtggcctgagtgaattcctgggtttgctgttccagatgattctgcagggcttcaaaaccagcaaggccctgagcaaagctgctccttcttctcatgggctgaactcatcgtgatgtcactggctaaggggggcagcatggggtccagcccggcccaggcacatggagctgcggtcctgtcaggctgagtgtggtgtttgccttctaggatggccccgaggccaccagttccagagagggtctgtcacc

SEQ ID NO: 7443 - DNA, 5339 bp, Homo sapiens
  misc_feature (3656)..(3656): n equals a,t,g, or c
ggatcaacaactgcgtgggaagccggaattattggtgaggggcacagaggggatggccggcacgggccaggcttgggggaatttggaagggaggggtctgtgggcaggggtcctcgtgttgaaagggtggagggtcctcttggggccacgtccctgtcctgatgtggtggcgcttggtgcctgcgtgccccggcctcctgtctggctctggggctgtggtgcagccgtccctggacaagctcatccgcatagagtaagtccctggaggccccccgggggcacttgcggggccacgctggctgaggcctcctgaccacgctgtcctgggctgggctgccttctctccacccaggctgaggctcatccagcacaagggtggggccacggaagggcagtgggcacccagcgcagatggacgagaggtgtttcccctgagcatggtggaggctcacagatgagaggtgtttcccctgagcacggtggaggctcatagacgagaggtgtttcccctgagcacggtggagatgcaaggaagagagatgtttccctgagcacggtggaggctcacaggcgagaggtctttcccctgagcatggtggaggctcacaggcgagaggtgtttctcctgagcatggtggaggcacaaggatgagaggtgtttcccctgatcacggtggaggctcacagatgagaggtctttcccctgagcgtggtggaggctcataggcgagaggtgtttcccctgagcacggtggaggctcatagacgagaggtgtttcccctgagcacggtggaggctcatagatgagacgtgtttcccctgagcatggtggaggctcatagacgagagatgtttcccctgagcatggtggaggctcatagatgagaggtgtttcccctgagcacagtggagactcatagatgagacgtgtttcccctgagcacggtggaggctcaagaacgagaggttgtttcccctgagcacggtggaggctcatagatgagaggtgtttcccctgagcacagtggaggatccagggactctcaaggccccgtgtgctgagccccggctgtctgcagcactgtattgtgaagatcaccagggaaaagaaccacgcctgctccccagctactctgtgctgacctgaaagaggccttggtgtgcgtgggagtggggaccaacgttgcctggtgtcacaggacgcaccggggggtccctgccctgcctccctgccatcccgtctggagcacagcatgtgtccagagaggctgagcagcccggcagggacagagaggttgcatgaccgcacagcgagtccagaggctgcgtgagatggtaggggccggggagacccacccgcctcctcccctggagaagagcagctccacgatggccaaggtggggccagctcctctggctcatgctagccccaggtgccacttccttctggactcattctgctctggtgcctcgagctggctcaatctggcgggtcctggtggggaaggtgagggggtgagggcccacaggcaggtggcaaggagagggtctgccttcctcaggaggggtgctggagagggaccacgtgggtgccaagtgtagacaccgcctgtgtgtgggaaaggggcatcaggagagcagggccggggtcatgggcgccctcagctccaggcagcagccaacgccggcatctgtgccaacctcgcttctgtcccttcatccgccagaggcggagagagcaacggcattgagagcaagatgaggaaagttgaggagctgatggcagagcccccgcgagggaggccgagctgatggcggagcccccatggggaggcccagctgatggcagagcccctgtgagggaggctgcatacttcgtagtgataagagaggaagggggacggaaagaaggcaggcggcgctggtgtcctgggaagactgcgagcgctggcctcggactctgcaggttaaacacaggcagcaggggcaggaggctgtgctaaccaagaggagaatgtccctgggtggctgcggggagaggaggccccgcgtgaatgggtctgccccatcctgtgggctttggtctctgtggtctctggtctctgtggtcttagagacccgccttctttcctggatgaagaggggagtcctctccagacagtaggatgaggatgaggggtctttactccccacaagtgggctcgagcccaggaggactgggggcagggtagggcgtgtccactgcctggaggggctgctgcttgggaaacctaagctgtgagagggaaggcagtatgagggagcagcagtcagggagccgctcacgcccggagccacccctcacccctggattatccagaagactcttggagggaggaggagcgcggggaaggcagctgtgccctaactgcgtcttcggacgactgcggcattcatgctctggcctccagttgaaaatagaaaaagggatttaaacaagcttaggtgaacataatacaatggaaaggattaaaggaggttaaaggatactttaaaaaaaatatcatcatggcagaaagaccaagggaagatggtttagtcaaagtgtgttccaggaactgctgcccagaattggtttttctggatggattattctctgcatcttttgagcaaagacgagagactgggagtggatttggtctcaggtctacagcatggacatcgcttttggctcagatttgcacaagacccttggagaaggggggactgcagccgaggtgtggccgggctcctccagggcctcctcagcctgagttccctttgggtgcagagatccaggtccctgagcctgcaggccctcctgggtgccacggcactctcatggctctccccttccctggcttcagtgcctttgcccagcatggtgccatggagaccccagcacagaccatgctcagggccccctgaggggacccagcctgcgtgctccttggctggtagggaggcctgtctgcatcaggtggagtcgggaggtgcgggcagaggccccagagctgtgacactggagacgccgtgtgaccctcatgctccgctggtaggcttgggcgagtcgcaccgcatctctgacctcactttccccactcgtgaaaagggctggttccccctcctcacaacctcattgttccttgtggggattaaaggcaatcacgtttgcaagaagcactgcctgaattgtcaggcggtgtgctggtgggaatgtcccacggccacccctctccagcgagaggcctggagacctgggggggcgtcacaggatggcacagagacaggagcctgagcttccaggcatggtcgggagcagggtttgaggccagcatcgggcagtggccaggagccctctctcaagtggacgcccacgctgacctgtcacctccaccctgcgggctccagatgccctgcgcgtccccatccctgcctctgcaccccccaccctgccctgcatgcccccacccctgccccagatgccctgcgtgtccctgcccctgcctctgcaccccccacctgccctgatgcccccgccctgcctcagatgccctgcgtgtccctgcccctgcctccccgcccccacacctgtcccacacctgcccttgcgtgccccctgccgctgtgcccccancgcccgcccctgcccaccctgtgcacaccccctgcccccgtgccccccacacctgcccctgcgcccccactgctcccacgtcccacccccatgcctgcctgtgtgtctcccggcaggttcttcttcagcactgtggcctcggccacagctggcatgctctgcctgatcgccatcctgctgtatgtcctcgtccagtacctcgtgaaccccagggtgctccgcacggaccccaggtatgaaggtacgtggccgccgctctcaaggggcctcatcctcgcctccagccgtctttccgggcggtagtatcgggtctggggtggtcggcccctcttgtcccagggagaggccggggcaggcagccccatgcaggctctgacctggcccgacggcagcagcccagtgttcatacagcccagcagcccccagcgcgcgggaggcaggctcggggagggcgctggccacgctgctctgtagatgctgccaggtcgtgtcaggcgagagacagtggggtccacctctgcccctgccctccgcagtcagccctgtagcacctgtcacaccatcctgtggggccatgtagctgtgggagggtgggggtgcccatcctgcaggagcagcccatggggagggagagtggaggcagcgctgagggtgctgggctgtaggctgcggtgtgctgaggcccttggccaagtgggcccggagcctgggcctcgggaaccaatgctcacactgagccactggagagacgtggcggtgaggactgtgggctccagaggcgagtccacgcctaacccagatcccgtgatgccagcatcctcgggaaatgggcctgcggctgtgacttaatatctgaggtgggagggtcatgctgggatgtcccagggagcccaaatctagccacgagtgtgcttgtaagagaaaggagagacgcagaggggagggggcctcgtgaggatggaggcaggggtggagtcacacagccacagcccggggtcgcccggagccacaggagctcgcagaggtgggaggacctccctggaccctgcggaggcagcgcgctcaactgtcctgcagctggacgtcagagccctgcctgcctcagactgcaagagtctgctggagaagctgcccccacccgccaccatttgatgtatttattgcagcagcgccaggaccctgaccaggaggacctgggccagagaagcccctcggggtgcaggacaagactgccagtctcagctccaggcatggctgcacccgcactgcacacagcccgggtggtgagacagggaggacttgcctgcccttgttccagaacattccggagccaacacggtgtgacatttttttcaaggatgagctttgccagctccacgtggaagtccctaaagctcctccttccacttcgaagcgtgactgatgcctccagggcctcacagccgcttctgaagcacttcctgaaagccagctccaccctggcgaggccctgacctcagcggacccaagcccaggacgatgcctgttgcgttcttctccccctgtagcaagtcaccttccccagcagcctccatgttgtctgggctctccctgtgggggatgccaggggagagtgagagagcagaggtggccaagatggcatgtgctgccttctctcctggaacatgctgcttccacacggca

SEQ ID NO: 7444 - DNA, 451 bp, Homo sapiens
agtaaggaaggggtgggcactgtgaccctggcacttagtaaggaaggggtgggtgctggggccctggcacttaggaaaggatgggtgctggggcccggcagagccggcaggcactgtgaccccagcacttaggaaggggtgggtgctgtgaccccggcacttaggaaggggtgggcactgtgaccctggcactaaataaggaagggatgggtgctgtgaccctggcacttagtgaggaaggggtgggcactgtgaccccggcacttagtgaggaaggggtgggcactgtgaccccggcacttagtgaggaaggggggtgggcgctgtgaccccggcacttaggaaggggtgggcgctgtgaccctggctcttagtgagcaaggggtgggcgctgtgaccccagcacttaggaaggggtgggcactgtgaccccggcacttagtgacaatgt

SEQ ID NO: 7445 - DNA, 1186 bp, Homo sapiens
tgccattctgccttgcctggccctctgccattctgcattacgcctgatttttggaagtgttgtggttttgagtgttggcagcccagtgtcacagaggaccatatcttagaaatgaccccaggtgagagctgtggctttcctgttctatttgaaggcggctgttttagggtgcagagggtccagggacacagcgtgggccatgaggaagggatggatgctgggactcggcagagccagcaggcgctgtgaccctggtacttagtgaggaaggggtgggtgctgtgacctcggtacttaatgaggaaggggtgggcactgtgaccctggcacttagtgaggaaggggtgggcactgtgaccccagcacttagtgaggaaggggtgggtgctgtgaccccagcacttaggaaggggtaggcactgtgaccccggcacttagtgaggaaggggtgggcgctgtgaccccagcacttaggaaggggtgggcactgtgaccccggcacttagtgaggaagaggtgggccctgtgaccccagaacttaggaaggggtggatgctggagccctggcacttagtgaccctgttggagcgtcacctcccagatccataaagcagggatcatgaaaaccaacctcagtcagcagggcccatggggcactcaggtaaggaaggtgtccaccagggcagggaggcatccctcgtgctggctgtctccacgccgccccatccccagcaagctctggtctgtgacatccacctgatgtggcacccgtcagcaggtgctggacacagtgtctctcccttgtctccccagatgtcaagaatatgaacacgtggctgctgttcctccccctgttcccggtgcaggtgcagactctgatagtcgtgatcatcaggatgctcgtgctcctgctggaccttcttggcttggtgcagctgggccagctgctcatcttccacatctacctgagtatgtcccccaccctaagcccccgatccccccaagcctggttggtcagagctgctcatcgttacacctctacttgagtatgtccctaaccctgagccccccacacctggggccagagtctttgtcccccgtgtgcgcatgtgttcagggtcagcctctcccagaagtgagatcatggacaaaaagggcaaatcacaggaagaaattaaatccatga

SEQ ID NO: 7446 - DNA, 3350 bp, Homo sapiens
tattaatatgacatttgtcattgtcactgatttttttaaaaaagcaatgcacatgttggttgtggctgttttccgcatgctatcttcatatctaaatgcttcattaattatccgagcctccggagaattaactctattacgtttgtatagtaagtttgtaaactgcttggcaaactgattaagaaataatttgcaataccgtgctactaaagtggcaggtttctggtagaaattgtgcgagtccaatttggagttttaagttccttgattgatgaaactaaaaaggcaattttggaaaaagagagggggaaaagtagatcacttatcttagcaaacggttgaaaatatgtctgtcctctgtggccccaaatccagtgaaagaaattctcccagtaaaagttgcttcctaactctgtttttctcagaatacctcttacctttctcaaagaaagcttcaaccaccatcatcagaaagaaggtggcctaaaaactgacacatggccagtgcccggaggggtctggaggcataagtctagatgcccagagagcatccaggcactgaactgctcagagcttgagatgaaatgacatacaagcttcagggtaaaactgtctactagcaagattacctccctcaattctaccattgcagatttcttctgaccccaaatgcaaccttacagagaatgctgaatgaggaaggccaattccttacaatgatggcagaacccccaagcgaatgccctattgaggagaaggacatcactgtatttggaattctgcctgctagtgatagctcacacatcacatcccagaatcccactcccaatgcattatttcctgaggcaagaacttaaggtcctcacctaattcctccatcacaaccattaactcttattggacaagctcctcctgtgagtagggcctgtactcacttcctcttagatcataattccatcttcaagagactgatttccagaatagtaatctttttccagcgttctctcttctccaatgccctggttgttatttttcccacctctcctaatattgatcttcttgtcttttggttagaactgcaacttcggagttgagttcatttcctattgctgctcaattcagtagcaacatagctggcttgttcccagacccaggaagtataagtcattgacagtttcctgagtggctctgccaatccataccacccttggtactgtgaaaaggcttcttggcagccaggtggcattgaggatggtattcagggcgctttccttctgtcatatagttgtgggatctctaccaagtgtgaaggtgaatgaggtaagggagatcagaaccatgcttcctggtttttcatacatccaaggaagaagtcctggtgtgggttgtttgacaccttctttccactttcaccttttattttttattccttcctttctacccccaaccagtcgagcaaatgagcaattttgtgtttctaatacaggatctggaagtagtgctttctaatcctcatttcctgtaggatgttcctgcactataacaagattatgttttcttccttctgcagcagctttctgcttcttgggtactactagctattgttcaattcaggtgaggcctgtgatgacatatatgtagcatgtgctctgcgctccctgcaagctgagcagatacaaccaatgcatcactgtatactcttgctgagaatgtggatgcagcctcacagatctttgcaacactccaaccagccaggaccagttgatcagaactgatcttattggtctgataaccaatcttatttgtgaactgattcatatctgtctttccactcttggttctcttgccgtagaacaaaaacagtttaggaagcataattacgaacatttaggaaccaatatgtataagtaattcggagactccaattcacctgcccctcccccatcccaggttgtggaggctcgaggaagctgacttcttaggctaaaggacaaaaaaatctctttacctccttggccattttcatgttctctgccaattactataggcagtcttcattttgcagaggtgaggtaagacttcatcttattcttcatgtaatcccaccttctaacaaaaaataaataaatatttaaattccaaggagaagtgttctttgtgtatttctagcagaaaacagatgcttaagcctaagaaggaagatccgtccatgacaaaggaaagtggaaaactgaaccagttatctgaatacttcatgccaggacagttgctattagcaactgttttgcaccttcagggctttaaaatgggctctgcagacagcatttgcatatgcaagactcagtagccaagcctccactgccaattgttgaaggcagtttcagatcgccaccttttgaggtacatttctttaagcacaagagaagtagaaatggcctttgccttgtctccagtggtttgtccctctggtgcctcagcagataccagagcttattcttatgaccatttggaagtagtcctcaaagtaaagatcaagaaaaaattggattctttttccattttctcataatagtagcctagtcaacacaagactcccataaaatatgactcactattgggagccatactattttataagcttacttcctgctgacaaaactagctttcctcaaggaaatataaaggaggggaaagtcacatagtgttaggaaaacattcctgtgttttgaatacgatgaatccataggatagagaaaaatctgcttgttctattctgagagttctctgagatatcccttcactctgcttggcatttggccattgatattcaacaggtcactgaccaagcttttctaaatttttcagagagagttacttaccagtaaggtctgttcttaaacctacctagttgattttcatatctttccataaagtgtcatgattctgtcatagaccctgacttaacattgtaaggactatgagtcctccattttttaattaatttttttttagcaaattaggacttcggcaggttttcctctcctaaactcattctttcctccacaggattgctttgtccatctcctgctttcatttcaagtgcataaacaaaacctcaaagggcctgggaaggtgaggcaggccagagtctgtgttctgtgttgagtgtcaagctatttgttaagaaggtctgcaacaggcctttggtgtgggctctgccagagactgttctgaacactttgcttgagatccgtgccctgtaaaatggatatgatgttttactgatgtctgtaatacatttgtaaacttccaataaaatttgaataaaagaaatgttgccattcttctca

SEQ ID NO: 7447 - DNA, 3349 bp, Homo sapiens
tattaatatgacatttgtcattgtcactgatttttttaaaaaagcaatgcacatgttggttgtggctgttttccgcatgctatcttcatatctaaatgcttcattaattatccgagcctccggagaattaactctattacgtttgtatagtaagtttgtaaactgcttggcaaactgattaagaaataatttgcaataccgtgctactaaagtggcaggtttctggtagaaattgtgcgagtccaatttggagttttaagttccttgattgatgaaactaaaaaggcaattttggaaaaagagagggggaaaagtagatcacttatcttagcaaacggttgaaaatatgtctgtcctctgtggccccaaatccagtgaaagaaattctcccagtaaaagttgcttcctaactctgtttttctcagaatacctcttacctttctcaaagaaagcttcaaccaccatcatcagaaagaaggtggcctaaaaactgacacatggccagtgcccggaggggtctggaggcataagtctagatgcccagagagcatccaggcactgaactgctcagagcttgagatgaaatgacatacaagcttcagggtaaaactgtctactagcaagattacctccctcaattctaccattgcagatttcttctgaccccaaatgcaaccttacagagaatgctgaatgaggaaggccaattccttacaatgatggcagaacccccaagcgaatgccctattgaggagaaggacatcactgtatttggaattctgcctgctagtgatagctcacacatcacatcccagaatcccactcccaatgcattatttcctgaggcaagaacttaaggtcctcacctaattcctccatcacaaccattaactcttattggacaagctcctcctgtgagtggggcctgtactcacttcctcttagatcataattccatcttcaagagactgatttccagaatagtaatctttttccagcgttctctcttctccaatgccctggttgttatttttcccacctctcctaatattgatcttcttgtcttttggttagaactgcaacttcggagttgagttcatttcctattgctgctcaattcagtagcaacatagctggcttgttcccagacccaggaagtataagtcattgacagtttcctgagtggctctgccaatccataccacccttggtactgtgaaaaggcttcttggcagccaggtggcattgaggatggtattcagggcgctttccttctgtcatatagttgtgggatctctaccaagtgtgaaggtgaatgaggtaagggagatcagaaccatgcttcctggtttttcatacatccaaggaagaagtcctggtgtgggttgtttgacaccttctttccactttcaccttttattttttattccttcctttctacccccaaccagtcgagcaaatgagcaattttgtgtttctaatacaggatctggaagtagtgctttctaatcctcatttcctgtaggatgttcctgcactataacaagattatgttttcttccttctgcagcagctttctgcttcttgggtactactagctattgttcaattcaggtgaggcctgtgatgacatatatgtggcatgtgctctgcgctccctgcaagctgagcagatacaaccaatgcatcactgtatactcttgctgagaatgtggatgcagcctcacagatctttgcaacactccaaccagccaggaccagttgatcagaactgatcttattggtctgataaccaatcttatttgtgaactgattcatatctgtctttccactcttggttctcttgccgtagaacaaaaacagtttaggaagcataattacgaacatttaggaaccaatatgtataagtaattcggagactccaattcacctgcccctcccccatcccaggttgtggaggctcgaggaagctgacttcttaggctaaaggacaaaaaaatatctttacctccttggccattttcatgttctctgccaattactataggcagtcttcattttgcagaggtgaggtaagacttcatcttattcttcatgtaatcccaccttctaacaaaaaataaataaatatttaaattccaaggagaagtgttctttgtgtatttctagcagaaaacagatgcttaagcctaagaaggaagatccgtccatgacaaaggaaagtggaaaactgaaccagttatctgaatacttcatgccaggacagttgctattagcaactgttttgcaccttcagggctttaaaatgggctctgcagacagcattagcatatgcaagactcagtagccaagcctccactgccaattgttgaaggcagtttcagatcgccacctttgaggtacatttctttaagcacaagagaagtagaaatggcctttgccttgtctccagtggtttgtccctctggtgcctcagcagataccagagcttattcttatgaccatttggaagtagtcctcaaagtaaagatcaagaaaaaattggattctttttccattttctcataatagtagcctagtcaacacaagactcccataaaatatgactcactattgggagccatactattttataagcttacttcctgctgacaaaactagctttcctcaaggaaatataaaggaggggaaagtcacatagtgttaggaaaacattcctgtgttttgaatacgatgaatccataggatagagaaaaatctgcttgttctattctgagagttctctgagatatcccttcactctgcttggcatttggccattgatattcaacaggtcactgaccaagcttttctaaatttttcagagagagttacttaccaataaggtctgttcttaaacctacctagttgattttcatatctttccataaagtgtcatgattctatcatagaccctgacttaacattgtaaggactatgagtcctccattttttaattaatttttttttagcaaattaggacttcggcaggttttcctctcctaaactcattctttcctccacaggattgctttgtccatctcctgctttcatttcaagtgcataaacaaaacctcaaagggcctgggaaggtgaggcaggccagagtctgtgttctgtgttgagtgtcaagctatttgttaagaaggtctgcaacaggcctttggtgtgggctctgccagagactgttctgaacactttgcttgagatccgtgccctgtaaaatggatatgatgttttactgatgtctgtaatacatttgtaaacttccaataaaatttgaataaaagaaatgttgccattcttctca

SEQ ID NO: 7448 - DNA, 6438 bp, Homo sapiens
tattaatatgacatttgtcattgtcactgatttttttaaaaaagcaatgcacatgttggttgtggctgttttccgcatgctatcttcatatctaaatgcttcattaattatccgagcctccggagaattaactctattacgtttgtatagtaagtttgtaaactgcttggcaaactgattaagaaataatttgcaataccgtgctactaaagtggcaggtttctggtagaaattgtgcgagtccaatttggagttttaagttccttgattgatgaaactaaaaaggcaattttggaaaaagagagggggaaaagtagatcacttatcttagcaaacggttgaaaatatgtctgtcctctgtggccccaaatccagtgaaagaaattctcccagtaaaagttgcttcctaactctgtttttctcagaatacctcttacctttctcaaagaaagcttcaaccaccatcatcagaaagaaggtggcctaaaactgacacatggccagtgcccggaggggtctggaggcataagtctagatgcccagagagcatccaggcactgaactgctcagagcttgagatgaaatgacatacaagcttcagggtaaaactgtctactagcaagattacctccctcaattctaccattgcagatttcttctgaccccaaatgcaaccttacagagaatgctgaatgaggaaggccaattccttacaatgatggcagaacccccaagcgaatgccctattgaggagaaggacatcactgtatttggaattctgcctgctagtgatagctcacacatcacatcccagaatcccactcccaatgcattatttcctgaggcaagaacttaaggtcctcacctaattcctccatcacaaccattaactcttattggacaagctcctcctgtgagtagggcctgtactcacttcctcttagatcataattccatcttcaagagactgatttccagaatagtaatctttttccagcgttctctcttctccaatgccctggttgttatttttcccacctctcctaatattgatcttcttgtcttttggttagaactgcaacttcggagttgagttcatttcctattgctgctcaattcagtagcaacatagctggcttgttcccagacccaggaagtataagtcattgacagtttcctgagtggctctgccaatccataccacccttggtactgtgaaaaggcttcttggcagccaggtggcattgaggatggtattcagggcgctttccttctgtcatatagttgtgggatctctaccaagtgtgaaggtgaatgaggtaagggagatcagaaccatgcttcctggtttttcatacatccaaggaagaagtcctggtgtgggttgtttgacaccttcttttcccactttcaccttttattttttattccttcctttctacccccaaccagtcgagcaaatgagcaattttgtgtttctaatacaggatctggaagtagtgctttctaatcctcatttcctgtaggatgttcctgcactataacaagattatgttttcttccttctgcagcagctttctgcttcttgggtactactagctattgttcaattcaggtgaggcctgtgatgacatatatgtagcatgtgctctgcgctccctgcaagctgagcagatacattcaatgcatcactgtatactcttgctgagaatgtggatgcagcctcacagatctttgcaacactccaaccagccaggaccagttgatcagaactgatcttattggtctgataaccaatcttatttgtgaactgattcatatctgtctttccactcttggttctcttgccgtagaacaaaaacagtttaggaagcataattacgaacatttaggaaccaatatgtataagtaattcggagactccaattcacctgcccctcccccatcccaggttgtggaggctcgaggaagctgacttcttaggctaaaggacaaaaaaatctctttacctccttggccattttcatgttctctgccaattactataggcagtcttcattttgcagaggtgaggtaagacttcatcttattcttcatgtaatcccaccttctaacaaaaaataaataaatatttaaattccaaggagaagtgttctttgtgtatttctagcagaaaacagatgcttaagcctaagaaggaagatccgtccatgacaaaggaaagtggaaaactgaaccagttatctgaatacttcatgccaggacagttgctattagcaactgttttgcaccttcagggctttaaaatgggctctgcagacagcatttgcatatgcaagactcagtagccaagcctccactgccaattgttgaaggcagtttcagatcgccaccttttgaggtacatttctttaagcacaagagaagtagaaatggcctttgccttgtctccagtggtttgtccctctggtgcctcagcagataccagagcttattcttatgaccatttggaagtagtcctcaaagtaaagatcaagaaaaaattggattctttttccattttctcataatagtagcctagtcaacacaagactcccataaaatatgactcactattgggagccatactattttataagcttacttcctgctgacaaaactagctttcctcaaggaaatataaaggaggggaaagtcacatagtgttaggaaaacattcctgtgttttgaatacgatgaatccataggatagagaaaaatctgcttgttctattctgagagttctctgagatatcccttcactctgcttggcatttggccattgatattcaacaggtcactgaccaagcttttctaaatttttcagagagagttacttaccagtaaggtctgttcttaaacctacctagttgattttcatatctttccataaagtgtcatgattctgtcatagaccctgacttaacattgtaaggactatgagtcctccattttttaattaatttttttttagcaaattaggacttcggcaggttttcctctcctaaactcattctttcctccacaggattgctttgtccatctcctgctttcatttcaagtgcataaacaaaacctcaaagggcctgggaaggtgaggcaggccagagtctgtgttctgtgttgagtgtcaagctatttgttaagaaggtctgcaacaggcctttggtgtgggctctgccagagactgttctgaacactttgcttgagatccgtgccctgtaaaatggatatgatgttttactgatgtctgtaatacatttgtaaacttccaataaaatttgaataaaagaaatgttgccattcttctcagccctccctcactttccagattttaggggtggtctctgcctttgagcatttcaacaaagaaaagaaaggacacaggtatggagggatgagttttactatgaaatattaacctgattgtttaaatcagggtttctaagcctcagcaatattgacgtcttgtgctagttaattctcggttgcagagggctgtcctgtgcattgtaggatgtttagcaacatcgctgacttctactcactagatgccagtagcagcccccagaaactgtgacaactaaaaatgtctcccatcacaaccattaggatggcagttattaaaaataacaacaaatgtgggtgaggatgtggagcaattggaacacttgtacactgttggtgggaatgtaaaatgatgtagtgctgtggaaaacagtatggcagttcctcaaaaaaaattaaaaatagaattactaccatatgctacttctgggctatacccaaaagaattgacagcagggtctccaaagagatacttgtacacccatattcataaaagcagcattcacaatatccaaaaagtgggagcaacccaaatgtccactgatggatgaatgtgtaaacaaggtgtggtgtatacatacaatggaatattattcagccttaaaacggaaggaaattctgacacatgctacaacatggatgaaccttgaggacattttgctaagtgagataagccagtcacaaaaagacaagtgtatgattccatttatctgaggcacctagagtcaaattcatagagacagaatgtagaagagtggttggttgtcagggactgaagggaggagggaatggggagttactatttaatgggtatagagtttcattatggcaagatgaaaagagttctggagacgggttgcagaacaatgcagatgaacttaatactactgaactgtacacttaaaagtggttaagatggtaaattttatattatgtttatttaaccacaattaaaaatgtctccacacattgtcaatgtctccctgttgagaaccactggtttcaatgcattgccttcttagtgtctttgttccttgagaattcttgaaactgattcctacccaggccacacagttaattttcagttattagcaagaattgaaagcagcagatgacccaaaaatatttgtgtttgcttttaagcaaataataagtggtctgtctggagaattacatccatgtctgtgttctggttagggcagcattaacactgactgggagccaggaccaaggcagcatgtaaattcaatttccccgtgtctgatccacaacattagggacttgctggatgctataatatcatctattcattcattcaacaaatatttatcaaaaggctttctctagccaggaaccgttctaggtgcttggaatacaataatgtgcaaaacaaacaaaaatccctaccttaaaggagtttacaaactttactttcaactaggcaagacattcggaatagtaagtagtcttacccaccctagctaatcacaaggacttgggagtggcagacaacaagagttgtttcattgtaagacattctaagagcttttgaataaaaacttgaactggaaatggcaattgtgcctgttctgcttacagacatgccatagagcatggcctgcaggcaaccatggtttttaatatacagcctccctgtttcccctcttcagccaaaatgattgtagtcaggtatagcaccctaccagcaatcttataagcatgataagctggacttatcagattcgctctctcaagaatacaggctgggcacagtggttcatgtctataatcccagcactttgggaggctgaggtgggaggatcacttgaggccaggagttcaagaccagcctgagcaacatagcaagacccgcccccgcccccatcgcctccgtctctatggaaaaagaacaaaaacaaaaaccagtagctggcataatggtgcaaacctgtagtcccaggtactgaggaggctgaagcaggaagataacttgaggccgcaatgacttatgactgtgccactgcactccagtttgggtgacacagtaagagactttgtctctaataagattaaataagattataaaccaagaaattctgagagaatgaggcagctggcagtgggagtggaagctaagagaatgtatggggaggaaccaggaggtggagtccagcacaggagcaacaaggtaagaggaaggatgaggaagcagatgcaacaaataagcaaaagtctaggctgagagcagatctaagagcaaagacaagagatcagaatggacccagaggagctggtcctcaggacttcctcacctccaaacagatcctagttcctgccctggaggtacccctctagggttaccatttgattttggtccttcacatacccctccccactgtgcctatgtattgtgacaatacatacctatgtaacctctttgggctcaagagttccttgcaatcccaattaaaacatatgaaggatcccatatgcactaaatgccagttgtgcaccttttattttggccccatgttcctttaacattttaaatgtcatctcagccacttgctacttgttgatcttgggaaatgtccatatcctctttgagcctcagttcttaatctattaaatgagataataacagaagagtcattattgggttattgtgtggatgtactggaataatacgtgtaaagctcttagtgctacctgtcattataaaagctcaggccgggcgcggtggctcacgcctgtaatcccagcactttgggaggccgaggcgggcggatcacgaggtcaggagatcgagaccatcctggctaacacggtgaaaccccgtctctaataaaaatacaaaaaattagccgggcgtggtggcgggcgcctgtagtcccagctactcgggaggctgaggcaggagaatggcgtgaacccgggaggcggagcttgcagtgagccgagatggtgccactgcactccagcctgggcagcagaacgagactccgtctcaagaagaaaaaaaaaaaaaaaaaaaaaaaaaaaaaaaaaaag

SEQ ID NO: 7449 - DNA, 941 bp, Homo sapiens
ttttttctatacaaatttgttacatgtcagtgagacctttttcaaaggaacatattcaatttggctttttgtggctgaaaaaacataactgttagacccaaagcattttatgctccgttccatcttaaggagccatccttaagtctgctcccaccctcagtagaatttattttctacaaagtggtagtaatttttttttaaattgcaaatgtaatttttgccaattagagaaaccaaccggtgtcagtaaaattctgtgagaaatgccatccctgctgggaatgttgaagttacttaatgttgatctatcccttggggaaagtaaaagtgactgtgagtggtgccattgtgtgatgtcagcatgacgttgttttgaatgtggcattatgttctggtgctcatgtttcctggattgtattatctgctttcctttaccaaggcagacagaactgctgccttagcctgacaaccggttgtcctcaaagcaaatgaacttaagcatttgggattgagggacagaaggattctgagggggctctgcgagggacggtgtgtgacatgtcatgcctggagaaggaacaaggctatttgaaaacagaaggcaggtcaagggtagaagttaaaggagaatctgaaggcaggtcagggaaaagaagaactggaaatgaaacagaggacaggtgacaaccacctcgaagagctcccagagattgtagaaagagtccagtgtaaccagcttagtaaccagagtatctggattacccaggaaggttgagctgctgagatttcagtggtgcaatgtctttaaaaaaacaggctttgttgggagggtatttccattttgaactttgaggactgttggtcagaaaatgggctcaaaagtgagtttgcttaatgaagacatttaacggttgtgctgtttatagtaaaataaaactccc

SEQ ID NO: 7450 - DNA, 432 bp, Homo sapiens
agcaaataataagtggtctgtctggagaattacatccatgtctgtgttctggttagggcagcattaacactgactgggagccaggaccaaggcagcatgtaaattcaatttccccgtgtctgatccacaacattagggacttgctggatgctataatatcatctattcattcattcaacaaatatttatcaaaagggctttctctagccaggaaccgttctaggtgcttggaatacaataatgtgcaaaacaaacaaaaatccctaccttaaaggagtttacaaactttactttcaactaggcaagacattcggaatagtaagtagtcttacccaccctaactaatcacaaggacttgggagtggcagacaacaagagttgtttcattgtaagacattctaagagcttttgaataaaaacttgaactggaaa

SEQ ID NO: 7451 - DNA, 941 bp, Homo sapiens
ttttttctatacaaatttgttacatgtcagtgagacctttttcaaaggaacatattcaatttggctttttgtggctgaaaaaacataactgttagacccaaagcattttatgctccgttccctcttaaggagccatccttaagtctgctcccaccctcagtagaatttattttctacaaagtggtagtaatttttttttaaattgcaaatgtaatttttgccaattagagaaaccaaccggtgtcagtaaaattctgtgagaaatgccatccctgctgggaatgttgaagttacttaatgttgatctatcccttggggaaagtaaaagtgactgtgagtggtgccattgtgtgatgtcagcatgacgttgttttgaatgtggcattatgttctggtgctcatgtttcctggattgtattatctgctttcctttaccaaggcagacagaactgctgccttagcctgacaaccggttgtcctcaaagcaaatgaacttaagcatttgggattgagggacagaaggattctgagggggctctgcgagggacggtgtgtgacatgtcatgcctggagaaggaacaaggctatttgaaaacagaaggcaggtcaagggtagaagttaaaggagaatctgaaggcaggtcagggaaaagaagaactggaaatgaaacagaggacaggtgacaaccacctcgaagagctcccagagattgtagaaagagtccagtgtaaccagcttagtaaccagagtatctggattacccaggaaggttgagctgctgagatttcagtggtgcaatgtctttaaaaaaacaggctttgttgggagggtatttccattttgaactttgaggactgttggtcagaaaatgggctcaaaagtgagtttgcttaatgaagacatttaacggttgtgctgtttatagtaaaataaaactccc

SEQ ID NO: 7452 - DNA, 2856 bp, Homo sapiens
caggggccttgggcaaagcacccagtaaagtgactgatgcccttccagagccagaacctccaggagcgatggctgcctcagaggatgaggaggaggaggaagaggctctggaggccatgcagtccccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcatatggtttgtctcgtttgactgtcaaagtgtaccgtttgcattcccaccagcaattaatgagttcctgttgctccacaccctcaccagcatttggtggtgtaagcgttctgggttttggctatgctaatggttatgtggtggtacctgattgattgacatttgcagtcccctcatgacatatgttgaacatcttttcatatgcttgcttcttggtaagttgtcttttcaggtcttttgcctgttgtttaattgggtatttctgattattgaattttaagtgttgtctattttggctaacagtcctttatcagatgtgccttttgcaaatatttt

SEQ ID NO: 7453 - DNA, 2680 bp, Homo sapiens
caggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcatatggtttgtctcgtttgactgtcaaagtgtaccgtttgcattcccaccagcaattaatgagttcctgttgctccacaccctcaccagcatttggtggtgtaagcgttctgggttttggctatgctaatggttatgtggtggtacctgattgattgaca

SEQ ID NO: 7454 - DNA, 2925 bp, Homo sapiens
ttgcttccttgtcaaagatcagttgactatatttgtgtggggctatttctgggctccctatttgtttccagtgattatgtctattttttcaccattaccaccctatcttaattactgtagctttatagtgagtcttaaagttgggtaatatcagtcttctgacctttttctctttcaatattgtgccagctattctgggtcttttgcctttccatgtaaactttagaaccagtttgtcaggatccacaaaatactttgctgggttttgattgggattgcattgaatccacaggtcaagttggcaaaaactgacatacagcaatgccagtttattgttttgtgatagccttaatccagctagtttcttcacaggatgatgttgaaaatatgggatgctcataatccctgaatattttttatgtggataattaaacttgttctgggtggatggttggatagccagaatagtaataacctctcttccagccactcaaagaaaatgatataaacgtagggttggtttaattgttgagaggtcacgttttttccattcttgcttgctctcaggtaaggaaagagcactgttggttcacgcattcctttttccctcatacactttgttgggcactgatatggtttggctctgtgttcccacccaaatctcatgttgaattgtgatcctgagtgttggaggtggggcctcgcgggagacgactggatcatgggggcggattttccccttgctgttctcatgatagtgagttctcatgagatctggttgtttaaaagtgtatagcacttcctgcttcactctctcccactccaccatgtgaagaaggtgcctttgcccttccgccacgactgtgtttcctgaggcctccccagccatgcctcctgtacagcctgcggaactgtcagttaaacctcttttcttcattaattacccactctcaggtggttttttatggcagtgtgagaacggactaatacagaaaattggtaccagagaagtgggatattgctataaaatacctgaaaatgtggaagtgactttggaactgggtaatgggcagaggttggaacagtttggagggctcagaagaagacaggaagatgagggaaagtttgcagcttcctagagacttgttgaatggttgtgaccaaagtgctgatagtgatatggacagtgaagtccaggctgagttggtctcagatgggagatgagaatcttattccgaactggagtgaaggtcactcttggctgtgctttagcaaagagagtggtggcattgtgcccctgctctagagatctgtgaactctgaactcgagagggtatctggcagaaaaaatttctaagcagcaaagtgttcaagatgtggcctgattgcttctaaaagcctatgctcatttgcatgaacaaagtggaacttatatttaaaacagaagctgagcttttataaaagtttggagaatttgcagcccaaccatgtggtgaaaaagaaaaatccattttctggggaggaattcaaggctgcagaaatttgcataagaagagcctcatgttaacagccaagagagtgaggaaaatgcctctagagcatttcagagaccttcacagcagctcctcccatcacaggcatggaagcccaggaggaagaaatgcttttgtgggccagcccagggccccactgttctgtgcagccttgggacatggtgccctgcatcccagccactccagctccagctgtgactaaaaggggccaaggtacagcttgggctgctgcttcagagggtgcaagccccaagccttggtggcttccatgtggtgttaggcaggtgtgcagaagagttgaggtttaggaacctctacctagatttcagaggatgtatggaaatgcccggatgtccaggcagaagtttgctgcagaggcagagccctcatagataacctctgcgagggcagtgtggaggggaaatgtggggttggagcccacacagagtccccactggggcactgcctagtggagctatgagaagagggccaccatccaccagaccccagaattgtagatccactgacagcttgcactatgcacctgtaaaagttgcaggcagttaatgctagcctgtgaaagcagctgtggggactatatgcagagccacagaggcagagctgcccagagccttgggagcccactccttgtgtcagtgtggcctggatgtgagacgtggagtcaaagatcattttggaggtttgagatttaatgactgccctcctggattttggacttgcatggggcccatagcccctttgttttggctgatttctcctatttggaatgggagcatttacccaatgcctgtatccccattgtatcttggaaataactgacttgtttttgattttacaggctcacaggaggaagggacttggctggtctcagatgagacttgacttggacatttgagttaatgctggaatgagttaagactttagggggctattgggaaggcatgattgtgttttgaaatgtgaggacatgagatttgggaggggccggggtggaatgatatggtttggctgtgtccccccacccaaatctcatgttgaattgtgatcctgagtcttggaggtagagcctggtgggaggtgattggatcatgggggcagatttcccccttgctgttctcatgacagtgagttctcatgagatctggttaagtgtgtagcacttccccctttgcttgctctctccctctgccatgtgaagaaggtgcttgctttcccttcgcccttctgccatgactgtaagtttcttgaggcctcgcagccatgcttcctgtacagcctgcagaactgtgagttaattaaacctcttttcttcataaattatccagtctcaggtagttctttatagcagcgt

SEQ ID NO: 7455 - DNA, 400 bp, Homo sapiens
gctgcggttggccatgatcgcactactgcagtccagcctgtctcaaaaaaaaaaaaaaaaaaaggttcgaaacaaactaaatgcctaataaaatcatttgtgttatatttattttaatggaatactatatattgtgatagatggtatagaaatatactcgttaacatggaatgatgtttacaacatgtgaataaagcctttttactgaaatacatacttttgtgtaaaaacatgtctatagaagtctggaagggagatgataaaaatagtaatctccaagtgatggttaatgagtttttaaactttatttttacttctagattttctgagttttatgtttaattaaaaaaatggtggggtttaatttttattagttcatttgttgggtttaagttgttgg

SEQ ID NO: 7456 - DNA, 2758 bp, Homo sapiens
acatggatagatctcttagtggtctttccaaaagtacatgtacttgaaatattttcattatcatactattctttgaaaaaaaagatgcttactgtatacttgttttcaagcatcctctaaaatcaaaggttttgatcacaatatgcagatttctcttgatagatacttaaataggctatttctctcctcttcttgggcaatgccttgttttctcctctgaatatttgcatttgaaaggattgcttcctgttctgctcattgatcaaaggtagggccaattaaggattctaaccctaacccagcaccacaaagcccccctggagcatcttcccggctggcaggaccatgccatctctgtggagaaggtgctggggagggaagtccttccagtgccacatggagtgaggccctgcccatgctggggactttggggaggaatttggtattctggtggccttgctcagctctcattgagatcttttcctatcagaatgttagtgaatatacttcgcagctctttgttcagcaataaggaatattctttcaattcctgctcttcaagccaatttactacacccagttgtctttccagaagttcatcccagcggtaatatgttggtgtttgttcttctttggatttcacatctgttttctggtagaagtgagcactgttcacttgtgcagtcgtcttattttccttcttcctagatgactcagctctttgtaaatgttgtgctcaacttctaggggccagttctagactttggagatgcagtgtctcccaggtgtgcacggacacctggtccgtggaaacaggtgtgatgggcacaggctgctgcccttctgtctggtcgggggattcctcttcttcaagctgctcagctaacccagaagaggggagagagtactccggtggttcccagagcccctcccgttgtgccgcttcgacctgacacctgctcgatgctgacttaggcttcctgccaccaagcaggaaactagaaagagaacatttcagtgtaaggtctgttcccgacagcatggattagcttccgtgttctgaagttgttcttttcatggtgtctgacaccgagggcgttgttcgtccatcaggcgggattggatggagtcttggtgttttgccttctcagggaccaaaaatgtatcattgactccttaacagtgaccttcctcccaaggacatatccgtgttcatttttcataggttttactcatattcataggtagattctgttaatgtgagttggaaagaaaagaccaatttgtacaccagtcacaccacaagacagtttatcatataaaatacctcaattttttgtattcctcatttccacctcacaattgtactggtgatgaattttaagggtctgtcctttagcttataggtgatgtttcacatctggccagattcttatacctccattgtatacttgaaaaggttcagaattacaggaacagcagtgagaatttggcccactaccacgactcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcctcagtttttctacctctaaaggggtgggatggttcttcaaattgtttctaaaacaccggcactttcagcagtgttctggtggcctgagatgagagcaccgtgttcagaagtgcctgggagtggcacagtggaaactccgcttgcacggaccatggagtctgctcaggaccatgctgtaggacacacagcctcatgcgctgagaaagcaaaggaagtgctgggtgtaaagtttgcatgattccatgaagctttagttttcctttttttgttttaaaagaaagggttttatatgttctattgtaaaatatggaaattaaacagggacttcagaaagccgcacagaaagatcaccttccgatggtgtgatgtgctcctgacattcggccgaggtctgtattctgaaaaagatttaatggcctgtgaaacacgtggattctgttgcactggatttgtaataaatgacgctgaacttcctgcttccaagcagctcaaccctgatgctgaactgacaccaggcgaatgtcagggctcccaaaccactagtgccaaagggtcatgttgaaaagttcagaatatttatttgtcagaatataataattgccccccaccttagtatttttgcactttacagaaatttagatactgtttttcagtggcttgagcgttttgccttttcaaaggataactattattttcttgaaaatggaatataatcatgagaggaagaagatgtaaaaaatgtcaaatgttgattggttgtgtaaaagttttgtcatagacatgtattggggagcttccaattagcatacatagacacatgtgtcagtggccaagacctgcttatattttgctttatagatgtagtcatagcatgttgttattgcctcatgtaaataaaaaggctattaagttttccagtaatatttattaatctgtatgtgttttaaaataaaataacttatttctagctgaaca

SEQ ID NO: 7457 - DNA, 476 bp, Homo sapiens
agtgtaatgagaaagttcatgtgtcacatgaaaatgatcatgtttgtgttgctacagcttttgtgggaaatttagtttaaaggcagctcttggtgtaccttagtatattttaatccacaattataccattgatactgagaggtgatacccgatgatcttctctataatattcttagagtaaaacaaaatctcaaaagtattaatagctcttctacccttgaaggtgactggtcctgggacagttagaatctttcaggtttacctctgttcagcagatacttcagtaggatacatagcttttcttccagtgaaacaaagttcatatcatccattgtttttcaagcacgtgacaccagcctcaaagtaaatgacatgaccagtggttgaacagtctaattttcaaatttaatatagagcatataacttctgatttgatagtatttattttaaaaaattatgttttcatcattcatttg

SEQ ID NO: 7458 - DNA, 1820 bp, Homo sapiens
tgggcagtgaaatctagctagatgaccataatatgtctgcttttcttgactttattattattactttttaagggcattgttcaatcctcgattttgtatctatggcagcaggtgaaggtctctagatgagcgttcacatacacgatgacaaatggttaaggaattttgaggctaaaatctttactgcttagatgtcatgtactttataggcatagcatttctagatttaataggaaggatctctgctctgtatgtgcttttatgtgacttgcaaaggaactattccatttaaatagatttcaattaggataatgggtttgagacatttcacaatggtatattttctagactcttaagatagaattgtcaaattatagcaaatagagttagaaattattttgcaattttctcagcagattgtaatttctcctgccatacatgtagtcattgtaaaaataatagtgtaagggtaccttttataaaactgattattttccaaatagactggtaccttttggtttagaaaaaaaatgatggaagaagattgtagttcaggagagcaagcagaaagcagtcatttttcagcctttcattttattgtacctttggtcacatttttgaagaaaggcccaaaattgccatatgtatgaaagaatattggtaatggggtagagttggaatgaaagtgagattttcagagtaacaaggtcactttcttctgtggcttgtagaaacagatatgtgatcacaacaggtccagcagccagggttggggggagtagagagttcatgtaatttgtatcatgcttaaatttccatatttgaaaaagcaactagagaacaggattttgtcaaaacaaagagaaaaaaataatttttttaaacaggagggggaaatgtacgtgttattcttacaggatgttgaaaaatgtttaaatagctgcgatacagtttgttgagggggcaggggacagtgggaacagtgactaaagggttacattttgatgtagaaatgcctagttgaagaaaaaagcttgcctgggaggaaagtttctgtggagatgtaccctgcatttggagtgatgtactgaagcatcaaagactcagcattaattttgatctttcttgggaagctggagaaaataatgcatttctgagaaaaaatagtaacttatgaaatgtcaaagcctgctctggacaatgtcaacatccatgagtgcgaggcaaattcaagaatccaaaccctaagtgaagaccttcctgacctgctgtctagacgtcaggggctgtttgagcggtgaggtccagcgggttaggcattccaaagatacgagaggcccacacccacatcaggattgtgtgttagttctcaggcttcctaggatttttcttgggaaaaggtttttgaccccaagtggctcccagcttgacagaaatctttagaggcagctcagaaaaactttggtttcccaaaataatccaaaggctaaagttctgccaccctttaaaagagtagtgttttggctgggcgcggtggttcacacttgtaatcccagcactttgggaaaccgaggcgggcggatcacgaggtcaggagttcgagaccaacctggccaacatagtgaaaccccgtctctactgaaaatacaaaagttagctgagcatggtggtgcatgcctgtagtcccagctacttgggaggctgaggcaggagaatcgcttgaacccgggaggtggaggttgtagtgagccgagatcccaccactgcactccaacctgggcagcagagtgagactccatctcaaaaaaaaaaaaaaaaaa

SEQ ID NO: 7459 - DNA, 311 bp, Homo sapiens
tctgcctttggccatttaagcttcttcctttctgaatttcagcctctagtgctcaggaggaggtcagggatctggctcttaaagggtgttggagaaaggtctcctttccatattgcttctgaggacttcttagaccattggcagcacacgtcctcacatgaaggtgggcgtatgatctgggagactctgcttaagaaaccggatctctttattgatagagccatctcatgagcaagtaatgcaagctgttggtaattacagaaaacctactgtggaatttcatctaaaattaatgaagagtcagcactgtg

SEQ ID NO: 7460 - DNA, 1957 bp, Homo sapiens
aaaagattcatttattgatttgtgcttcaggtttaatttgaaaacaaaaacaataggagaattggaggaaaggaatgggaggacagagtacatgtgttggcatacctttgcttagctctagaggataatgatgcagatttagatcaattatgtagctgtgctgaaatttccctcatttgagcacctttaatgtgaattattatgtgttcttgctggacttacactgttacatcattgtcaacttgcttagtgtgctcagaaataaaattttcatagctttcctctggaccttgttttaaagggtaatatattgatccacttggagacaagaggctggtaatagaaatttggtacttggtaacaaaattgctgaatgtgtgaaataagctttgaaaaatatatgttatggttaaaatgttggaagggcctcagaattttcacagcagttatttgtgtattttctttctaggtgcatgctattatgatgctaatcagtctatgtatgtgtttggaggctgtacccagagcagctgcaatgctgctttcaatgacctctggagacttgacctaaacagcaaagagtggatccgacctttggcttcaggtaagagatgaaatgctgatctttgcctccttaccaggtgactcccttggcatggaaactctacctgatcatttttggtgttggtctcaaggatgggttactgggactcaggtccttaagtttaatgtgccatgtaaatgataatagtaatatgcttgtgtaagtctttgttttttgttaaattatactttatcattagtaatggtgccctgccaaaattgctgtactgctgtgtgaattcatttgcatggttttctcaagtatactcatacaggtgtgatacatcatttggtaggaggttgaagtaagaacagaaacacagagtcgtgagaactgtagttgactgacagaagctattgtcctagggctaaggtctctgaatatctgttgttgttgccagctcagatatttggggagtgtatgggacgtgcctctgctagttactcttaacaacccaggggtgtgggaagattctacagtaggtacattcctacccagtcccactatgccagaaatctggcagaaagaaactagattattttcttatttttgacctaacctctcctgggggaaaaaataaaaacaatggtttttgcactcatgaggcagggcaatttgaggaggcatagattggaggggttggtgtgatggagaaatagtgtccactgagtataaagtattctgctagattttttggcaagcttttcccaaaacattcatttggctttttagtattaggactcagtcttaggactaaggacatttgggtttccattgggcaagttccttatttatttaggccttgccttactactttgattaccagataggaggcatcattgtatattagaaagggcactggactaagagtgaggggacatgagtttcatttcctggcatagtcaccaattctccatgtaactataaataagttattgcacttctctgggagaaatgtggagtagtactaaatgactatttttaaatgggctaaaaaggctagtttatgtttccctttctataaccgctactgtgaatgtctaggccagggacttaaacctgtttatgagaagaagctgcattttgcttccctaaaacttaagttcctgttctttccacctacattaggcaaatataggaggagcctactgagtggataccatgggtggagctgggctttgtgtagatgaagttctttattaaaattattggcatttggagggtaggagggtggtggtccagtctgcagatggccacaccaggaggaggagctattatatccccttctcttccacttcctgtcacaaccaataaaggccgtttgtgccattcataaaaaacaaaaacaaaaac

SEQ ID NO: 7461 - DNA, 1957 bp, Homo sapiens; identical to SEQ ID NO: 7460

SEQ ID NO: 7462 - DNA, 424 bp, Homo sapiens
attgagaagtcttttttgtttacttaattttattttattttatttttacctcctgcgtgcatgaaatggatggcaaggaaagctttgcttgggcctcttcctgaaatccaagatggcaaatgcaagactgtaaggaatgtgatcgtcatttccaaaggatagagaccgcaaggggcagaacttagcactcatgcatcttttctagactctggctttggtctttgtagtttttgggtaacagcccttctgatagtcattgcctctttttcttaggaatgcctggtgatgtgtatacaatcatctaatcaaagaaggctttttttagagatcctggtgttttttaaatgttaccgttctgttttctagtcggctccaaccagcatgccttggtagctcttggatacatattgggacttaatgattt

SEQ ID NO: 7463 - DNA, 364 bp, Homo sapiens
aaccatcaagtttaaagactgctttgtggctaggcgaagtggctcacgcctataaccccagcactttaggaggccaaggcagaaggatcccttgaggccaggagtttgagactcacctgggcaacatggtgagacccccatctctacaaaaaataaaaacaaaaaattagccaggcatggtggcatgcctccatagtcccagatacttgggagggtgagacaggaggattgcttgagcccacagatataagcccagacgcctaggcgagagtgagactgtgtctcaaaaaaagaaacaaagaaagagaaagagaggaagggaagaaaagaggaaggcaggaagggagggagggaagccaaagaa

SEQ ID NO: 7464 - DNA, 364 bp, Homo sapiens; identical to SEQ ID NO: 7463

SEQ ID NO: 7465 - DNA, 3422 bp, Homo sapiens
gccgctggctctcagaagtagcacgtgggcaggagtctctcctctgatccaggagcattggcaggtttgtgttgggactgctggttaagttggagctgtgtaactacttagtttttggtagccaatcagaacgcagtgccccacatattccagctcggtacatgttgataaacagactcatccaaactttcaaaatggattcgtactaaacatgctcaggttttaaattttggtttgcttttgagcttttcctctttatgtggctcttaataataagtagttagaatgaaccaagccatcccagttattccaagcaggctctcaaatgacctttgagcacccttcacctggctggtccccaggccaggggtccacagccctgctcccttctcagcaaggagggtggcctgtctgacagtgcagttgaacctttgctccctactctgcaacttttgaagacttcaggctaatcaaaattacttataattagaatcaagtgcctttattcttgttttttatttttattttatttatttatttttttagatggagttttgcccttgttgcccaggctggagtgcaatggcatgatctcagctcactgcaacctctgcctcccgggttcaagcgattctcctgcctcagcctgctgggtagctgggattacaggcatctgccaccacgcccggctaattttgtgtgtgtgtatatgtctatgtgtgtgtgtgtatgtatatatctttttttttttttttagtagagatggtgtttcaccatattggccaggctggtctcaaactcctgaactcatgtgatccgcctgccttggcccctcaaagtgctgggattacaggcatgagccaccacacccggcctattcttggtattctttattcttggttttctagcctttagaaaaaaaaaatctagtcttggtaaagaaaatgttcattttaatcaagctccagtacagcttgtgtcaagacctagtaagaccacctttaatgtgttcctggatatgacattaaaaactaacttgaaaattgttaggatatttccttgttccctacttttattgtaaaatctactacattcttaagaattaaaaaatgccatttcagaagagatgatagttttatcttgccaaggaattatcttcttagtagcctatattggcttattccaaaaaaggcgttaacctccatcaaaacatcttctgcgcctctctctcagcatatgctttgatatttgaagtgtgtaatagattggagctatcagtcacttatttctaaaaaatgtattcttttttcttcatagctgtgaagagggataccaaggaaagttctttctgctgtctttctctttggtaatgcttatcttatgaacactcaactgaaaaaacactccacctaaaagcaggaaagatggcaattctaaatagcagctattatccccgggtataaactatttttgttgttggcttggggctttgctgcaggtattaatagtttaaaaagaaaaaaaaaaaaaaaaccctaagcaaatctgccacctctgggaagtgccttttaaaatgcaaatagaaagtgaactctcccctgatgcctggatctgcccccttcctttcccttgctaagcctctgtttgcaggagctactcctgaggtatggaaatggtctttgcaactgaaggacttttccaactgaagcaacagttgtagctaaagtggccgtgctatagggttgtgcagagctgggctcaggggacaagaaaggagagacttggagccagagagacctgggtcacatcctggcacaggcctgcctttctcagctataagatgaaataagaaaactcctttcattaagggagattttgtaaagtgcctggtgcttagtaagtgctcaagaaatattatatttcagattcattgagttaagtaggtttttgaggtagcatccttttttttttttttttgagatggagtctctagttctgttgcccaggctggagtgcagtggtgtgatactggctcactgcaacctgtctcctgggttcaagctattctcctgcctcagcctcccgtgtaggtgggattacaggtgcataccacgcctggttaatttttgtattttcggtagagacggggttctcaccatgttggccatcctggtcttgaacttctgaccccaaatgatctgcctgccttggcctcccaaagtgttgggattacaggcgtgagccactgcgcccagccttgaggtagcatactttctgaaataaaaaagtagattatgtccgaagcagttgacctaaaaactgccttggactgacatttgttaggtggtctaagatgttctcttcacgctttgcaaaaaaatgagcttttttggagtttaaattaagcatccctctggtgtgtttggttttttagccaccaaaaatttaacaaatttgataacctgtcacgtgtaagttcagaaagcactttggtcttaattggtgacttgggggttatttggtataaatataggttctttttctaaaaattattgccagtatcctccaaataattgccccttcaaatgtttcatctaaaggtgacagcttgtgggcagaaccatgcacaggaagtgcctgccagtgggtgttaggagatgtaggtggagtctgtgatagccaaccaaaagctatccccttctcgcccagaaaagccacgtgctttgctggacgctacttgaaatctgaactctgcacctacatatgtagtaaaattagagacttttgtcactttaatttttagattatctcaagttttcactagatttcaatgtgccacttgtgctatgagtctttaagaagctttaaaaaataaatgcacacctgtagccttttaccattcagacaggtagattatatttacctgtcatgagggaccatgtatggttgacagttgcaggtttgattaaatccactatattgcacaaattttgctggaaataatttcctgccctgccaagagctctatggtagtttgataataaactactaccccagtattcttaggaactgtgttactaagtcttttctgcctgatttgtactttatttccatagacccctcagatatgtgaggaatcaagccataaatgtgcatttgctggacattatgtaccatgtcatctctatgactacagatttcaaggataatttttacatctaacaatttcactgtaacagtgaccgataatgtgagaaatgtgctttttacagtgctgctggtgggtagacaagtgcttgctgcagttgtttctgaatctagccagatgctggagtcgtgaagctgtaagctccgcgggagcagggaccatctctctttcttgcactacaggcactcaataaatacttgtggctgtgaactgg

SEQ ID NO: 7466 - DNA, 531 bp, Homo sapiens
ggtttttaaaaaatgataatgcaattcctatttgaaacgtgtcttagagtgaatatcagaatagtaataatggactcttggaaagctttgaaaactacatgaatataactcattttctttaaactttattgtctgtaagagaaaaaagagagattgtaattctctaattttatcttttctaaaaaagttaaacaattggagagccctctctggaggtctctcagagtagctctctgcccattgttctgaattaacttgtgtcccaccctggacaataaatggacagataaaccctttgaaatacaagccaccaccccgtgagggattaagagggcagcctggttttcttagtgtgcatagcttcagctgtccgtcatagttgtcatctggatatgttcacccctttccactccttcaccctggccaaaaggaaaatatttccactgtaggtgctgtaagaacactagactttagatcatcacaatctactgtatttgttaatggacagggagtgtgtccggatggagcctg

SEQ ID NO: 7467 - DNA, 1268 bp, Homo sapiens
tctcctgtggaggaatttctccctttggaactaagacctctaagccagtggggcataaaattatgagaacaggaagaataaattttgctagtgggtcaccagggttaataatgcatggtgccacttttgtttctaccccttgattcctggctatggagggaaaaaaagtaccatttattggatgctgattcagagcatatatatagccctctggagaactctgccctccctgcaagttattgccacctagctggtgctataactgaatcttcaaaaggccatcccatcatcctattaggccagcttctttagcatgataaggaacatagaccagtgaattccaggagcaatgactcatactgaaattcttttgctgtgacgtgagttccttgatcagaagcaatgttgtatggaatatgacaatgggtaaagcattccatgagaccatggatgacaattttggcagaattttgtatgaggaaggcaaatctgtatcgagggtctgttctagtaagaacaaaatgctaccccttccatgatggaagtagttcaatgtaatcaactacaaagctgactgagcacccagaggaatagtgccatacttggagtcagtgttgttgtctgctgctgactggttgggccctcagcagtggcatccaggttggccttggatagtggaaatccatattgctgagcctatgtatgacctccattcttgccactgtggccactttgttcatgagccatgaacaaagaggataccagttagcctctttccccagccctgttctgacagaggtggctggaatagagactgactggtttccacagacttgattatcctatattcacttcattattaaaatcctcctctgctaagatcacctttggtgagaattttatggcatacatccttcttttcttttcttcttttcttttttttcccattgagagaggtctgtcctgggtgggtgtgatggctcatgcctgtaatcccaccgctttgggaggttgaggcgagtggatcgcttgagcccaagagtttgagaccagcctgggcaacattgtgaaaccatctcttcaaaaaaatacagaaattagccaggtgtggtggtgcactcctgtagttccagctacttgggaggctgaggtgggaggatcacctgagcccgaggaggtggaagctgcagtaagctgtaatcacgccactgcactgcagcctgagcaatagagtgagatcctgtctcaaaaaaaaaaaaaaaagatct

SEQ ID NO: 7468 - DNA, 280 bp, Homo sapiens
atcccagtacttcgggaggctgaggcgggcggatcatgagatcaggagatcgagaccgtcctggctaacacagtgaaaccccgtctctactaaaaatacaaaaaaattagccgggcatggtggcgggtgcctgtagtcccagctactcaggaggctgaggcaggagaatggcgtgaacccgggaggcggagctttcagtgagccaagatcatgccactgcactccagcctgggtgacaaagcaagactctgtctcaaaaaaaaaaaaaaagaatatagtt

SEQ ID NO: 7469 - DNA, 21292 bp, Homo sapiens
cccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggtacgtagagctgcggtagggggtggctgtgtggtcctagctccttgcatctttttctaggcccgtcggcctcgggccaggaggcaggggcgttttaggctccgaagtctgaagccgggagggcaggcaagggagacagcatttaaccaaaaaaagcctttgtggatagtgccttagtgcctttggtcgtgaaggagggaggcccccggcgggtttatgtggcttctgcccgagacggccgtttttcccgttataagagggggaagatgaaaatggccgctgcgtccccgcggtgttgggggaggggagcgatatcttatttcggcgttgctctcctgcgaaggtccgccgcagccatcttgggctggcgggctgggcgagctgccagaggcacaaaatggcggagaagccgcgcggcaacgcggacccgacccgcagcgggccgcgcttcgtaaggccgcgtggtggggtgcaaggggacagacgacgttcttttgggtctttgggccggtgtttaggttaacgaaggaccgtctttgcctccacggaaaggacggagtctgggatgtctttggggcctcttaagatggaaactaatccaaggccgactaagttctgggcccgttaggtggaggggattgcgtgagggctttgtgtttggcctaaatgaagcgcttttctctgatgccgaaagggcttcccaggcaaaaatctgtatcagtattctattaggacagaccacaaagtcgttaagatgattttgtggacatcgcatttccacgggattgtgaaggagaaattggcgggcaaccatttacggcgccgttatttcctttgttttgaggcgttctaatacttagaaccacagcgtgtgttggctacagttttctttcccttaagtttccacctcttaaaggtgttcagtgagggttgattgaattgcgggaacaagacagttctagggtttaaacagcatacgtagctggtctgtggggctctgggtattggattcggaaagcattgaatgatgcgaacatacgaggcttgctagaattaagaggaatctgttagaagggtgatagaaaagcaccatagaaattgatttttgaggctgtgggaataatttgtgcttttttaaaaaaaaaaaacaatttgttacctaagtttccccttgttggtaaagctaccttaagatctgaatatgatttatcaggtaaataagactattaaatgtcttagcaaacttttgattaagattttatatgattcctcagagtattttaggaagaaattttcagtgatgaagcgtgagtttcctgcgtaattttggagcccaaactgcttaatttggtttgaactaatcaagccttgcgtttacatactcggatgagcatagagtttttagtttttgatgtttttcccgaagccgattgactccaatgtcacgagtgttttagatttttttttaagttcttgctttcttgggtaagaaagttgggattgagctcaaaagttgttaaaaagtcgtgacttctgatcattggcagttgaatctgttataacagtcattggtgtttggactgcaaagtaagcgattttaaagtcttttgttattaaacagaaaaattcaattattgggtacctttctactcttcaaaaatactaaatgactggcttctgactagagctctcgattgaatacacgtgaagaatgcttgagaatggaaaattgcccagagttcattagtatattttacgtgagaagggaaacaattgaaactaggttccagtttgagactcggctcaagagaaatttgaaattttctgatgggttatctttttactagtaaaagtacactgtgtttttcgcaatctttgaattgtagagggaggttaacttaatgtgttaaaaattgagttttttttcttacataagagtcttcgctttctggccgagatctctaaacttttacgttgtgaaatacttccatattgttgtgtttggtgtttgcgtgtttgtgttccaattggaacctttaagggttggaatacacctgaatcaaacacgtgtctaggcttccaaagcaagcttgggaaaaccataaagctcaatggaacagcttgatcttagacatgcctgtggtgtaaatgatgcttctctggagccagaaaaatgagtgttattcaactccaggcttctgaactgggtcttaatgtaaatcactaatctcttcaaatcagtggaattctcccttatttatctgtctctaatccagacaaccccacccctctgtgccccaccttttccagtgactgtaggagtttgttgttgtgtccctcccctttaaggttgggtgtgtgggataaattattctcagtttgatcactcaatagaatacatttgggtgaatataatgacatttaaagaactggtgtgtccctcatccctcgttggtctgtgggatttattttttcccccctctcaaaggtaatagattaacactaaaatctgtctataggggtctaattagcaggcttaacctgatctggccaaaccactttcaaaagtaagatctcgttttcatctccggattcaagactcttcccccaaaattgcttgcattttgtaaaggggttgactagcaccatttctttgtaaaaagaggcactcctggcctttaagtcacaattacaagaagttgaataaaaagttgatgaagtgcagggtaatctttagagcccaataatggtcacagcgtataggttgtgtgagatttgtatgttggtcttgcacgcagtgtaatgttctgagcctctcaatattgtaatgagtttctacgagtgagtctttactaaaggaatccagaaactaaggagacactgatgtatggaccagatgttaaagaaaatgttttgacccagcagatactctgatagaatactggctattatttttgtaaagccgatgtgattgcaacataggcacgtaatctttatcattagagatgaatagcagcatctggacaccaacccatcaaactgcttttcaaattctgcagtttttctcatcttctgctgaatcttgggatgtctttttatattccttggttttagctcctaaactctaaattctaattttcaaaactgaaacatctctgaatctacttctttctaaagaattgcagccatctcaccaaatttcctttaaaaaaggattgaattgtcaaataggaggaaattgttttgtattgtgagtctggttaggtttatcagtctcttgaaacccggttgaaatatttttttcttggttttaaacaagaatgctttaatattgtggatattgtctggaactagaacgtgacattttcaagctgacattacaggtgattttataaggtaagtactactggttttgccaaaaggttgaaaaggaattcaggtggtgggggaagtgttaatgggatttgccttacatagcgttttttcctcctttctctacaataaaatccgaacgtaggtggtaaatattaatgctttcatagctattttgcccaggacaagggcagagctacagctgtgtatatttcttgagccttagcattttatgttgatcagtgtttttacatatgcgactgtttttttaacaaggcatggtgactgatgtttaggaattttaagtgttttgacccaggttagtattgggggtgtgggctatgtagaattagatattgaaatcacttagtcttgtttttaaactgcaaaccaaaagaagttcttcactgtagcaaattacagtcttgaaattcccccaaaatctttgctttgaattgggttttggaggttacattgagattgatgttatcaacatagattgttacctgacagtttggataaggggcccctttttctctaatttttgtggttagaaattaggttaaaaggtagtcttctgaaaagtcaaaagatatttatatttgcttttgttggggagtactgactgttttatgaatgtaaatttaacagtctgtgctatatttacaagagagtttttataagcacaggcctacaactaatttcagatgatgtttttttccagacactattctccagtttttgaggatttacttatccatttactcttctggtagacagtttggctgccagaaaaaaatatagtccttattatattgatatgagcattgacctttccataacaggattaatgaggttttctttgcccctgtccctcccaatttttaaaatattgccttgtcagtcaacttaatgagtttgtgcatgtttaatgttaaatggattctagttgtatcccctagaaacattttaacaaaaattgtgttgataggacaagtttctgtttatttctaactagggtctcttaactaaatgtacataacattagcccaagagttgatcttctggttttataaagtagccacttgaacttagctgagttgaattaaatctaatatttataataatttagtaatggttttgttcttagactataagagaaggaaccaggttaggaaggggtaatgaagtaacagcaggaaggtatccacattgaaaacagttgtgatagctagagctatggcctctattcttgtatcttctgcatctaagtgccctgtctgtatcgaagttttaggaggccctaaggaaacctgcttgggcattctgattccatgattacatttgtgctgccagaaaacatttcccattgcattttagtgatggagatttaaagaaagccaattactgtaactcccttaaataaaaacatatttaaaaattttcggattaaataaacaataattgactctaaaactagactggaaattatccttttgttaggaaagacatcacagcacttgccagattaacgatggttgtctttatgcccagataggtataaagacttgcaatttttttaaacaaagccttacatttttttcaggaggaaaaaccaggagaggaagtaattgacaataaaatgaaagatcatcaaagtgaaatgtaggataacaagaaaaactagcatgttttatgtaggcagtattttattttgtttagtatgttcaacagacatttacagatcaactaaattcaatctttttaattatttgaggaggtgagctgtaatttaaatagtgccaccttttaaagtagtatttctcctttggacatccagaagacttaatattttctaaattgagggggaaaatgtacaacaaaactctttgaaaataccagtgttggattcaagtttgttctgctttccttcatagctactggcatattgtaggtggttgacttgattttgtctttttatgattcatactataaaatctcactagagcagcttttccagggggtgggttacacttaagctccaaattgtcaggttccctgacaccgtctttctgcagagctctttaaatacagtacaaaaatgtgtgacgctaaatacgtttctttatcctatctagacaagtcacaatactgtaaacctcttcaaccctgagcgtttgtcattgtacaaatgaattgtccgtgctttcctttcatgcacttatgtattaatgtgtcactttttgactagaggtgtgcttttgacacttaacctattttctattgaatataataagaagtgtgaaatgtaactaatagttcttaaaatgttaaatgaacagtaaatgttcagtggcgcacttcacattcaacttaagcatgataagtctatttggagtagagaaatgagattaccatatattctagaaccagcagaaaactatgtagttttcagttttttgagctgcatattctagtttctttttttttttttttaatccaaatcaacaaagggattttttttttctagtttcagttttggcactggattttatcctggagttttaaaatattcttcatcctgttctttttctattaaggttaatgttgaagaaggaaaatgcggaagtcgtcatttgacaagttttataaatgagtatttgaagctcaggaataagtgaagctgaaatttgaaaaaataaaagaaagaatgcatgctaattatcagaccagaagtcccacttgtagaatattgagcaatttgtgtgaagtggggaagatgaaagaagtcagaatttgaaacggaagaatgaagaaaagaaataaaaatgaagttaagataagaagtaatctggaatcagaaagcactacgctaagtaattactagtctgtttatgtgtccctgtatattttgctaaacatgcatgcattatttgtttaatagaggaaaatatatacagggtaaagaagtgccttccaggggaaacgtttaaattaggtaattctgattttaactgcttagttaaatgattgaaatgcaatttttaaaaaatatttagtagtcaagcaccaggcagcagtgagctctccagcatgggtaacagtgggcttcatgttgtcctctctagataaactttacctgtctaatgttgctggtcctggggcatgagcgaatacctccagggttggaactggtggtctttgccacctccctggactcttagattgcactgtcccctttccttcagtactgagcaatgtatagtagaatattttctgttaaaccattttcaaaggaatgtcaccaggatggttatggaaccaaacccccaaaatccaaacaaagcattgaacaaaatagttccctttggcattagtgtgttagttttttccatatggcactagtggaaatctgtgagcatttgggccctaaatttaagatgcatatttgctaaatacacagggatggtttttcaaattctgtttctgtttaatgcctatttcagctgattgactaggattactgataaaataccgtagcttccccttagaagaggtgggtcacacaagtgaacaggatagctaatacaaattgcagtaatggcagatgctttcattcctatttctccttttttgctatcaacatttagctattgtaatgttagaggtaacggttacaaagtagctttattctggttacctggtatcccttgcacttattgagaaattcaacccaaaagctgtcccttcttttctgtgtgttttgttttagctgagtagaagggtcaagtgattggtgtaatgttactttcagttgaatgagacaagtacacatatcaaaaataatacccagtagtagtcagccagcggttttctacccagttgagaatgccaagggtatcatgtcacacatgtcttcctgaaataaactttctctgagagttgtcaggtcttcatgctcttggagaaagtgacttaaatggcatttcttggagaatccattttctgatgctttcaggcctgtttatttctatatcttgcaagcagaagaaaattttctcttaagaagttttgcattcctttgtcaaatttcttgccatagataaactaatgatgataaatgttattttatgttccaaattactcaaagagcaggcaggaaactgaggtaaatgtgtgaatgaatattacattttaattccaagcccatggattcttttatcaagaaacctgacaggtccttggggtgcaaaagaggaaaagacctcttaacccccagcccactaaaggaaagaaagcaatttggaatctggttatgacccaagctggatagacttaaggtgagaaaacgttgctagtggaccattgtgtccatttgtttttgttttcccccttgaccaaagcatctgtgggtcctaatgtgtctcctcctcgggccatagggaagatgaggaggaggccggcttctgttcctgagaacaggcagtgtgtgaaagactgccttaatcagaggtctgattaatgctaaggggagtcaaaacaaggaaggggatgacagtgtttcaggaagataacctttgccaagggaaaaaaatgagtaggaagcatgtaacttctgaggttgactaagtcaagtaagtcagacttaactagtatgataaacagtgttttaagagatgcagtgtttatgagccactattttaaatctaacaaaccacattcagtttttaaaataatacagggattggatggttagtcctttcaaatatgtttttgtaaggtggttgctgttctcagaatagggagatgtggattattttgttggaaggctaagtgtgttgtatttttacttgatgtattccctttaggttttgtattaggatgtggctgagatccagtctgtgagagcttgattgatttcctgagcattttttcagggaaattttggttttattcatgctaattttagtttcatggtccctttttttgaggcagtggtgtccagttctgtctgttggtgtggttttaatgtgttgaccatgtcagccctgagagtggaatttgaagtatgcttagatttagggacttccccaactggtttttatagctttacctgtctgcattgagatttaaagttaattatgcttttgatttgggtgctaattttaggtcttatttcttgtaggcaagttttattcccttgccatatgtatttcccagccagttaaatggccaaaataacttcagaaagctttaacttctttaagaaaatatccctgataaaggatcgagacgtttaggtgttacccaaacaagtgtcagtatagaaaaggaagcctttgcattctggtatttcccttattcctggcccaagaaatgattgcttacaaaatatatctgcatagtccgttagttttggaggctgagtgaaaactcctgtgatttcagaaatattgtatctgtgatctgctagattttaaggagaaaacttcattaagtcttattttctaggttaggagtactgtctcttccctcagtggacaggctgccgaagcatcttagcttagaataaaggtttttctgttaaagccaggagcttaaagaggatcttgacttgacccattcttcctttatactcagattcctgggctgactgatttctgttaactacagttactttattggtagtcttaactgttactgtgaaacacccatattctgctttcacttctggagaaaattgtttcatttccatagaggtaatctttctagtgttggagtaaacaggcttttagcaacttttgggttccccatttctatattctcacctatgttaatttttgcctgtggtaaaaatagcaaaaactacaccctcatttttgagacttcctcctttgtccatggagagaagggaagtgtccgttcagaatacttgatagggaattccaagggattgttgttaattggaagccccagagcatcactacatcctttaaccatttcttgatgttaaaggcagctgttcatatatttttcttttaatctttttacagtcagtcatggagggaggtagaggggaaaggctgtcacatttcatgtcaccccaccatgttttataatggctttgaagtcatttgaacgtttctagagtcgtctggggcctagagacctgaactcattttactggatgagttagcctttccttctgtgttaaacctcaaaccttaatttgtctattctgtgttacattataaatgttttccctgagcatcaaaggatcatccaaattttctccattatgttgtaaaccacaaaactatcttctaaagtgttttgagctgtaatttagaataatcctctactgtcctttcaagaatgtccagaatactctgaagatgtatcacacaaggaaatctcttgtgattttatctgaaagcttcacctttgattcatgccatatagtgacttactgtaatactgcttccttttgagtcttgccatttctgctctctggagtagaaaggcttaccaggctttactttgtctaagtttgataacctaaaataaaggttgccttgataattttacctagctatcagactgactaggagtaggttctgtcctttcctcatctactgttttggtgccttggcagaacttttccttggtttcattacttagtatacccttttgttgattatgtgtctttagctcgttggtgacctagttatcctggttaccattcctttgctatttttcattacaaatccccccttaacctgccagccaatcccagttttggttgggaaagctatgagtacacaatgtttacctaaactttggcttttgtatgtagtttctgtactcttttgcttcctgggccctaggttaggagctcctgatttagctgcctggttttgatgtgtacttaagtaactaggtaagttaggttaattcctggttttccataagtttgccctggctcatctccatttagctggagaagctgtggaggatctctgacaccctctctactcttatttgtgtgtagttcgctgttctgttgtagctccatctggttgctttcagttttttagggggcctcccaccatggttagatgcaatagggttttacagggtttagtgtccttcaagctagcctttgctttccactaggtttctgcttttctctaggatttgaaactgagatcatcatctttatctcttatcactgaattataagtagtaacttgaaaggtcaaggtctttttaaaaatcaagcatttttttaagtaaattatataaattatataggattttgttttattgattgcaacttgattgaaataggtataaagtataggtgtcatagttaataaggttccgcctcaccctagtctttatggagtaacattctgaaacacagtccttggacagttcccttaactgcttgactttggcacccctttctgaaggaagtggggtcaaataactcttatccctgctccaaaaaggtggaagaaaggacaagttaattgacttatgtcatttggagcaatgaaactattaacaccaggtatattcagttcctgcccttacctatattttcttatcttggaaggggattgctgtccctcaccatttatctcacagcagcttatttgtttttaaagttgcccagaaagtgtgcaaattaaacttttaacatctacgtgtaggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtaagaaagactgtcttgagatttcctcgttactcttagctctgaaattggtgcgtgttttgtaaaccaggaaggtagagagggttagattatttgttggcctattaaatattggtactagaagtgaacttaagttctgggaggcaagactaaaagcggttaagagcctgggcttttggagtcagggttttctatttttgctggtttgggcagattaacctttcagctttagcttctttataaaaggcaaattagtaatacagtaccagttcttcagggttgttgtgaggatttactaaatgtaagtaaactgcttactagtatggcaaatatactgcagaacattggctttcagtaattagaattcttgataaataagtatatatatggtgcgcttttttttttttaatgttggtcaaaagtaggctatatatacatcctggtttgcctggggcgataccatttatgcctgtggtcaggcataattaacagcaccccttttcttaaatgtgtgtcctcgtttcgatgacaatttagagtcactctagttagtcaagagccactcaattttttgtttttttaactgctggggaatactccttgtgattttgttactgtattaaattaatggtgggcataatgggagacagaaaagtagagaatggtcttctgagggggaaagatgggcacaagccaagctagtaaaatgctgcgtgccttgatttgtaaaagataagtaatatgtctttaattggaagaaatactggaggagagcttgtggtttttagaacgcttcctagcaaagttgaaatgactaaataattagagaagaaaagtattgatcctactaaattggtaaccatgttagcatattcctggattgttccctcttttggagtttaactttagaacagagtaataaagaagacaatatttgttttcagtcataaccttaggaggtctttgtcttgcaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggtaagatgaaaaactggttttgaagcagtcaactgcctaaatttactttttcttaaagttagagctgattttgacaatagagctttagcagttggtgcgtgagtgaaatcttcagaggcttttttagtgttttgagagagtcttttaagttaatcttccatgacggggtctgcatttgggctgcctgtcaattaagcataatactgacacaatggtgtaactccttagcccatcaaaaaaaaaaacttccgactgcattactatactgtagtatagtattagtacattagttcaaaatatagttctatgctaacattaactctttccaggctgcataaacctagttagatgctctcctgactttcccatttaatttgaagctaatttcttttgggtgttgttaaggcattttttacatttcatgaaaggcttcaaatgagatgatatttattgtgatttcactgtataatccaagtggtttaggaggagggtgcagggggggacttaatgtttttagagtagagtagaatttttccctagtaaattgttagtttatgaaataaatggaatctttaggtaaattcatcacagcatctggaatgttagcaacatatggctcactctttattctttcctcttgtcatctttttttgagacagggcctcactctgtcgcccagtctggagtgcagtggtgcaatctcagcttactgcagcttctaccttgcaggcttaagcgatccgcccacctcagcctcctgagtagctaggactagaggcatgccaccacacccagtaatttgttatatttttgtagagacatggggtctcactgtgttgcccaggctagtctcaaaactcctgagcttcaagcagtccaccagccttggcctcccagagtgtttggattacaagcatgagccactgcgcctggccaactcttgtttcttacgattgcaagctgtttatgacctgtaaaatggtttggtacgcatcccctcaggcttcgtttatgtacttacttgtgtattgtgtttctgaaaaaatcgaaccatacatgctcatctttttggcaattcagagcattctattgaatggaaggtgtgtcaacattacaattttttctagctgatagacacagtgtggttccagttatccttgtatgtcatgttatgaatatgtgaatttttcttagaataaattcatagaaggaaagatgccaagttgcttttcgccagcacgagtgcttgtttacctacttaattctaaggttgaaattttttcttttgcattctttcctacccattcccaaaaatacttgtagtacttgctgtaattttgtaatttctaagcagtgtttggtctaatcattatgtacttttcttgttagtgacattttggctagtatacagctccctttttaaacaactttgattttatgacaacttttccaaagtttaaaacttttttttttccctaggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagtaagtaaaagcccgttcctttgtaaaccatcagttctattgttaacgccaagttatcagtgaccaattgctaggataaggacaaggacaagtcagtaatacttcgaactttttctccaacctcttgtggagactcaagatacatgcagaataacaaaattttgtataacttggggaagttggtcctaccacctgctttattagttgccacctattggggtcaactataccccaattccgccaggatatgtagtcagtgtttacactgggttcacattctagagtcaaaaataaccaaaagcaaagttatgatgcagaaggaaaacattgttccttttttggctagtgaatgatgtcatatttggattttgatttgttttgaggcagaatatagagtcaagatttgaaatgtggggctagaccccatttaagaaattcagattttaggtacattaaggatggtagctaaagtcatctccaagtatagagaagaggaagaactgagaaacacttaatgacaaacggagtttcactcttcttgcctgggctggagtgcaatggcgcgatctccggctcaccgcaacctccgcctcctgggttcaagcaattctcctgcctcagcctcctgagcaggtgggattacaggctaccacacccagctaattttgtatttttagtagagacggggtttctccatgttgggtcagggtggtctcgaactcccaacctcaggtgatctgcccccctcggcctcccaaagtgctgggggattacaggtgtgagccaccatgcgcggccgcccatttcctaattaaatttttgcagtaggatcatagctctcggaaaatagcataaattttatcttaatctctagtgccagaaactgcctgggcgtaaacactagcttgaacatctgaactagaagatagcatagtattggaattagaaacttaaattctatttaggtgaaaggatgtttcctcaaattatgaacaaactttaatgtgtttgaaacggggtatttttattttttaaatgtatgctgttaatacatactttgggaaaaggaactatatgtacttaaggctgtgcttcagtcttagcttttggcttccagagaagggctaagaaaacttccaagggttaaataatgtgttcaggtttcagtcataggatctcagtcgcaactatttaactctgttgttttaacccaacagcagccagatgaatgagttggggccctattccaataaaagattattttggggcattggaatttggattttgtgtgtttcttcacttgtcatgaaatactgtttttccccctagttatttaaatttttagcttatgggttatacagaaacagccagctggccagatttgacctacaggctatagtttgccaattgtgtgctgctttggagctggaaatactgtcaggatcatagttaggtaaaataattgtttcaagtttttatgagtagcttttacaaatgaacatttagtagagggaacaacacatttgtaagttgtagaccttacgttctggctaacattaagataacttaatgcacctaactgaaatgtccagtgggatcttactcatagccacaggataattagtggctttgttcaggatgtatgtaacaatttatttaccttttgaaggctaaagaacgtgccaatggaatggagcttgatgggcgtaggatcagagttgatttctctataacaaaaagaccacatacgccaacaccaggaatttacatggggagacctacctagtaagtttattttcaaaataaatataattggcagtttttcacttgtcaaagaaacacttgtattagtggaaagtcttcagcacttaggtttgtgccataaacttgactgttgattgattaaatgctcctcattagggcatttttctcatagtagaagttcaaccattacaggtaaaactaaatcttagtcaagtccatttttaaattttttgtttgttgttgtttggttttgtttttgttttgttttgagacggagtcttgctctgtcgcccaggctggagtgcgatggtgcaatctcagttcactgcaaccttcgcctcctgggttcaagcagttctcctgcctcagcctcccgagtagctgggactacaggcgcgtgtcgcaacgtccggctaattttttgcatttttagtagaggcaggttttcaccatgttagccaggatgttctcgatctcctgacctcatgatctgcccgcctcggcctcccaaagagctgggattacaggcgtgagttgctgcacccggcctaaattttcttaaatagagcaaagtgatactatttttgtttcctcttagaaatatgtgggatatgcagattgacctctggcaggatctgtgtgcctccttaaccaaagatttttaaaaataggtttatatatattgaaacaagggaaagggcaatgtttgctcaatataggtgagaattttaacaggaataattttcattttccagttaatgtgtcagaaaaggcctactagtagatataaaaactcatgtccagaaagataagggaggtcacctgaatatttttttcttcatagtggcagctctcgccgtcgggattactatgacagaggatatgatcggggctatgatgatcgggactactatagcagatcatacaggtaagttatgaggtagaaaggtcaacgtctgaatctcagtacagtgtacagagcagcactatgcttaagttttagcctttgttaaaagctttgctttagtacttttactcgagaaatgcagagtagaaagttaaatcagattctaaggttctgtgtcttaatcaatttaatgtgtaactggatttctgttcaaatattctagaatataaatgggatttaaatgataacttggaatattaataataaaatgtgttttatttttaaacattgaatgaggccaggcgcagtagctcacgcctgtaatcccaacacttcaggaggccaaggcaggcagatcacctgagatccagcctggccaacatggtgaaccccgtctctaccagaaataaaaatttagccggttgtggtggtgcacgcctgtagtcccagctactggcaggtgaattgcttgaacccggcaggcagaggttgcagtgaatttagattgcaccactgcactccactgtaggcaacagagcgagagactcaaaaaaaaaaataaataaatgaatacatagtgaaagcaaaattataggctgaggcaggggaattgcttgagcccgggaatttgagaccagcctgagcagcatagggaacctccacaaaaaatgaggcaggaagccggggaggttgaagctgcagtgagccaagtacgctcccacctgagtctcctcccccagagcaagaccccaccttaaaagaaaaaattatagcctctgtcttagccttttaaaagcaaatttataatggcttataaaagcaaatttcataagccattttggaaagccaacacttttcaggcagtttcttgtaatctcttaatgcatgcatcgtacactgagggcaggtaaaatggatgccttgaaagagtccagagaataattttaaagatgttaatttagtatgacaagggtatgtggctttttatttttgccaaaaatttggtatttcggggtttgggtagggaaatgtcaatcatagtttaaaaataaagatatctttgagaatacttccaaagataaaaatgaagtaaaattgtgacattttggtcctcccttgtcaaaatgtgtaatttgacaagtcaaataatgtagttagtaagtattgaccacagttgtcattgataatggtattgaggtatatggatgtctattttgtgcattatttggcaatgtttaagaagttaacagttgtcagtcattgtctgaaagtgagtctgtaagtgtattgttcagcattttatcacccatgaaaaccctttttttatttaaagcatcactctattgaatggtactaaaggtacaaatttgttggggctgagatttttttcttagtttgatttttttttttaagagcatttacttaggaatgttctgtgttctaatactacttatttcagccaccagagagaaccctatgccagtttctaaaaagggtggcaaatcacttgacctgcaagaaacatctcattcatgctctatgaaagtttttattttactaaatgaatgacataattttttaaaacttacaaactgaatgcgtgttgtgttgcctttctgtcttcacagaggaggaggtggaggaggaggaggatggagagctgcccaagacagggatcagatttataggtatgccaggagaggacttagcatctgtacaacagtataaagcttcacataaagatgtttgcctagtaatgttttggtaaattataagtggaatacccaaaatcagactgtttgaagctcatgaaaatattctaacggaaactaaatgtataaagtctttgtatatttataaaaattaattggttttgcaatagattatttagtgataccattttataccgtgatgaggtacagtgatgttagtcactgataactcattttttttgtcattatgttcttgtattacattttccttgctttttaaaagtaagcatctcaaatagcacaagaacattcaagccagcctttttaacacaaagctaaatcctgaagcacttgtgaaattagttttgggtgttcaagagggtgctgttgggattatttaatggtatgggaattttctcatttttatttttaatttttggagacagagtgttgctctgttgcctaggctggagtacagtggagcaatttgagctcactgcagtctctgcatcccgagtagctgggattacaagcatgcaccaccgcacagagctaattttttttttttagtagagacaggttttcaccatgttggtcaggctggtcaaactcctggcctcaagtgatcctcctgccttggcctcccaaagtgctgggattataggcgttgagccaccgcacccagccaggaattttcttttacaaaactctcttaacatagttcacaaaatttaaaaagtaagtagattaaaatatagcaaggattatttgaccttaaagttattaagagtgcttatttgacacttgggcctgataatgtgcttcattctcaagatttaaacagaccttgaaggttcatgcagctttccttttttggggaactgatgaaagggcagtatatatagtcataaatttatatgtttggtctaattgtgatctattgagacttagacaatcttgacatttgtttatagaaggcggtcaccttctccttactatagtcgtggaggatacagatcacgttccagatctcgatcatactcacctcgtaagtttttatcttaatatgattgtttatattgtagtatggcttgctctgatgacagtgtattccctttatcagataatggattggtttcaggtagtttcatacctaatgattctccacacatcctgaacattttttggttcaagaaagtttgtggaaacaacccttagaatcctattattttttaagaaggaaaaattggacagcctcctgagccagagtaggctcggagactcctgttgtttctaactgaaatagtaaataatgtatttccaccatttacccagagtaggctcagagactcctgttgtttctaattgaaacagtaaataatgtatttccaccatttagtagcttttcaagagtccttaaaaatttttggacagcacagaaacatggattacttagccctttagttctcagattgagttatatacttcccagcaatttctgttatttaagattgctatctcatttctggtgtaatacttacatggaagtctttctctatttgggggtggtggggttctggcacataggaatttcttaatggcagaatattctgaaattctcggcattaaagtatacttgataattagttcacttaatattaaagcatgttcattcttttcttcccaggtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaatgttggtgcagctgttcacaaagaa

SEQ ID NO: 7470 - DNA, 627 bp, Homo sapiens
agtaaataactagactgcgggtactttaatacatgttcttattattttgcatttaagtaattttcatgaccaattgtagggatgttgctacaggtgggttattttgttgccttgctaacctttatcgcatctaggtattagtatgtttcaggtactttgggaagaactttacatataatctttagcaatgaaatgatgtagagtaacttaccttagttcaaatagctgtttaagtggcaatgccacgatctgaattgaacctaggtgatcttagtccacagttctcttgatcatgatgtctcaaatctgggtacctgggtgatggaaaataccagtaatggagcataggcagtattggcaggtcttaatttgtaaaacttactgtccagggtgttttcagtgtttgccaacttgtggtaaattaatatgcttagagaactacccttaggtttgtttctgataagcatgtggaaacaacttagtatatgcctgatgggttatttcaaattgttctcaatgagttttgaaacaagaatttgtagtatttatatataaagttgagttttagggtgtggtcccagagggggttgtgttatggatggatacattaaaggctgagaaacctgg

SEQ ID NO: 7471 - DNA, 304 bp, Homo sapiens
cctttttttttttttttttttttttttgagacggaatctcgctctattgcccaggctggagtgcagtggcgcgatctcggctcactgcaagctccgcctcctgggttcacgccattctcctgcctcagcctcccaagtagctgggactacaggcgcccgccaccgcgcctggctaatttttttgtatttttagtagagacggagtttcactgggttagccagaatggtttcgatctcctgacctcgtgatccacccgtctcggcctcccaaagtgctaggattacagcgtgagccagcgcgccc

SEQ ID NO: 7472 - DNA, 1452 bp, Homo sapiens
caaaaaatgatctctgattcatcagcatgaatttccaagtttggggtacagggcaatgcactttcctcagtttatttatattattgtttttaaaaatttgcaatacttaccaaagataaaggatttgttagaaacagcttttggaagaggagcagtgatataggtttattttactaatgataatagtaagtaaattataaagaacctttaatgttttctgagaaagtaaagcctattcttggagtttataatcatttaagtggttctggacaaaacttaccaaattctttactgttattactaaaaagaatgttaacaattttaagaaaacaaaaaaattattttttaagaattttgtttatcggttgatatactcattgccaaaccagattaaagtaatattccaattggattggcttcttctaagctctacttctaaggaaattgtttggattgatttgctgtctgtgctttgagaatgacttttttcccctcctccttttttttaaagcaaactttgcgtaacttattgagcaaggtttccccttccttttctgccgaacttaaacaactaaatcaacagtatgaaaaattatttcataaatggatgctgcaattacagtaagtattatcattacaaacccttgtaaaataaagaataatatttacatgaatctttatgttaaagtaagttaacatttttctttttacagtgagtttcagatatttagtcatatataaaaataaatgtaaaaatagacattatgactcagatatagaaatgtcactttattgtatgactcttcccagaaattctacagtttttaagaaatttgtgtttatcagacttgacagccattgataagataaatagcatttcttagaattatgttattggtttaaaaaacttgaatatttcctttgtcaagattaataaatataacaattagaaaaaaaaattataaagttttccacagcatagttctttaaatgaaaggataatatttactttaatcttatgtatgtgtactacagactttcagaattttatgaacagatttgttctataagcattattttactattttaacattatttcctagaatattttttcactgttattattttcacacacctcagattaaattttaaatttccattaaaacacctagaagaatgattgaaatcaaaacataatactttctttttatgataattacttttatccttgcagttaaaaagacttgaacataaggaagtgcttaaaatgtacactaatgtgaatatacatgcacactcacagttacattgtcactgaggtaaataagaaggtagagccatggaccaggcacttggcctcccataatcccagtgctttgggaggccaaggcaggaggattgcttgagcccaggggtttgagagactctgtcttaaaaaaaaaaaaaaaaaaa

SEQ ID NO: 7473 - DNA, 126 bp, Homo sapiens
gcctgtaatcccagctactcaggaggctgaggcaggagaattgcttgaacccaggaggcagaagttgcagtgagccaagattgcaccactgcactccagcctgggcgacagagtaagtctccatct

SEQ ID NO: 7474 - DNA, 87 bp, Homo sapiens
ctcacacctgtaataccagcactttgggaggccaaggcgggaggatcacgaggtcaggagtttgagagcggcctgcccaacatggtg

SEQ ID NO: 7475 - DNA, 1664 bp, Homo sapiens
cccagccctcatcctgagccctgctgtgtgcactgtgtctgatggagaggcagcctctctggatggcagctctctccatattccaaaggcattcttctcctgttctccttccctctttttaaattaaatgggaatgccactgacgtgatgtcgtttgcactgcaggatgacagaactgttgtgtgaataccattgtatttgccaaatggtccactcgtcatttcagaacaaacaaatggatggtgtctgtaagtcggcaaacactggtgacatttagccttgtttatgttcctttccttttgctgcatatttttggctccaaaagctactggctgaatcaacagggcctctgaatcaggagagaagtctggtagcattaattttagttgctatgtccatattctcttcagactgcatgaatcctactgctcaggaccaagtctaggtgagaggagagggcaatcaacctctttggtttcggatgttgtgtgcaaagcccagggttcaaataagcagtaattatctcctattacttagtgctgatcaacagcacctctacgtctaattgccaacctgccctaatcatgttgactattcttgctttagccagagacagaaggaccaaattttataaataacactttattgtcattattccattaaacgattaggggatgtggccctgcccttgctttcaaatgcctctagccctgatggtttctggattatttaataaatctgcacattttcttgcaggtaagtgacactccctgtcctagtcggtctatctggacttgcccttgtctgttcgtggtcctcggtggttatctgcagcttgttaatcgtgtaaagtcaagagaagaatgtatacacatatgtgtgttgaataattactattggcataggtatgtgtatacacacggtgcaccaatctacagtatatatagcagagaatcagaggctaaaaatattaccccatatgttccagtattagtcatggattgcaaaggcttagtaacttgagcaggagagaaaactccctcaaagtcataaatcctgagtgacaactgctgctggatgacagatcccttcacctgtggacaacctggctgggggtggggggctgttccaccagctcacctgagcatgtagaggtgggtcctgcagtggtctcgtgggtattactgcttgtgtctgattgtcctgtattttgtaacactttagaagaatacagaaaagtgcagtaattctctttctccatagtatttaagcagaaatattgctagtttaatattgtgtcaggtcgtcctattaaccaggagcagatgacagtaaaatttcagtgaatagcaccttgacatctacaacttaaaaatggtgattgaagcaaaatatgtaaacttgtacggggtgatcgtgtgctttggaacagagtattgttgaagtaattagaagatatattaaggtgttcctggtaatgaaggcatgtaagttataataattgtagctttctgaataagtgtcaaactatatctttaagtgtgctgtatgctgagttacaagttaggtcatttatgaatggaatgtaaaataatactaaaaatgcttcaataacttatcttggtattgctaataaaaaaaaaaagctgtgaaacattagtgca

SEQ ID NO: 7476 - DNA, 413 bp, Homo sapiens
gcgatctcggctcacggcaacttccgtctcctgggttcaagcgattctcctgcctgtctcccaagtagctgggattacaggtgcacgccaccacacctggctaattttgtatttttagtagagacagggtttcatcatgttggtcaggctggtcttgaacttctgacctcaggtgatccgcccacctcagcctcccaaagtgctgggattataggcatgagccaccgcgcctggccaatacctacccttttacgagctactcagtctaaagcaacaggcagcaaatattttcttaaagggccagagaataaaagtgttggctcacaggccatggggtgtctgtggcgaccacccaactccgctttggaagtagcaccacagctaccatagacaataggaaaatgatggctgtg

SEQ ID NO: 7477 - DNA, 1184 bp, Homo sapiens
gtggaaactcaacagagatttgtaaagtaccatatgtgttttaccagttgtccagctgattaaatctttgtgggtttcttttgctgttttatgcccgaagttaaatccatgctttctttggttattaatactgatgttatttaagaaatgcaaaaaggccttactttagtttctaagcggtcttggatttacatagcataaaaattagaatggatttaaatgggagttaaacagcaggagctggcaaagtcaggcccatctgacattgttatctaggctgtgttctttgagtatggaagatgacaaggaaacattaacacaatagcttaatagtttacttcctgtctttggtcaaaatgttccaaaaactgaattcttacctcaaagtcactagcctttgggtgatgaattcaattgtaattactttgggtttgctcatgacagtaatgcagtaacttaaagttagaaaataatttcaacccaggagcatcttaaatagaagtcattattgtctctatgtaattcttgttggaatgtttctttgggcaatttaaactgcccacacattagggcaatgactttctgagcattttgtagcaattaagagttgttgtttcttgttcttggcattgtttttgttgccttgtgagagaagatctgtggcaggatgctgctcttaaaaattttcctttaaattgactcaagctgttatttccttctgaatgtctgatcttataagacatagtagatgctattaagaaagatttgttttactgttgtttagcacttaaaacatatattttgtagttatatgtgttagctagggtcaaacataaaaactcaaatgctggctgggcgcggtggctcacgccagtattcccagcactttgggaggctgaggtgggcagatcacttgaggtcaggagttcaagaccagcccggttaatatggtgaaaccccgtctctactacaaatacaaaaaaacaattagccaggagtggtggcaggtacctgtaatcccagctactcgggaggctgaggcaggagaattgcttcaaccgaggaggcggaggttgtagtgagccgagatcgcaccattgcactccagcctggtcaacaagagcaagactctgtctcaaaataaatatattacaataaaaaataaaaactcaagtgataccaga

SEQ ID NO: 7478 - DNA, 1182 bp, Homo sapiens
gtggaaactcaacagagatttgtaaagtactatatgtgttttaccagttgtccagccgattaagtctttgtgggtttcttttgctgttttatgcccgggaagttaaatccatgccttctttggttattaatactgatgttatttaagaaatgcaaaaaggcctctttagtttctaagcggtcttggatttacatagcataaaaattagaatggatttaaatgggagtaaacagcaggagcttgcaaagtcaggcccatctgacattgttatctaggctgtgttctttgagtatggaaaatgacaaggaaacattaacacaatagcttaatagtttacttcctgtctttggtcaaaatgttccaaaaactgaattcttaccttgaagtcactggcctttgggtgatgaattcaattgtaatcactctgggtttgctcatgacagtaatgcagtaacttaaagttagaaaataatttcaacccaggagcatcttaaatagaagtcattattgtctctatgtaattcttgttggaatgtttctttgggcaatttaaactgcccacacattagggcagtgactttctgagcattttgtagcaattagagttgttgtttctcgttcttggcattgtttttgttgccttgtgagagaagatgtgtggcaggatgctgctcttaaaacttttcctttaaattgactcaagctgttacttccttctgaatgtctgatcttataagacatagtagatgctattaagaaagatttgttttactgttgtttagcacttaaaacatatattttgtagttatatgggttagctagggtcaaacatataaaaactcaaatgctggctgggcgcagtggctcacgccggtattcccagcactttgggaggctgaggcgggcagatcacttgaggtcaggagttgaagaccagcccggccaatatggtgaaaccccgtctctactacagatacaaaaaaacaattagccaggagtggtggcaggtacctgtaatcccagctactcgggaggctgaggcaggagaattgcttcaacccgggaggcggaggttgtagcgagccgagatcacaccattgaactccagtctggtcaacaagagcgagactgtctcaaaataaatatattacaataaaaaataaaaactcaaatgataccaga

SEQ ID NO: 7479 - DNA, 451 bp, Homo sapiens
attttctgcaaacatttggcctttcttgtgtgttttcatatggcatacttaccttccttttctttttcacctaaagtaaccatctggttctgcttttccattaatcctccttccttccttccttccttgcttcctttctgtcacttttctaagcgttctttatgccttcttgacatttgactgataatgacaatcaccccaggagcttaaaaaaatgacagtttcctggtcctcatggcatctgagatctgcttgttagacatcccaggcgtcatttggtatgcagccagatatgggagtcactgtcccagaaaacttgcctttctctcctgtgcccagcgcttactttgacattcctaacccatcactgtctggcctcgatgtacatttcctggctcatttttcaccgtattccccaggagggccatgcttccctgcttacgttaccatt

SEQ ID NO: 7480 - DNA, 84 bp, Homo sapiens
ggtttcaccatgttggccaggctggtctcaaactcctgacctcaagtgatccgcctgcctcaacctcccaaagtgctgggatta

SEQ ID NO: 7481 - DNA, 2107 bp, Homo sapiens
attggctgtgcagcacagcaaggacttggtgtgtgggatctgcatggaggtaggcagtctatgagaaagccaaccccagcaagtgccacttcaggatcctctccaacggcaaccacacctactctctcaagtgcatttgcaagtggagaagtgctaagcaatttgagagcaagatcataaagtcctgcccagaatgccatatcacatctaactttgtcattccaagtgagtactgggaggaggagaaagaagagaagcagaaactcattcagaaatacaaggaggcgatgaggaacaaggcgtgcaggtattttgataaagagcatgggagctgcccttttggagggaactgtttttacaagcatgtgtaccctgatggccatagaaaggagccacagagacagaaagtgggaacatcaagccgatactgggcccaacaaaggaaccacttctgggaactcattgaggaaagagagaacagcaacccctctgacaacgatgaagaagaggttgtcacctctgagctgggcaagatgttgcttatgctttgggctgcaggtagggacgatagactgacagactctgaagatgagtgggacttgtttcatgataagctggaagatttttatgacttggatctataacaaccttgcatggcgtgtgaactggtctgctgaccccagacagcagctgtcccctgtggtggtgtggcagtgcctgtgttctctcctaggcaggcctatcaactccaagtgctgcggtaagaatttttacccagggcctgtcttctcaacccctaccctttccgcgaggagtgtgttttccctgttgaaaaaacttacaaaaataaatcttaaagttagttttttgtaacatgaatttaaccgtcagttagtgtaggtgtgttgcgccatctgttttcaaccagattgtgtttatggacttttcacacactcattttgaggaccccaggttcaaaagtaaaagcagtggtcctgctttggggtccaagaataggagtgatgggtgaagggacctaagctggccaatagccttctgctccagacatgggacgtggatccttgaggtttctggtgaaatctgcacatctgtgtttttatatctgttccctatcctgtaatccctaccacgtgcacttgttctgtggtttttggtctcttgtttaattgtacataagtgatactactgggtaaccagaaccaggtgcaaatgtgttgagatttctactgttttgcatgttaggaaaattgagaaagaatacatataaaagatacagaggcataacatcaatgcagagttggaagttgactcccaagggctgacataatgtgtatgagtgtgggtgtgtgaaaagcttctcatccctgcatagatgcagtattcttagccttagcagaaaaaagtggtttagtggtttaagccttgtacagcaggatagatcttaaagggcaaagcactatattggtagttgtcaatatagcagtgctagctctgtctatataaacagagaaatggggttagccatagaggttaaaactacctggttatcccatatgttaacacaaactgggtcttggatacactgtgtatttaatgttttatgatctagcttttccagtacaggcactttctgaaaaacctttgtcttcatttggggcattttgttgtcgagtttttgtgtttttttttgtgggtatttgcctcattccacccctgagttttcacatagacagatgtgatacaaaactctgttctaaggtgtctattgtagtggactaatgggtttgcagtaataagtcatacttttccactgaaggggagggcttgggaatccctaagactagctaaaattaagttatttgaagaattccttgattggaaattttacctttgtgttttgtcgctttgtttcctgaaagtaactcggggatgctcctggtttgtccatttactgctttgattccttggatcccacccattctttcactttatgaaaatacaaataattgttgcagaggtctctgtattttgcagctgtccttttgtaagaagcacttttcccaaataaaacaattcaaataatagt

SEQ ID NO: 7482 - DNA, 34547 bp, Homo sapiens
gagtattctcgcgagaagtccaggggtggccgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcgggtaagaggtcctgccgcccgaggaagacgcgggagggaggcccgcccctcgcgaatcccgcggctcctggagccctgccgcccgccccctgcgaacccaggccccgccgccaatggctcgccctgcctctgcgccgcttggcccgtcccctctcaagcatatctcggataacgccccttccgcacctttcacgggcggtgggagctgaggctcctgtcgttatctctgatccttgcaccctggcaggaagctggtagctcacactttaacgggaggccttcacatattccagaaaagaaaccactttgcagtgccagactggaagaagtaacggtcactctgaaaacagggtgggagagctgcctctctttgaacctctcccaggaccaactctaacccaggtagatttgactgtaaaggccggttaggcttccctgtgctccgtgggtccgcgactgtctgacatgtccaccttctcagtatcctgacagtaccttgggcatccagtctgagatcaggcttagctgaaaaagctgcaggagtatgaagttcggctgtaatttgatcatcatttttgggaataggcattttgaggtttgtcttgagaattcttacttgagcgctttcattatcttatagggaggcaaacttggtcgatgtaagcggtggcttggagacagaatcatctaatggaaaagatacactagtaagtatttttagttgtttgcaagacaaaatagggtttgttttagttatttcttcttcttcttttttttttttttttgttgcgacggagccttgctctgtcgcccaggctggaatgcagtggcgcgatctcggctcactgcaacctcctccccccgggttccagcgattctcctgcctcagcctcccgagtatctgggattacaggcatctgccaacacacctggcttcttttttttgtctttttagtagagacggggtttcaccatgttggccaggctggtctcgaactcctaacctcagttgattctcccgcctcagcctcccagagtgttgggattacaggcgtgagccaccgcgcccggccttgtttttacatttttaagcgaatcaaaaatacattcaggccaggcacggtggctcatgcctgtaatcccagcactttgggaggctgagacctcaggatcacttgagaccagcctgggcaacatagggagacccccgtctcttaaaaaaataaaataaagtaaaatacattcaagtcaactgatttgagtctcgaactgctctgacacaggaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcgtgagtacttttcatagtttttgtgagaattgctcggtaaaataaatctgaacatgctcaacagttactttgtgggcaaaataaatgcaaagtatttcctatgtctcctaacccctattcagcaagtaggatgttgaatcaggagttgttttaattcccttagcatgttatctgcttactgagggcacagctctggtagatacaatggtgggtattgcccctccttttgagttgacaacctggtttggagacaaaaaaaaatgcaattacaaagtgttatataaacaaatttagaacaatataaaccttgtgttggtgttttggatttttcagaaaggatatatgtggataaagcctgttgtccaaaatttgagatgacccatgctctttatgcctgaaccatcctttttttcctttctcattgctgctgactcactcctttaggtatattgtctactctcctcagcaaacctatttccaatcatgtacctcttctagtgaattaaaatcatattgtgattgagaatgaaagacttttttccttatactgactgtctgttggaataattgtactgctcgctctctgtaatgttctttatggtttgtattatgctaatacatttataaaagactatctaaacataaggctgcattatcgtgaaattaatccaccttgggtgagattgtgaagaaatacatatatgtgtgtgtgtgtgtgtgtgtgtgtgtgtgtgtgtatatgtatatatatatacatatatatatgttctcttgtttttttcttgcgactgggtctcgctctgctgcccaggctggagtgcaatggcaggatcacagctttctgcagcctcgaacttctgagctcaagggatcctcctgcctcacccttccaaagtgttgggattactggcatgagccaccacacccagctttcctttataatctgttgtatactttctagttaaaaggttaaagtgggttttagaaatgctgatgtcttaattaacatgtgacttgtgatttaggaaagagtgtttttaaaaagaaagaaaaatactgaaggatcaggaagaaataattgatcttggtagcaacatctgctgggaaaacacactagctaagcaagcctggtctcttagagaggcctaagatagggccacttttgccagaaaaatttgtttggatagacagtttaggaaaggaagtttactagagagataactgggaggaattcaaggaagaatcaaatcacagttcaaagttttggtagctttggagacaacagtttgtaactgaatttcaaaagttatatctaaagtccagttagatcctatcagtggtatcaagttaaaaaaaaaaaaaggtggggggccaggcgcagtgactcacgcctgtaatcccagcactttgggaggccaaggcaggctgatcacgaggtcaggagttcaaaaccagcctgaccaacatggtgaaaccccgtcaccagaaaaaaaaatacaaaaattagttgggcacagtggtgcgtgcctgtagtcccagctactcgggaggcaggaaaatcacttgaacccgggaagcagaggttgcaccccagcctgggcgacagtgagactccgtctcaaaaaaaaaggccaggcatggtggctcacacctgtaatcccagcactttaggaggccgagacaggagaatgacgtgagcccaggacttcgagactagcctaggcaacatagtgagaccctgtctctacgagaaatagaaaaaaattagctgggcgtggtggttcacatctgtagtaccagctactcaggagctttaggtgggaggattgcttaagccctgcaggttgaggctgcagtgagccatgattgctactgcactccagcctgggtaacagagtgataccctgtctcaaaaaagaaaagaaaaataaagcccagttaggtgggatggattatcttttacaactgagatagagaatgtgagctagcagggtataaaaaaggctgctttttacacctgtttgtatttaaattaaaataactatttacctacctatctttagtatgaggttttgtctttgtaaataagcttatcacaatagtctgttaaacagaagaggttctacagagaagtgaaggtaaggaaactcagctgtaacatttgtaagaatgtttcgtaattccatgagggtagcaatagttggtaaatgcagtcttctctgaggatatcctaagctagtttcagagtccaagataaacctttgttctgatttcttctcttctagcttaagccatttatactaaaggtcttctgtccttctgttactttgccctttgcaagactaaactcctgtgcttttcctgtcatcttgtgcaatcactaccatgtttctcttctcaaatgcgttggttcctctgttgcatccgtctctgccatattgtctttcccctcctggcctcttcctctcttgccttcaaataggcaagtcttctcttgatgtcaggtgatccatgcgccttggcctctcaaagttctggaattagaggtctgagccactgtgcctggcctagttatttacatttttaattcattttttcttacattctgcctgccctttccaaccacattattgacaccatagagatacaccttagactactttgtcctcttctacagctagcctggcatattctttttaggtactcaaaaaataaacttaacgagataccagtgagaaccttctagatgctgaattgtccagtataacggataaggtcttattaactttcgtgacagaaaaatccaggtatttataaaaatatgagccctgttttggttttgacaacctttttacattttaagactatgttaacatattaacattttaatttacctgtcactgaggggaatggattcatgttaacttctcataaagaggcgtacagcctgtgcagcatggcgaaaccctgactccataaaaaaatacgaaaattagctgggcatggtggctaatgcctatagtcccagctacttggggggctgaagtgggagaatcaacctgagccagggaacgtcaagtctgcagtgagctatgattgcaccactgcactccagcctgagtggtagagtgagagcctgtctttaaaaaaagaaaaagaagtgtgtgtgttcacaagttcactaattcgtataatttggctcttcggcagatcctgtctacctttcatgaccaactacagttttcattgcaacgtctgccatcacagtgggaatacctatttcctccggaagcaagcaagtaagaacaaactctggagtatttgaagatgattatccactggaaaagaaaagggatctgggcgtagcagaatcaggagacctttgcctagtagctggtataaattcagttggggtttagctctgaataattgcaattgcccatttcaggtcacatgatgactccattttgctgctataattgttattttctggaccacttatcgagtattcccttggtagtagagatgtagtactacagataactgtttcttcctttttgtttttgatagacttgaaggaaatgtgccttagtgctttggccaacctgacatggcagtcccgaacacaggatgaacatccgaagacaatgttctccaaagataaggtagaggtggaactaatgtgattgcagttatattgaagagttaggtggaacttctaaatatactccctaacaagtactttcttcccagtttttattgaatatatgacagtggattcagtgattaccttgttctctttttttttcaagatggaatgcagtgatgcgatctcagctcagtgcaccctctgcctcctgggtcccagagattctcctgcctccgcttcccgagtagctgggattacaggcatgcgccaccacgcccagctaattttttgtatttttagtagagacaggatttcaccgtgttggccaggctcatctccaactgacctcatgatccactggcttcggcctcccaaagtgctgggattacaggcgtgagccaccgcacctggactgttgtgttttttttgagagagggtctctgtcacccaggctggagtgcagtggtgtgatcatggctcactgcagccttgacctcctgggctaaagcaatttgccttcctcggcctctcaaagtgctgggattacaggtgtgagccactgcacgtggcctctttttagtttattttttccaaaattattttgaaaagtttcaaggtggaatgtagtgacaccatcacggctcaccgaagacttgacctcctgggctcaggtgatcctcccacctcagcctctcaagtagctgggactacaggtgcacaccaccacacccagctagtttttatggtttttttagagacagggtttcgccacgttgcccaggcaggtagaactcccgtactcaagtgatccgtccgcctcagcctcccaaggtgttgggattacaggtgtgagccactgcacccggcccatttcttcttagatttaacagttaacattttgctacatttgttttatgtccccatatatctgtttttcccttaagctatatgaggctacattgtgggtacactttacccaatattctgttatacaaccacagtgccataatcataataaaaaaatttaacattggtgcagtactactaatttacagttcatatttgtagtttctcaggattatttttgtgttaataatatcctcctctatagcttctttctccatccaggatctggtcaggatcacccattacatttagttgtaatgactgttttgtctctaatctattaataaaacaattcctttattcagttgggttttgctctattacccagcctggagtgcagtggcacaggcccggctcactgcagcctcaacctcctgtgttcaagctattctcccacctcagcctcccgagtagctgggattccaggcgcatgctaccacatccagctaacttaaaaaaattttttgtggagatgtggtctcactagctggtttcgacctcctgggttcaagtgatcctcctgctttggccttccaaacgtctgggaatacaggcataaaccaacacacccagcccctttatttatttatttatttatttatttatttaatgaattaaaattttttaagtgcttaggcagttgtttggcatgatattcctcaatttgcatttgactttcttcatgattatgttcaggttaaacttttttttttccgctttaatagggacaggtctcactatgttgcccaagctgatcttacactcctaggctcaagcaatctaccagccttggcctcccaaggtgctgagattacagttgtgagccactgtgcctggccatgtgttaaacatctttggcaagaatattacataagtattgtgtgttttttagactgtcacatcaggaggtatataagatattgctttgttttattattagtgatcctaaatttgactagttggttaaggagggagcatttttatctttgtgctaagtaatccttaagccatacatggagattatgtgagtactttattttcctactcctttcaaccagtgatttttagcccccattgattatccaaccctgaatcagttgttagagtagtagttgtaaatcagaatacattctttggttgcaagtcttctgtaaataactttccctcattctttttcttcccttttaaatatcactgtggattattttttaaaaatcagtgtgttatagtccattgttggaatttttttttttttttaattgagatggagtctggctctgtcacccaggctaaaatgtagtggtgcgatgtctcggctcactgcaacttctgcctcctgggttcaagcaattatcctgcctcagcctcctgagtagctgggactactggcgcatgccaccatgcctggctgatttttgtattttttggtagagacagggtttcaccatgttggccaggctggtctcaaacttctgacctcaagtgatccacccacctcagcctcccaaagtgctgggattacaagcgtgagccaccacgcccagctcttgttggattttttcatttctgaccctcaggttgtcccagattcaaccattgtagccctatcagactgactcctgaaactctttgatactcccccatccgtttttgaactcttccttactttctggaacaacaaaatattccaggctttctttgtactttccctggttcctttcagtaaagatttagttgtcatggagctaactctggtggtggtgcttttgaagattatctaaataggaggccagaagatgaaggtcaaaagtcgtttcagtcatgcaagcaggagttggtgagagccacagtcacagcagtggggatggaagggagtcctgactgaagtgacatttctgaaattttaaaatttatttggtgagcatttaggtgtaaaaattgtgagagaagagtcaaggacaactcttaatgtgtctagcttattctgggtgatgactggttctaagttatcaggagcaagaatagaaatccataaagcagatttatgaggtaatataccaagttccattttagtcacaagaagtttgaggtccctttaggatgtccagatagagatgtctcagctggtagaaataggagttcaagagagaataatttgggagtcatcttccaattgacagccaagggactgtgacagagcttttctctccaattggagtgtaagccctacatggctaaggtttgtttatacttgtggaaatccccataatctgtgtattgtgtgtatgcaatgaaatattcagagattaaaagacaaacatgtaaaccttgtataacaccgtggggggaaaaactaacatggatttttctcttgattctaacaagatcttcgaaaaatgctgttttctttctttgtcagcatatctttgattgcagcagtaatagtcttaatttattttgaaaattaggatattataccatttattgataaatactgggagtgcatgacaaccagacagagacctgggaaaatgacttggccaaataacattgttaaaacaatggtaagtagattaaaattgattagacttgacatttaaaaaaccattgttttttgtaagaattcaataatatcgtctcattgtgaaatgataaaattagaacaacttaatgttaaatctttgagtgtgagatacagctaattgtgaattttagtagttttcacacacagaatcagtgagatgcatattgtcttatatgaacattgcccgcatacacctggttttatgtattgaaacttgtccacagtacttttccaagaataattttgtattgaaattagagaccatttcttttcttctattaaaaaaaaagttataggcaatattgtccttaaaattaaagagagcacctggggagaagtcaacagcaagctgttaacagtgcttatctttgtgaaatagaaggataggtgaggattatgaaaaacttgggcactctttgtgtttctctgttgtttgaattttttgatggtcactgattatttcttagaaggaaaaacgatactatcttttttggacactgcacctaggaattgacttttagagttagtggttgattattaattccatacttttaagtataaaatgttcattaatagtaaaacactacttctttttagagtaaagaaagagatgtattcttggtaaaggaacacccagatccaggcagtaaagatccagaagaagattaccccaaatttggacttttggatcaggtacattaatatgttttacattttctttttgattttaagccactcggggataggtaatcaggttctgtttacatttgtatatttgccacataacacactgccattatatgcacatagcatggtggactccaaaaaaatagtgactgatatgagagtactcaccttcaaccaagagaccagtgttgtatagtgtttttgttgtgggtcttccccaaaatgttatgaatttcttcaaatcacttttttttttaactttagtttcctcgcttgtaacatgtaaaaatgctatttcaaattacttctaatcttcctgccatcttaaattttgctcttaaaaactttctttgttgtgaaaagaatttgttttgaagaatttgtgttgcatatctaacataacaggcaaacgaaaattgctgttttttgttcaacagcagggttcacatttggcaagtcagaatgtcaaatcttaaagctgtgtctttacatgtttgatttgccagctttgaaaatgcaagattcagcccggtgcagtggctcatgcctgtaatcctagcacttttggaggctgaggcaggaggattgcttgagtccaggcattcaagaccagcctggacaatacaacaagacctgtctctcaaaaaagaaaatgcaagatttcacatagaaatttagatttctgtcttgtaaaatgaaaacatctgactgcatggggcctgaattcccacaggagctgagtgaatggggcttaggcactctggtttgccctgtgccctctcctgcctctacccaagttgattgattaattgccatttatcgccattctgaaactattctgatccttacacttggcctacctcacacatacttgcaaggttgcttgctggtccttaaaacacccaagtttgggactctgcaagcttcattgtttagaattgtccatttcagactgtgcatggtggctcacgcctgtaatcccagcactttgggaggctgaggcgggcagatcatttgagatcgggagttggagaccagcctggccaacacagcgaaactctatctctagtgaaaatagaaaaattaggccaggcatggtggctcatgcctgtaatcccagcactttgggaggccaaggtgggtggatcacctgaggtcaggagttttgagaccagcctagccaacatggtgaaaccccatctctactaaaaaatacaaaactttagctgggtatggcagcaggcacctctaatcccagctactcaggaggctgaggcaagagaatcacttgaacctggtaggcagaggttgcagtaagccgatatcgcgccactgcactccagcctgggtgacaagagtgaaactctctcaaaaaaaaaataataataattagccaggcgtgttggtgtgtgcctataatcccagctactcgggagggtaaaccaagagaatcgcttgaacctggaaggcagaagttgcagtaagccgagatcgcgccactgtactacagactgggcaatagagtaaggccccatctcagaaaaaaaagaattgtcaattttagttcccattctgttagaatttctcttgttttatgagcatccagattgactgacttacgtagactccttttttaattggatgtatttttgcaggaccttagtaacattggtcctgcttatgacaaccaaaaacagagcagtgctgtgtctactagtgggaatttaaatggtaagtgtttacatatctcattgctgaaatatttggaagctattgaatccagttgtgcctagaactggccattctttgggttgacccttaacctggatacttactaaaatgcttttatagttcaaactcaatttttaggaactagccaaggatttggcagatggtaatagaggagaactttttgtcactttacaacagtttggtcttgagtgagacaggtttagcataagacaaggaaccatttcaaggtcagatttgctgtgtttatatctgtatccttataactaacattaaatttagaaagattcatctcctctccactctttttctgcaattcagctgttacttttaacagatttcctgtgcccatcttctaatttttcttgccctgaaacttcagctcattcacatgatagcatttctatattaaccacccattgcagcttgttcttctgttaacccatctaatagcgggaaaacccctcgttactaatggttatttaataagagttggggtggctgagagatatttagctgttcatctgatatatgggatcattaacctgtcttttggagtggtcgcgtcttaaatatctgatcatttctactgttactaatattttaaggtgggttggaaatagctagtgtgttatctttttacaacatattttcccgttttaattgttaaaatttgacaaatacatggtgccacttctgttcttacaggtggagccacttttggaggtgaattcctccactgtcttctttcagcctctcagacttaagtattttgtggtttggaaaatgctttttgctgagctatggtagaagctaaaaactacataatttgaagcattatgaaaatggcggcaatagcacttaatatgaaacagtagttgagtttaatgttagtatttaagagcttgtatgttgtcatattctgcctaacatggccagccaccccacttctgtactgtttgctctgttctggttggatctgaaacttcttaaaataatcaaaatgcaaatgacaattaaaaatgtaattgtggccacgcgaggtggctcatgcatgtaatcccagcactttgggaggccgagacaggcagatcacctgaggccaggagtttgagaccagcctggccaccatggcaaagccccatctctactaaaaatacaaaaaattagccaagtgtggtggcaggcgcctgtaatcccagctactcaggaggctgaggcaggagaatcgtttgaacccaggaggcagaggttgcagtgagccgagatcgtgccactgcactccagcttgggcaacagagcaagactctgtctcaaaaaaacaaaaatttaattgttttttgattatggttacttaaactagagatgatgacattgcagcagtttaacattaaacttttatgaaaaataggaataacatctgaggtgttcaccaaaggaaattctgcataaaaagtctggtcctgtatatgcagaatatgagccaccttcaatgtcttgatcctttttattgcagcagaactgctagtaattcccaagcttgccccaaattaagatttagtactctgcagttgtttacgtaaaggtgttttcctgcagttcagggacatttcctggaagagggaaaaataaaactaattgagaggaatttgaactggacaaaaatttcaaagtacctatttcagaaatacacaaggtaatcttccttgtggctttagtatgtagctaaattttttgtataaaatatgtaaattgtctattcctatttattgcttttagttccacaagccaggttaatctaacctgaattttagtgcattggcacaatcttaataaatgttgtatttgacgaatgggtatggaactaaaaattgcctagcaaatcgaaagccttctttcttatttgtgtcatgtgcaaccacgatggagatctagcagtactggagagaaacacctttttagtacttctgtttccgttttccatgttggatgtattttgtcttgttggatattcaggttcaatgctttagcagatactgtgcttttatgatgtttatggactgtattgtgtagttcaagcaagtgaacatcgacttacagtgaggacattctctctttatgggtgtttgtattaatttggatgaaaaaaaatgtgcccatacagttgttttcattctttttagctgtgggtgtttgggatctgaatgagtgagaatgcatttgtgtcacaccctgagaaagtataccaatagttgcagtttattaggaacaaaggttgaaaactgtaacccaaccatcatagtgctggattcatttgagtttattgccagaacccagtgttcccaggctatgagatgctcagtagattctttgaaaactagggtgaaatccaatatgcctttggaaggaaatcctcctgtggtgttacacaaatgcacattgggtgtgttggtccctatggaatttcagtatccacatggtgtttcccttgtggctcattgaaagcaatctgccttctcttcaaagggggaattgcagcaggaagcagcggaaaaggacgaggagccaagcgcaaacagcaggatggagggaccacagggaccaccaagaaggcccggaggtggggagagtgcccaccctgcccccctcactatttaagtattatttggtgctgggaaagtccagcagagggaagagagttcaagggtcggaggttaaaaagcctgtccattttttctaaaccttgagcactttgagggacaaaataaccccaggttggaggccaggcgcagtggctcatgcgtgtaatcccagcactttgggaggtcaaggagggtggatcacttgaggccaggagtttgagaccagcctggccaacatggcgaaaccccatctccactaaaaatacaaaattaggcaggtgtagtggtgagcgcctgtaatcccagctacttgggaggctgaggcaggagaatcgcttgaacctgggaggcgggtggcagtgagccaagatcatgccactgcactccatcctgggcaacagaatgagactccgtctcaaaaacaaaacaaaaaacaaaaataataaccccaggccgggcacggtgggtcatgcctgtaatcccagcactttgggaggctgagacaggtgaatcacctgaggtcaggagtttgagaccatcctggacaatgtggtgaaaccccatctctactgaaacaaaaaacaaaaaaattagctgggcctgggggcacgtgcctataatcccagctactcgggaggctgaggtgggagaattgcttgaacccaggaggcagaggttgtagtgagctgagatcgcgctatcgcactccagcctgggccacgagaacgaaactgtctcaaaaaaacaaaacaaacccaagtttaagtgtcatgttttacatttaagtgtacatacatttgttagtacaaaatttatagtagtaacaaggatagtgtcttctggtgataagcctggggaacctagggagtgaagttctgttaaggcgacttgagaaaggataggtggggagggagtgaaaccagtgttgaatgttagctcctttagctccttaactttctgcttctcccttctcatgccttttcccttccctttgtctaaagctgaggtgatgaaatccaggttgcttatttatttatatatttttgtgagatggagttttgctctatcacccaggctggagtgcagtgatggaatctcggctcactgcacaagttatttacttagattagcaagatagcaagtgcttatgtctctgagcttctgttcattactttataataatcagtatactaaagactatcaccctaatcacccccattcctctcctcccttccccccccccccccccccgcataatgtaccagctcagtttcatagacatcaattcatgtttaaagaccactgggaagatatccacaatctacaagtaatttcaccaaaactaccttgctcaataaagctaatccttttcacttccttgttttgcctgaagagggcagagttacttatttgagtaatgagaagtatttgctgtgaagttgcatgtattctagctgaaataaaccagaggcctttcttacacagttgaatgcatttgagctaaagggggttttagttttttgatgttattttttcctttctgcagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgaggtatgtaaagtattggagatcatatggatgcagggttactttgaactgccatcattagccttgtcagtctagaattaggtgtacatctcagtctgttgccactgcctcacccccatctctgtctagattcatccagaatgtgcaagaaattctgttccttcctataagctccagccgttttatttatttatatatatatatatatatatatatatatatggttttttaaaactttctattttgaactaattttaaacttgcagtaaagttgccaaaaataagttttctttctcatcaagcttttcctaatgataatatcttagaaaaccatagtacagttatcaaaactgggaaattaacattggtaaatattatcaacacaactagagaaagacctttcaattttaccagtttttccactcacacttaattatttctctttagtctattatagtctttaacagttccaaagccattgcttatctttcatgaccatgatatttttaagtgttttaatcagttattttgttgaatattcctcagtgaagatttgtctaatgttttctcatgattagactgaagttaggcagtttggggaagaataacacggaaacaatgtcttatagcatcatctcatgggattcatgatgtcagtaggtcttattggttacgttgaccatgatcatttggttaaggtgattctgctagctttctccactgtaaaaaactaccgtctttcccttatacttaacaaatgtcttaggcaaaaatacatcgagtctatctatgcaaatatcttgtttgtttttaaacttatgttcactaattttagcacccatcagtggatattgtctgcaacaattatgactgtgttgtatgatgattttcgatttcctctttcccttttctgttaattgattatttatatcagtatggactcatatatatttactttatttcagggagtataatccaatactttgattattttgttgtttaaattattccagctttggcaagtaggagcttcttcaagaagttggttcttgtgttctttcgataagccgtgtctttttttaaaaaaaaaatttctttactttgaggcatcaaaaggtgttcctggccaatcttatattttctgtgccccaggcctacttctttcaccgagccctggttcctttgattggagcatgttgtttaggaataacatctaggtgctcacttccatatatcacatataccaaaattagaatgataaagagaagatgcatggcccctgtgcaagaataacacacaaatttgtgaagcgttccttattttttttttaagtaataaagtaaataaacaaatagcaattaatatctaggtgttaggtgtgctgttactaggcgtcattgcttctagacttcctcagtggtcagaggtaggaagtgcatgtgtgtatgtacaaacctgcatgtacacagataacaatttatattgatacctgggttgacagccttcctcctttccttatttgtaaggtctttctccaacagtgggaaatgtgaataattagatagataattatctacaatatatttactttatttcaatatatttattttgttatagagatcagagtctcactcaggctggtatgcagtgatgcagtcctggctcactgcagcctcaacctcctgggctcaaacgatcctcctgcctcagcctactgagtagctgggatcacaggcacacgccaccacacctagctgggttttttaattttaattttttagaggtggggtcttactatgttgcctaggctggtctcaaactcctgggctcaagccgtcatcctgcctcagcctcccagggtcttgggagtgagccaccattcttgaccttgctcatatttaatatgcacataaagtcgtttcagaatttctttttttttttttttttttttgagttggagtcttgccctgtcacccaggctggagtgcagtggcgcaatctcggctcactgcaacctctgcctcccgggttcaagtgattcttctgcctcagcctcctgagtagctggaattacaggcacgtgccaccacgcccggctaattttttgtatctttagtagagacggggtttcaccgtgttagccaggctggtcttgaactctggaccttgtgatctgcccgcctcagcctcccaaagtgctgggattacaggcatgagccactgaacccagccagtttcagaatttctaatccctgggagaaacatttactaagtagattatagcatttatatatagctctttttgtctttagacttgccgtactcagtccaaggtactggtaacttagattagttcttttcttccccacttcctttagtgggtcatgtccagttaagtcaggtttatttgctagtgtttgatgccattttggattctcccacatgttgattgtttgtgtgtatgtatgtttggagtgaggatgtgtgaaacattactatggttctgggagtcagagctgtacagaacggtttacaaaatgtcactccctcatcacccctacagtgcccttctcactctcttttttccaccgtcttcccactcacactctagtttctagtttatccttgctgtatttcttcacaaatgagcagatacagtacatgtatatattcttttgtctcccttttttgtttgtctgtttctgtgtttttttggtttgatttgttttttgaggctagaaggcagtggcgtgatctcggctcactgcagccttcacctccctggctcaagcaattctcatgctgaagcctcccgaatagctgggactacaggtgtgtgccaccacccgtggctaatttttgtatttctagtagagatggggtttcgtcatgttggccgggctggtctcaaactcctgagctcaggtgatctgcccatctcagcctcccaaagtgctgggataacacgtgtgagccactgcgcccagccttatctccttttttatacatgaatagcagcgtgctatatatatagtctttgctccatgcaattattttattttatttttttttttagaaaggttcttgttctgtcacccaggctggagtgcaatggtgcaatctcagctcactgcagcttcgacttcctggctcaagcaatcttcccatcttagcctcccaggtagctgggactacaggcacacatcactgcacccagctaaattttaattatttttttagggacaaagtctccttcactgtgttgcccaggatggtcttgaactcctgacctcaggtgatcctacttccttggcctcccaaagtgctgggattataggcatgggccattgcatctggcctcattgtttatttgtttgttttcaagatggggtctcactctgccacccaggctggagtgcagtggtgtaatcatggctcactgcagcctcaacctttcctgttaaaatcagcctgcaaagcctcgaaattctctcccaccttttgccattttttctttctgtggaagtcatggggttctcccctgattatttagattgctcccttatctcacataatggcctggtaataaagtaagattcaaaccatatgcagaggtagagagatgaattacagtgaatacctgtcttagtccctttgtgttgctactaaggaggacttgaggctgggtaatttgtaaagaaaagaggtttatttggctaaaagaagcatggcaccagcgcttgcttctggtgaggatcccaggcatgtccagtcatggtagaaggcaaagcggagcaggcgttagatggcaagagaggaagcaagacagggagggaggtgccaggctctttttaacaaccagctcctcagaaactaatagagtgaaaactcactcacatccccacattccgcattaatctgctcttgaggtatctgccctcctgacccaaacacctcccatcagaccacacctccaacattgtgatcaaatttcaacctgcacttagggtcaaatacccaaactatagcgataccttgtacacttttcacccagattttaacagttcaagattttgccatgtttgctttatctgtttatttctttttctttttctgaattaaaaaaatatatatatcaccctatgtacactaaaaactatgcatctctttaaaaatgcggctattggggccaggcacagtggctcacgcctgtaatcccagcactttgggaggctgaggcgggtggatcacctgaggtcgagagttcaagaccagcctgaccatcatgaagaaaccccttctctgctaaaaatacaaaattgcgggcctggtggtaatcccagctactcgggaggctaagacaggagaatctcttcaacctgggaggcggaggttgcagtgagccgagatcgcgccattgcactccagcctgggcgacaagagtgaaactccatctcaaaaaaaaaaaaaatgcagatattttcttttataaccaaaataattccttgctatcatccaaattcagttcataatcagatttccttgattgtcttaaataccggttcatctcctgagatatttattaattacaaaaggaaaattgtcatttagcagtggagaaacctggcaggcatcatcttaatcaagtgaccagggtgaacatcactattttgatagcatatatgatgcactgaggggcacaacattacctcattggagttcctgagtaagaataacaataaccttgaccttaaaatgaggaaacgccaggccgggcatggtggctcacacctgtaatcccagcactttgggaggccaaagtgggtagataaccggaggtcaggagtttgataccagcctggtcaacatggtgaaaccccatccctacagaaatagaaaaattagccaggcatgatggcaggcacctgtaatcccagccacttgggaggctgaggtgggagaatcgcttgaacccgggagccagaggttgcagtgagccgaggttgcaccatcacactccagcctggatgacagagcaagactctatctccaaaaaaaaaaaacaaaagaaaacaccagacaaatgtaactgagggacattctacaaactgaaatgaccaatattcttcaaagtgtcaagcttatgaaaggttgaggaactgtttgagattggaagaggctaaggagacatgacaactaagtgaaatgtggaatctaggattagaacctgggccagaaaaggggatattacttggataattggcttaattttaagaaggtccatggattatttaatagtattattgttaattttctggttttgatgattatgttaatgattatacatgatgtgaacatttgggaaaactgagtgaagcacacactaggactctactattttttgaaagtttgaaattgttggccgggcgcggtggctcacgcctgtaatcccagcactttgggaggccgaggcaggcggatcacgaggtcaggagatcaagaccatcctggctaacacggtgaaaccctgtctctactgaaaatataaaaaattagccgggcgtggtggcgggcacctgtaatcccagctacttgggaggctgaggcaggagaatggcgtgaacccgggaggcggagcttgcagtgagcagagatcgcgccactgcactccagcctgggcaaaagagcgagactctgtctcaaaaaaaaaaaaaaaaagaaagaaagtttgaaattgttttaaaacagttaaggccaggtgctgtggctcattcctgtaatcccagaactttgggaggccaaggagagcagattgcttgagttcaggatttgagaccagcctgggcaacttgttcaaaccctgtctcttcaaacaattagctggatgtggtagcacttgtagtaccaactacttgggggctgaggcaggaggattgtttgagcccaggaaatcaaggctgtagtgagtcaagatgacaccactgcattccagcctgagcaacagcatgagaccttatctcaaggaaaaaaaaaaaaaaactagtcaagaggctagccacagtggctcatacctgtaatcctggcacttgggccaacacaagaagatcgcctgaggccacgagttcaaggctatggtgagctgtggttgtgcgactgagtaagagagcaagaccctggctcttaaaaaaaaaaaaaaaaagttaaattttttaaatgaagatttattcaaattaagttccaaactcatcaccattggtttgttatatttgagggaatatgcaatataattaatatcaatcagatgtcttaaagttaatcacatgtaggctgggctcagtgactcagcctgtaattccagcactttgggaggtcagtgcaggtggatcacctgaggtcaggaattcgagaccagcctgaccaatatggtgaaacccgtctgtactaaaaatacgaaaattagctgggcgtggtggtgggcgcctgtaatcccagctactcaggctgaggcaggaggattgcttgaacttgggaggcggaggttgcagtgagccaagatcgtgccactgtactccagcctgggctacagaacaagactctgtctcaaaaaaaaaaaaaaaaaaagataagccaggtgcggtggctcatgcctgtaattccaacactttgggagaccaaggcgggcagatcacgaggtcaggagttcgagaccagcctgaccaacatggtgaaaccctgtctctactaaaaatacaaaaatgagctgggcgtggtggcacgcgcctgtaatcccagctactcgggaggctgaggcaggaaaattgcttgaacccgggaggtggaggttgcagtgagccgagattgcaccactgccctccagcctgggcgacagagcgggactccatctcaaaaaaaaaaaagataatcacatgtaataaaaactaagtaacctaacaactttctcttttttgttgctttctcattccttgccagtatcttatgctgagatttttaaactcctcaactaatatttcaaacacctgacctgatatttgtgatttttaaattgttttattggactaatgtttttgtggcaattgtccccaagaacctcaaataagttgcaggccttcttttaatctctgtcaccgcagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggtaagctggggccttaatatggacatcacagcagatagagaggatagaccatctggccaagggctaaggcttcaaggctgttgggtttaccagattgtgggcatagaattcagttcctgagggttgagctggtttgctattcccgggatatttttgtaattctttgcttgtgagaaagtttttaagcaattttacaaaattgaccaaaaaacataaaaagaaataggatctttttccttcagcaaactagatttgacttgcaatcttctgacttcctgtgtatgtttttattgggacaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggtgagtttgtcctctcccggcagattcctggctttgaaggcctgtggcagccagtgcttatcactggcttgtgtgatctcttaggaactgacccacagctcacgttttttcctaacctgttgctatgacattttcagaataacagtaacaatcggtgcacaaatagtcatccattcattcttctacccatctatcatttgtctttttttagtgcactacagagaaaatgacagacatcaggacactttcccactaagtacttcaggatacataagctagaattcagcctgtttaattcattcttttgatacaaaatgtatataaaatgaagtacacaaattttaagtgtacattcactgagttttgagtttgacctaaactgttgaaatgtaggatccactaggcatgatggttcacgcctataatcccaacaatttgggaagccaagctgggaggactgcttgagcccacgagttcaagaccagcctgggtaacatcacgagaccccatctgtacaaaagactaaaaaagtgccgatagtcccagctacttgaaaagctgagatgggagaatcattcagcccaggagttcaaggttactgtgagctgtgatcacaccactgcactccccccaaaaaagagatgtggacacttaccatcacctcaggaagtttcctcatgccttttcacagttagtcctcacccccacatagaggcaaccactgttttaactttctttcccaccatactttaatttgtacctcttcttgaacttaaatgggctcatgcagtctgtagtcttttatatctggcttttgagactcatccattttgctgcatatatctgtgcacccttttcagtgcagggtagtactccattgcatgaatgtgccccagtgtgtttatgcattttcctactgacagacacttgggccgtctcaggtttggggctactatgagcaagatgctatgaatattcttgtacagtctttttggatcattggatagttacatatttagctttataagaaattttccaaactcttttcctaccatatatgagggttttagttgctgacatttatgattgtctgtcaacttaattttagccatttttgatgggtgtgtagtagtatctcattgtgagttaaattagcatttctttgatgacatactgggcatttttcatgtgcttttcggccactcatatgttttttgtgaagtttctcttcaaatattttgcctgttaatattgctattctgagacttctctgttcttttttttttttttttttaagtttaaatttttttggtagaaacaggtttggtattttttgtttttttttttttttccatgttgcccaggctggtcttgaactactgggctcaagcagttcacctgcttcagcctcccaaagtgctaggattacaggcatgagtcactgcacttaatagtgtcttctgaggaaccaaagttttagtttttatgaagtctgatttatcaaatttttcttttatacttatttctttccatgaatttaaaaaaaaatctttggctactccctgtcatgaagatattctcccatgttttcctttgaaaacatcatggtgttagcttttacacataggtgtctgatttaccttggattaatttttttttttctttagatggagtctcgctctgttgcccaggctggagtgcaatggtgcaatcttggctcactgcaacctccgtctcatgggttcaagctgttctccagccttagcctcccgattagctgggattacaggcacccgccaccacacccagctaatttttgtatttttagtggagacagggtttcaccatgttggtcaggctggtcttgaactcccgcctcggcctcccaaagtgctgggattacaggcatgagccactgtgcccgaccagatttttatgtatagtatggaaattcattttttttccatatgattacacaattatcccagcaccatatgttaactctttcctttctccactggatttctttgatgcctttattgaaaatcagatgtttgtgttaaggaaaggtttacttcagagctctgtatttcagtgatctgtttcttgtcctttatgcatgtatcacagtgtcttggttatcatagctttagagtaagtctttaaatttgatagtggaaatactctgagtttattctgataataagcagcctacagtctcatttttattgattatatcacactagtgacttattgtaccatcctgcctcccggaactctttaaatgtataccacactgatgcctggttttacagaacacagaggtctgcacttaaaaggattctgtaggtgttttttcaatgattcatttacattacaaaaaaaattttttttcctttaattaaaaaaaaaaacaaattttttgaccagacactgtggctccacgcttgggaggccaaagcaggcaaatcacttgaggccaggagctcgaggccagcctgggcaacatggcgaaaccctgtctctacaaaaaaaatacaaaaattagttggatgtgatggcacactcctgtaatctgagttactcaagaggttgaggcatgagaatcgcttgagcctggagggcagaggttgcagtgagccaagatcatgccagtgaactccagactgggcgacagagagcaagactgtctcaaaaataaataaataaataaataatttttagtgacatgtccacacgacagaatactatggatctattcaaaagccgcatatatactgattataaaatggtctctaatgtagttgccaagttaaaaactcaagatgcaagaccaaacttataatatgttaccatttgtatggctttttgggctttttttttttttgtatgtttatctggtgttttattttgaaacagagtctcattctgtcgcccaggctggagtgcagtggtacgcagtctcggcatactgcagcctctgcctcccaggttcaagcaattctcctgcttcagcctcctgagcagccaggattacaggcgtgcaccaccacgcccagctaatttttatatttttagtagagacggggttgcgccatgttggccaggctgatctcaaattcctggcctcgtgatctgcctgcctcagcctcccaaaatgctgggattacaagcgtgagccactgcgctcggccacatgtgtgtgttttaattttgaagacaatatatgcctagattctctggaaggataccaggacactggaacagtgattacttttggcaggggaaactgggtataagggacatagaaagagagactctcgttttatatgcttgtatatcttgggaattcttcttttctaaccatgtttaatacatatatatgttaagaaattgaaattttttaaattaatgtcatatatttctctggaagtgaatagttaaatagactcttaagaaccagtaagaaagaggtgacccagagaccacctgtgggaacagatgggaaactaggacggggaagaaggtgaccttcaaaatattttcatagaataagggattgtaggcttggtgcggtggctcgtgcctgtaatcccagcactttgggaggctgaggcgggtggatcacctgaggtcaggagttcgagaccagcctggccaacatggcgaaaccccgtctttactaaaaatacaaaaagtaaccgggtgtggtggcacatgcctgtaatcccagctgcctgggaggctgagacaggagaatcgcttgaacctggcaggccaagattgcagtgagccaagatcacaccactgcattccagcctgggtgacagagtgagactgtctcaaaaaaaaaaaaagaataggctgggcgcagtggctcatgcctgtgatcccagcactttgggaggccaaggcgggtggatcacctgaggtcaggagtttgagaccagcctggccaacatagtgaaaccctgtctctactaaaaatacaaaaaattagccgggtgtggtgtaatcccagctactcgagagcctgaggcaggagaatcgcttgaacccgggaggcggaggttgcagtgagaagagatcacaccattgcactccagcctgggcaacaagagtgaaactccgtctcaaaaaaaaaaaaagaataagagattgtagactcaataaacgtcatttttttcagtgagattattggaaaagatgtgtgaatttagccacttttatgggtatttttattgtggtaagcatgtatgtattatgtattttctcacgtttcttactaaaggcctactgaaaatgttttaataaacatgtgccatctggtattttttaagaagtgtgtaatagttcaaaatctagcaaaactcaactgcaaagatttttaatatctgttgtagagctcaaggggttaacactatttgtgtgcggatgcgtttttttcatgatgatggagctgatgctttattgtgcctttttttctttcttggttttcaaggctttgataaaattcaagagttatttgtattttgaggaaaaagactttgtggataaagcagagaagagcctgaagcagactccccatagtgaggtgagtcatggccataagaacattagaatcataaggccttgagcgttaggacccattccttcattataaaagtgaggaacacgaggcccaaaggggaatgaaggggcatctggtagccccactggccagcggcaagctcaccctctgcttattgtgttttgctctttatgtagtaccatgcttctgctgttagagacatgatcctgttctttcaggataactctgtagagaaaagtgtataaaaatagtggcctgcaccaccccatctgggaggtgtacccaacagctcattgagaacgggccatgatgacgatggcggttttgtggaatagaaaagggggaaaggtggggaaaagatagagaaatcagattgttgctgtgtctgtgtggaaagaggtagacatgggagacttcattttgttctgtactaagaaaaattcttctgccttgggatgctgttgatctatgaccttacccccaaccctgtgctctctgaaacatgtgctgtgtccactcagggttaaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttgtatgctgaccttccctccactgttgtcctgtgaccctgccaaatccccctctgtgagaaacacccaagaatgatcaatgaaaaaaaaaaaaaaatagtggcctgttgggaaatctacaagagactgaggaagcaagtccagtgtctttattctttatcagaggaggtatcaagtccaaagggagggaacctggagtgggagagtagaccttgtggtgtggcccaggggcactaggagctgtaacgtctcactcagtgtccttcagaactttctctgcctccacttccggggttgctggaaacatgtctgcccaaggtcatagcacagtcagagaaaggctggcacatctgggccagccacaagcaccaaaaataaaaagggaagtgggatgtagaggaagaaagttaagctggaaacatttttttcataaaaatgctaatgctgtgaggccacccaggacactaatagaaggagatggaggtgaaataaagaaacgagtttcagctgtttttaggaaagaaatactaaagagaaataattattagatctaaagatgcaataaccagaaagccccctcttgtgggaagagaaggcagccttttctgaagaattgaagtggtcaagagaggatattcagtgtaattctgggagagaaaggaggaacatgaggattcagagatgtgacataagagtcttagagaacttcaaagtgaaaaagcagaagtgagaactgactcggggaaaggaattgataaataagcacgcttaaacaggtgtggtcccaaggagtccatggaaggccagcttactttaaaaaaaaaaaaaaattttgtagagatgaggtctcactatgttgcccaagctagtcttcaactcctggcctcaagtaatcctctctcctcggcctcccagcttacttttataaatacagtgcaatgaataataaaatatagaaatgtttggtatatgtagcacaggaattcagaaaacaaagccccggactttgagaccagtctgggcaatacagtgagatctgtctctataaaaaaattttaaaaattagctggatatggtggtgtatgcctgtagtcccagctgcttgggaggctgatgtgggaggatcacttgagccaaggaggttgaggctgcagtgagccaagatcacaccactgcactccagcctgagtcacagagtgagaccctgtctcaaaaaagaaaaaaaagcctgaatagtgcatattaacatgctttgaaaaatcgaaagtattataaaaattgaagatgttgttattacacaagttatgcactgttcttgggtgagtgactagcagtctggcagcagcacttctaacatattttcctagagagttctttttttgtttgttcttttttacagttctgaagtaaaaccatggtttttgtttcagataatattttataaaaatggtgtcaatcaaggtgtggcttacaaagatatttttgagggggtttacttcccagccatctcactgtacaagagctgcacggtacgtacatgtttccatcccatgagcaaaacttgagggaagcagatgaatgggttgtgatgacaaagttactgagtgctggaacgaaatccaagcagcctcagagtggcatgcgcatgtgttgttaccattactgtttagtccagaaacagtttgggcatcttagggagtatttgctggatagaaaaaggtcctgcagtttgtgtgcgccatacttttcccttgagcacgtggtgtggtgttaccgttcagtaggaaggatataaatacacatacacaaatcctcctgggatgtcatgataacccaccattattagtcattgttgcttacaatgatttttttttttttttttttttttttttgagacagtgtctcactctgttgcataggctcaccatagccttgacctcctgggcacaagtgatcctcccacctcagcctcctgagtaggtggggtgtgctaattttttggtttttgtttttgtagaggcaggatctcactacattgccctggctggtctcaaagtcatgggctcaagcagttctcccagctcagcctcccaaagtgctgggattacagagaggcatgaggtaccacatctggcaagttttttttttttttttaaatatgatccaaacatgaagaagggtactatcattagggcctgttggttttaaaaatatataggtagataggtagatagatacagatatatagaaaagttggggctgggtgcactggctcacgcctgtaatcccagcactttgggaggccaaggtgggtggatcacttgaggtcaggggttcgagaccagcctggccaacatggcgaaaccccgtctctactgaagatacaaaaattagctgggcttggtggcacatgcctgtaattccagctactcaggaggctgaggcaggagaatcacttgaacccaggaggcggaggttgcaatgagctgaggtcgtgccactactccagcctgggtgacaaaacgagactctgtgtcaaaaaaaaaaaaaggaaagaaaagaaaagaaaacttaggccagtcgcggtggctcatgcctgtaatcccagcactttgggagggtgactcaggcagaccatttgaggtcaggagttcaagaccagcctggccaatgtggtgagacctcgttgctactaaaaatataaaaattagccagatgtgatggccacgcgcctataatcccagctgtgggggaggctgacgcaggagaatcacttgaacccgggagatggaggctgcagtgagccaagattacaccactgccctccagcctgggcaatagagtgagactccgtctcaaaaaaaaaaaaagggcgggggtggcgctgggcacagtggctcacgcctgtaatcccagcactttggtgggaggccgaggtgggcagatcacgaggtcaagagatcgagaccatcctggccaacgtggtgaaaccccatctctactaaaaatacaaaaattagccgggcatcggccgggtgtggcggctcacacctgtaatcccagcactttgggaggccgaggcgggccgatcatgaggtcaggagatcgagaccatcctggctaacacggtgaaacctcatctctctaaaaatacaaaaaaaaaaaaaaaaagaaaaaaaaaagctgggcctggtggcgggagcctgtattctcagctactcaggaggccgaggcaggagaatggcgtgaacccaggaagtggagcttgcagtgagccgagattgtgccactgcactccaacctgggcaacagagcgagactctgtctcaaaaagaaataaaaaattagccaggcttggtggcacgcgcctgtcgtcccagctactcaggaggctgaggcaggagaattgcttgaacctgggaggtggaggttgcagtgagccaagatcatgccactgcactccagcctggtgacagagcaagactccgtctcaaaaaagaaagaaaaagttaatgcatgaagatttccatgtacttttagtctgtcagtaggcaccattgaagcaggtaaaaaaaaaaaaggaaatctttaaacagtgtaaaccaaaactatctgagacagatctcaatcaatttagaagtttattttgccaaagttaaggacctgcctgtaagaaaaaaacagaatcacagaaacagtctgtggtctgtgcctttctccaaggatgaatttgagggcttaaaagttttaaaaagaaaaagggctggacggagtggctcacggcagtaatcccaacactttgggaggccaatataagagaatcagttgagcccaggacctcgagaccagcctgggcaacatagcaaaaccccctttctacaaaaaaatacaaaaaattagccaggcgtggtggtacatgcctgcagtcccagctacttgggaagctgaggtgggaggatcccctgagcccaggaggtcaagggtgcagtgagccgtgatcgcattgttgcgctgcagcctggacaacagagtcagagcctgtctcaaaaaaaataaaaagtaaaataaaggggaaatgcgggctggaggggaaagtaggagggtatggtcatccacatgttgcaagagaaaaggagcagataggggaaagtcaattatgtattcatctcatgcccggtaaatcggcacttcacataaggtaaggtgaacataaagtagctgcctgtggggatatttaacgttttatctgtaggtgtctgcttagcaacaaaaggaaaggcagtttcttgcatgactcagctttcagcttaattttttccttttgacagagcaaattgggatcctgaatttttatttttctttgacaacagaaatcaacacagatctcttttagttacctaattcttgatggacatcaggatgttgaccacttttagtaatatttaatatatatcttatttgttccatttatcccccgagtattgtagccacatttaaagtgaaaatttcctgtgtcaaattaacttttccaatattttttgtccattttttccatgtctgcttgaattgaattcgctccaggtttccattaactttggaccatgcttcaagtatcctccgaaggatctcacttaccgccctgtgagtaacattacaaatggctgcatgtgtcctcagcatctccgtggctgctgtagtcaccgtgttctgtttctcattcctcctgcagatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagtttatgtgacactttgcttcccttcagattgggtgcctcttggtgacagtgttcagaaatgtaagcagcacgaggaagggagctggcactgggaggaagagccgggtttctgagttgtgttttggctgctttcctattgctcccattcttgccaatcagccaccccctttcctgtgaaaatctgccaccttgaggagaggaacaagagtttaaaagggctaatgatctccctcccggtcttcccttggaacatggatgttgatatatgtgcgggtggtttcctgtcttgcttatcttcctttgccctgagctgatggctaaagggcagttttcggactattaaagactgaaatgtaa

SEQ ID NO: 7483 - DNA, 142 bp, Homo sapiens
ctgtaatcccaggtactcaggaggctgaggcaggagaattgcttgaacccgggaggcggaggttgcagtgagctgagatcgtgccactgcactccaggctgggcgacagagcaagactctgtctcaaaaaaaaaaaaaaaaa

SEQ ID NO: 7484 - DNA, 688 bp, Homo sapiens
tgaggattggcgaggggtgcgccgttcttgtgtaaagcgggagaagagtgtattatcgttaggcaacattttaggatataggataaacactggtgtcctgaaaacgttcctggccgcaacactctcagaggtttgcattctcgagtttggagaccatggctctgaaagactcaactcactccactgatgccagccaccagctactgttgatgacttcccaagttcgtactttcagtccacacctcttcctttcgctgggcaccaaacttgtctacattccgagtgccccggcacaccccggggcttcgctttccgcctctcacagtaggaagcggcgagccgcttctagtgcccacgccgctcctcggctgcccggcctgggttttccaccctcgcccctggaatcggcctccctagattcccttccctcttaaaatcatttggaaacgggctccaaggggcgaccctgcgcagaaaaccaaattccatccggggcgggcagggagtgctagactccaaggaagacgtttcccacattcggtggtgaggagtgtttggcggcacggcacggccagcgctctcaaggaccctcttctgcgcagaatatccagtcgtagccacgaaaatacgccgcgtcagtccctgactcgaaaggaagtcctccagagagccgcactaaccatctagc

SEQ ID NO: 7485 - DNA, 452 bp, Homo sapiens
ggaaagaaaagaacagaaaaaagctaatagaggaaggtaaatctctaaatgagttaaataaggcttaaataaagtttgcatggtatattctctaaaagttgattggcgtggaggaggctgtatgtgtttgtgtgtgtatgcacatgggcatgtctatgtgtaaggtcagaagggggagcctgaattatctactgcttttttggttaactagtcctatttttaaaactttgtctaactcccaaaacttattaatgcgacatgtagtactgaaattagaagattattgttaaactcaggacagctctgtggagattcacaaagtaatttcatgaaaacttatgaggaagttgttcagtactgtcactaattaacgcgcacaaaaaaaaaacttgttgtgagtaattatgggtgatttcgctgcaaaacaaattagtatacgaattattattttt

SEQ ID NO: 7486 - DNA, 452 bp, Homo sapiens; identical to SEQ ID NO: 7485

SEQ ID NO: 7487 - DNA, 471 bp, Homo sapiens
attttatgaaaactttagtataacacactacttagtttggacttgaaatcaacttattatgatgcttaaaaaaatccatgttctaaatcataattgcatgacagtttagatcttattactatttagttgtagcctaacaaatactgtattcctctgttttctcaaaaaaaaaagttcctagtttatgaaatagtattcagataaagccttatgctgcccaccagcccactaaatgtattaaatacctgtctctatgtagcttatgtaaaaactcaatgttgactgtcccatgtctgctgcatttaaaagctcattgtgattctatcatcttgctatgccaatgccttatgttatggtgtcgtgtatataggccatggtacaaaagtgactgtcaactgcttactcaacatctagtcagaaaaggtctgaggcagtgcaataacgcttttagtcaaactggctcactgttgg

SEQ ID NO: 7488 - DNA, 623 bp, Homo sapiens
ggttttcatactagtctatgaatgctctgaatgctgcagggaaaaagaagcacaatcagtatttcattatttatgaattctcaattgaattatcctatcctgtccacacacataatagcattagcatttcttcttataccatgttgaaatacttttaatacaaactctcaatagaagcttaaacataagtggttaagtcttgttgtctagtctcattcacctgcctcaacatgctttctttcattctatttgcatacaaaatgttcttatttcagttttgtagacaggatatgagttagcatactcgtgtttgttcagctgtccatcctgcatcgttactacaatgcctttttctgccatttaatggtgtttgtatcaatgttcccatatctgctgcattttaactccataaaaaggaaatgtgatttcgtattaatagttttgttgatcaactcaatatttctgcaccaatcagcatacctatatgcatgtagtagtctgtacaattgttcaacatcaaaatacttgtttactttatgtcaaaatgtctataaaattgctggcattgttctccatttcagtctggtagaataagcgagatagaaaataaatgtgtaaatgaa

SEQ ID NO: 7489 - DNA, 471 bp, Homo sapiens
attttatgaaaactttagtataacacactacttagttggacttggggatcactttattatgatgcttaaaaaaatccatgttctaaatcataattgcatgacagtttagatcttattactatttagttgtagcctaacaaatactgtattcctctgttttctcaaaaaaaaaagttcctagtttatgaaatagtattcagataaagccttatgctgcccaccagcccactaaatgtattaaatacctgtctctatgtagcttatgtaaaaactcaatgttgactgtcccatgtctgctgcatttaaaagctcattgtgattctatcatcttgctatgccaatgccttatgttatggtgtcgtgtatataggccatggtacaaaagtgactgtcaactgcttactcaacatctagtcagaaaaggtctgaggcactgcaataacgcttttagtcaaactggctcactgttgg

SEQ ID NO: 7490 - DNA, 623 bp, Homo sapiens
ggttttcatactagtctatgaatgctctgaatgctgcagggaaaaagaagcacaatcagtatttcattatttatgaattctcaattgaattatcctatcctgtccacacacataatagcattagcatttcttcttataccatgttgaaatacttttaatacaaactctcaatagaagcttaaacataagtggttaagtcttgttgtctagtctcattcacctgcctcaacatgctttctttcattctatttgcatacaaaatgttcttatttcagttttgtagacaggatatgagttagcatactcgtgtttgttcagctgtccatcctgcatcgttactacaatgcctttttctgccatttaatggtgtttgtatcaatgttcccatatctgctgcattttaactccataaaaaggaaatgtgatttcgtattaatagttttgttgatcaactcaatatttttgcaccaatcagcatacctatatgcatgtagtagtctgtacaattgttcaacatcaaaatacttgtttactttatgtcaaaatgtctataaaattgctggcattgttctccatttcagtctggtagaataagcgagatagaaaataaatgtgtaaatgaa

SEQ ID NO: 7491 - DNA, 1385 bp, Homo sapiens
agtagaatattaaaataaatgcagaatgcgttggctccgcttctggtgtgtgttctcttcatgttctcaacttggccttggacttccaaagaggtggattagtgtctccacaaagatccagcagataatcactgtttctccctttaatccttttagagacaaagtaagaataatatacaatggtaccttggccctccaggggttatttacctggtacctcagttattactaacccagctgagaagcaggaaggaaggagatgggcctctgaacagccaaaacagatgtctaaagttcaagctcacctggatcatttattcttaatttagacaacaaaatgaggtttttccagctttggcacgttagtgaggatgctatggcaggttccttgagagcagccagaagtgatagcctggtttgagctgaggggtctgtggaatactgatactcaaacacaatagctcaagaagccggatggtctgggcccacactcggttttcacagtgagtaactgctgttcgtaatgacagtgctgcattattagagagaaattaattcattcttcatataatcttgcaaaggctcttagagtatgatatcatttaggaggtattaccaccagatatgattaaactccctcagtttttctgctaagttttgttttcatatcagtgccagaatttaacagtggtctctatcctacgagggaaagatagagtagctgcctttagttagaaatatacataaccaaaagtgacagacattaggaattgttcaaaaaggatcttaacctggaacagtggaatgatttcctacaagtgcattatttgccttttgagtaaaataaggtccactatcatccatctttgcggcctgatgagttttagaattcagagcttttcagattttttgaaaggaaatatgtatgtatacaaaaccacacatcacataaaagccctggcagggtctaaggtaacacactatgataaagcattaatatttctgcagtgaaatgtacgaagaactaattaggacaaactctgtagtttatttaaataataaaccagtagactgggtgcggtggctcacgcctgtaatcccagcactttgggaggccaaggttggcagatcacgaggtcaagtgattgagaccattttggctgatacagtgaaaccctgtctctactaaaaaaaagaaagaaagaaaaatacaaaaaattagctgggcgtggtggcgggcacctgtagtcccagctactcgggaggctgaggcaggagaatggcgtgaacccgggaggcggagcttgcagtgagccgagatcatgccactgcacttcaacctgggcgacagagcaagactccgtctcaaaaaaaaaaaaaaaatt

SEQ ID NO: 7492 - DNA, 1385 bp, Homo sapiens
agtagaatattaaaataaatgcagaatgcgttggctccgcttctggtgtgtgttctcttcatgttctcaacttggccttggacttccaaagaggtggattagtgtctccacaaagatccagcagataatcactgtttctccctttaatccttttagagacaaagtaagaataatatacaatggtaccttggccctccaggggttatttacctggtacctcagttattactaacccagctgagaagcaggaaggaaggagatgggcctctgaacagccaaaacagatgtctaaagttcaagctcacctggatcatttattcttaatttagacaacaaaatgaggtttttccagctttggcacgttagtgaggatgctatggcaggttccttgagagcagccagaagtgatagcctggtttgagctgaggggtctgtggaatactgatactcaaacacaatagctcaagaagccggatggtctgggcccacacttggttttcacagtgagtaactgctgttcgtaatgacagtgctgcattattagagagaaattaattcattcttcatataatcttgcaaaggctcttagagtatgatatcatttaggaggtattaccaccagatatgattaaactccctcagtttttctgctaagttttgttttcatatcagtgccagaatttaacagtggtctctatcctacgagggaaagatagagtagctgcctttagttagaaatatacataaccaaaagtgacagacattaggaattgttcaaaaaggatcttaacctggaacagtggaatgatttcctacaagtgcattatttgccttttgagtaaaataaggtccactatcatccatctttgcggcctgatgagttttagaattcagagcttttcagattttttgaaaggaaatatgtatgtatacaaaaccacacatcacataaaagccctggcagggtctaaggtaacacactatgataaagcattaatatttctgcagtgaaatgtacgaagaactaattaggacaaactctgtagtttatttaaataataaaccagtagactgggtgcggtggctcacgcctgtaatcccagcactttgggaggccaaggttggcagatcacgaggtcaagtgattgagaccattttggctgatacagtgaaaccctgtctctactaaaaaaaaaaaagaaagaaaaatacaaaaaattagctgggcgtggtggcgggcacctgtagtcccagctactcgggaggctgaggcaggagaatggcgtgaacccgggacgcggacgttgcagtgagccgagatcatgccactgcacttcaacctgggcgacagagcaagactccgtctcaaaaaaaaaaaaaaaaat

SEQ ID NO: 7493 - DNA, 1303 bp, Homo sapiens
ggtggggctagctggaacttagtttccaactgctggaatggattatttccttctggctagggctgatccaaatgctcttccatgggaacctgctgaattctgtcctgtgttgcttttggctgtgacagggcagcactgagttccaatgcaaagtttcacaattacttcactcttcctcctccaaacacacggactctctcagcaccacaaggtactgctggagaatggcggatgagtggtgtagacaactcaagaccatcttttctacgctcttcagtgcctctttccttggtaggatgttaaaactaagtactgtgatcactcacctgatttttggttcttatgaaggtgttttcttgtgtggatagttgttcaattttggtgttcctgcagtagagacaatcaatggagggttctgttcaactctcttgggccaccttctccaatcctgttctacttaatgtatcttggcaaactttccatatcagtacagagaaagcttcttcattctgactgctgcatagtatcccagtgcttgaaggtagcatgattaatttagccatccaattcataggcacaggttatttgggttgctttctattacttgtaattacaaacagtgctattctgttatatcttgaacatatatttttgtgcacattatagaaaatgtcaaagtgattttcatgtaggttgttccagtgaatgagagttcttattttgtcacatacttggcaaccctgagattatcaatacgatttaaatctgtctgccaaacagataggtttgtaaaaatgtactttattgttttaatgtgaatttctttgattataagtaacaattaagaatatttccaaatatttgtgaaccatttttctttttttgtgagctgccttttcttgtcctttgttcattttaaatcgggttgttttagcctcttttaaattgatttttaaaacttgttatatattaatgatatgatttaggtttgtgtccccactcaaatctcatgtcgaattgtaatccccaatgttggaggaggggtctggtgggaggtgattggatcataggggcagatttcccccttgctgttctcatgctagtgaatgagttctcacaagatttggttgtttaaaagtgtagcacctcccactttgctctcttcctccttctctggccatgtaagatgtgcctgcttcccctttgccttctgccatgattctaagtctcctgaggcctccccagccatgcttcctgtacagcctgtaaactgtgagccaattaaacctcttttatttataaa

SEQ ID NO: 7494 - DNA, 977 bp, Homo sapiens
ggcaccaccatgtatctgggaattgccgacaggatgcagaaggagatcaccgccctggcacccagctccatgaagatcaagatcatcatgcccccagagtgcaagtactcagtgtggattggtggctccatcctggcctcactgtccaccttccagcagatgtggattagcaagcaggagtatgatgagttgggcccctccgtcgtccaccacaaatgcttctaaatggactgtgaacagatgtgtagcatttgctgcatgggttaattcagaagtataaatttgcccttggcaaatgcatacacctcatgctaccctcacaaaactggaatagccttcacaaagaaattgtccttgaaggttgtgtctgatataagcactggattgtagaacttgttgctgattttgaccttgtattcaagttaactgttccccttggtatttgtttaataccctgtacatatctttgatttcaacccttagtacatacatgtggtttggtcacttcatggctgaggtaagaacatgcttgtggaagacaagtctgtggcttggtgagtctgtgtggccagcagtctctgatctgtgcaaggtattaatgtgtcagggccgagtgttctggaatttctctagaggctcgcatgggctcctgaaccaattgtttctgtcctgctggtctgtctgtcagggttggaaaagtccaagccataggacccagttttctttcttagctgatgtttcctgctagaacaccatggactgttacttgccttgagttggaagtagtttgcatttatacctgtaaatatatttatccttttaatttatgtaaggttttttttttgtatgcaattctggattctttaaagagatgacaatgaattttggttttctactgttatgtgagaacatcagtccccagcaacacgtcattgtgtaagtagaaataaaagcgctgctgttaaaaaaaaaagaga

SEQ ID NO: 7495 - DNA, 3894 bp, Homo sapiens
gccagatggtgcaggcagtgaggagagactcaggactgcaacctttcggctccttattcctgctcatcactcagaaaagggcagtactaacccctttcctaaccaagacatggcactccctaagagctcttgtctatagagtttggtccttagaggaaagcagataccttcagcgtgagaagggcttggttgacagttttggggtattatgggaagagtaggttggggtaaagcttgagtctaactcttgatccttacatggacctatgaggccctgccattcagtcaggcactgtccttgggtcctcaaattaactgctgagaacactccccactttccgaggacgctgatgggaaatgggctctgtccatgcagctggaaggatccagtgctggtgccactgtcagtggcaccatccttgccttgaatgatctttcttgcaggctcctgcagctgagtgtttcttgtaagatttttcagggggattgggcaagaagaagaggtgcaaattctgttcccttcctaccttgaagccttcccagaccaccacggtctctgcacaagggaggctcccattactgttctgttggcttctagacccaccatcccctctctttctgtggactctgcccgacttctggccacatgcaaccagcagagtaaactgctccaacacctcgggcatgtcctagggcttgccctcccaccagggccagcccaagattaggtcctcagcagcatcaaggtctgggagagccactggcccacatgtcaccattctattcctcagcctccaacaggactcttcattttggggagggaaagggaagatggggccatagcccctaccttgaaattgtacagtgtggaggggatgttagtgcctacctgtgacctttctgctccactgctcagcaagatgaggtaaggttgggtgtcagaggggacctccagcttctctgaagagccagcccttaaggcacttggagcaaaggtcattgagatcagctttatgtggagtaaggaggaggcctgggaaccgcttgtggcatcagttggggcgacaggtggatgagtgtgctctgatggagcttttacggcccacagccactgccaggagcctgagctcttccccatgcttgggacacgttccttggtccccacagcagaatggacattgaattttggtgcttttccctttggtagaaggtggaggtatctgaggagttgtttctgtcttgctacctctgtctactatatagagcaagagtcgggaatagggagatgtgtgagaatcactctcccatggatcagtgtgggccctgtccctcttccccactgtcaccaaccagcagcttggggaaaaggctctgtcgtggatttttgctgcctgcttcccgcttccactcttcttggcggtagatgttcatggtgatccactttgggcggtctgaaagtaggaggtgggggaagaggcaagcctgcacacacacttcctgtccacagggggttgcctgtggcattggagggtggagtctcagagtccagggactgggaggaaggtacttgatgggatggtcttgattctggaactttagactgaggtgttagaaaggggaattgttggctaggggagaagagcagtttaacgctccacttgctaagtcgtctgtatcagtgtcagaaggtcttgacctcccattcagatttaatttcctaactgccaggtgtggggctggggatagagggcccagaagggggcgcagtcactgacgtgaagggaccacatcccgcttcatgtcagtgactcctgccccttggtcttcagtgtttttctcttccccaggagggactttgatcatgcaggatagaattctcccatcgcacacctgggggcaagttttagatgagcttctttcctccatttcacctggtggtctgaggacacacagagggtgggggtgagcaggcagtgtgggtggggaggggctacctcccccagaccccttacaaactctgtacctctcggtgcgcggcagcctcttgctgtagttcttcttttctggatatgactgtcagtttcgtcatgagatttcttgctctcatttcgaactctttctttcttccactttctttgggggcgacccccgatccatgccaggtcttcctgtgaagaccgttccaacctcgtttccatttcttgaatgttgagtattacaacatcactgcgctagggtgcttcatggtgctgttctcgaagaggccagttgggctgaatctccttcctcccactggctcctgatatcttgctgtattttgtcttctttctgatttttccctaggggtttggggtgggtgacttaggggcggcttttgtgttctccctctctctctctttcttttctgtatgtatgtatggactggttaaagtgagtttgggcagctgactttatggtatgggttggctgacttttgttcaacattaaagacaaaccaacaaattgtacagctgcacacagaacacctttgagtgtgaacttgaatggcaactagaggcttactttttgaacttcaggtatgtaactcaaaagtaaataaaaccactattttttcagtaagcttttttttcttctaaaagatgacttagaaatcaaactataagaacatgaaatcggtgctgtaccaaagccttatatgaacatattctacactctgtataacctgtctgtgaggagctccctgctctatcaccctcttctcaaaagcctgggaatgccagcgcgtgccaagcctggggctgggtcttggggacctgtgggccaagggcaccctgggaagtaaaagatgacggtgaggatgggacacccttctgctgcctgagcagactgcaaggaaaccagatgtgtgtgtgtgcgcgcacctgcatatatatgtgtgcatacctgtgcgtgtgtgtgcgtgtgcgtgtgtgcacgcaagagagtgagagcgggagagagctcacaggtgcacagtgtcatggtgaatgtactaagtacgagcttgaagggaggcccaggttggctctgggagtggggcggtgtgggaatgaaggggggatgctctctcccctgttttctgcctccttcccttctccgtcagggaagggaggtgtattggaaacagctacactctcaatcaggtgctttttttccctcaaaatctccaaactcaaagcatttataaggggcccttccaatgggcaggcacccccagccaccaaatcacagacttccaagagtaggaggaactgtctcctcccgaacccttccttgctttcctggggaagagggttcttcctgcagggaccctgggcatcctgctgctgggcctgggcctatagactgccctgccccttcttcccaaacactgagaagaccccgctggagatgaccccaaagccacgcctgctctacggccctaagcaatagacgcctgccctggctgctgatgatggtgatccctttgtcctttgacttggcagtcaaaaatggagtgacaccccagactcagtcaggaagagaacctgcagcctgcctcagctcaggctaccacgccaggctccactcgctggtatttccaggcttgctaagtactaaccaactcatccccagtaacactgcatgttcatatcctgaattacaaatcaaaatgagcaaacacgtgcataagcaaatgagaaaaaagaaggcacacatcaaatgatgagatgtgcagccagtgcaggtaccccgggagtgttgcaagttaaactgatgaaaagacgtttagtatttaattgctcctcatgtaacattactctgcttcagaaatgttttgtattttgatataaataaacatttgctaaaaaagtt

SEQ ID NO: 7496 - DNA, 3402 bp, Homo sapiens
agaagaagaggtgcaaattctgttcccttcctaccttgaagccttcccagaccaccacggtctctgcacaagggaggctcccattactgttctgttggcttctagacccaccatcccctctctttctgtggactctgcccgacttctggccacatgcaaccagcagagtaaactgctccaacacctcgggcatgtcctagggcttgccctcccaccagggccagcccaagattaggtcctcagcagcatcaaggtctgggagagccactggcccacatgtcaccattctattcctcagcctccaacaggactcttcattttggggagggaaagggaagatggggccatagcccctaccttgaaattgtacagtgtggaggggatgttagtgcctacctgtgacctttctgctccactgctcagcaagatgaggtaaggttgggtgtcagaggggacctccagcttctctgaagagccagcccttaaggcacttggagcaaaggtcattgagatcagctttatgtggagtaaggaggaggcctgggaaccgcttgtggcatcagttggggcgacaggtggatgagtgtgctctgatggagcttttacggcccacagccactgccaggagcctgagctcttccccatgcttgggacacgttccttggtccccacagcagaatggacattgaattttggtgcttttccctttggtagaaggtggaggtatctgaggagttgtttctgtcttgctacctctgtctactatatagagcaagagtcgggaatagggagatgtgtgagaatcactctcccatggatcagtgtgggccctgtccctcttccccactgtcaccaaccagcagcttggggaaaaggctctgtcgtggatttttgctgcctgcttcccgcttccactcttcttggcggtagatgttcatggtgatccactttgggcggtctgaaagtaggaggtgggggaagaggcaagcctgcacacacacttcctgtccacagggggttgcctgtggcattggagggtggagtctcagagtccagggactgggaggaaggtacttgatgggatggtcttgattctggaactttagactgaggtgttagaaaggggaattgttggctaggggagaagagcagtttaacgctccacttgctaagtcgtctgtatcagtgtcagaaggtcttgacctcccattcagatttaatttcctaactgccaggtgtggggctggggatagagggcccagaagggggcgcagtcactgacgtgaagggaccacatcccgcttcatgtcagtgactcctgccccttggtcttcagtgtttttctcttccccaggagggactttgatcatgcaggatagaattctcccatcgcacacctgggggcaagttttagatgagcttctttcctccatttcacctggtggtctgaggacacacagagggtgggggtgagcaggcagtgtgggtggggaggggctacctcccccagaccccttacaaactctgtacctctcggtgcgcggcagcctcttgctgtagttcttcttttctggatatgactgtcagtttcgtcatgagatttcttgctctcatttcgaactctttctttcttccactttctttgggggcgacccccgatccatgccaggtcttcctgtgaagaccgttccaacctcgtttccatttcttgaatgttgagtattacaacatcactgcgctagggtgcttcatggtgctgttctcgaagaggccagttgggctgaatctccttcctcccactggctcctgatatcttgctgtattttgtcttctttctgatttttccctaggggtttggggtgggtgacttaggggcggcttttgtgttctccctctctctctctttcttttctgtatgtatgtatggactggttaaagtgagtttgggcagctgactttatggtatgggttggctgacttttgttcaacattaaagacaaaccaacaaattgtacagctgcacacagaacacctttgagtgtgaacttgaatggcaactagaggcttactttttgaacttcaggtatgtaactcaaaagtaaataaaaccactattttttcagtaagcttttttttcttctaaaagatgacttagaaatcaaactataagaacatgaaatcggtgctgtaccaaagccttatatgaacatattctacactctgtataacctgtctgtgaggagctccctgctctatcaccctcttctcaaaagcctgggaatgccagcgcgtgccaagcctggggctgggtcttggggacctgtgggccaagggcaccctgggaagtaaaagatgacggtgaggatgggacacccttctgctgcctgagcagactgcaaggaaaccagatgtgtgtgtgtgcgcgcacctgcatatatatgtgtgcatacctgtgcgtgtgtgtgcgtgtgcgtgtgtgcacgcaagagagtgagagcgggagagagctcacaggtgcacagtgtcatggtgaatgtactaagtacgagcttgaagggaggcccaggttggctctgggagtggggcggtgtgggaatgaaggggggatgctctctcccctgttttctgcctccttcccttctccgtcagggaagggaggtgtattggaaacagctacactctcaatcaggtgctttttttccctcaaaatctccaaactcaaagcatttataaggggcccttccaatgggcaggcacccccagccaccaaatcacagacttccaagagtaggaggaactgtctcctcccgaacccttccttgctttcctggggaagagggttcttcctgcagggaccctgggcatcctgctgctgggcctgggcctatagactgccctgccccttcttcccaaacactgagaagaccccgctggagatgaccccaaagccacgcctgctctacggccctaagcaatagacgcctgccctggctgctgatgatggtgatccctttgtcctttgacttggcagtcaaaaatggagtgacaccccagactcagtcaggaagagaacctgcagcctgcctcagctcaggctaccacgccaggctccagctcgctggtatttccaggcttgctaagtactaaccaactcatccccagtaacactgcatgttcatatcctgaattacaaatcaaaatgagcaaacacgtgcataagcaaatgagaaaaaagaaggcacacatcaaatgatgagatgtgcagccagtgcaggtaccccgggagtgttgcaagttaaactgatgaaaagacgtttagtatttaattgctcctcatgtaacattactctgcttcagaaatgttttgtattttgatataaataaacatttgctaaaaaagtt

SEQ ID NO: 7497 - DNA, 3894 bp, Homo sapiens; identical to SEQ ID NO: 7495

SEQ ID NO: 7498 - DNA, 3887 bp, Homo sapiens
gccagatggtgcaggcagtgaggagagactcaggactgcaacctttcggctccttattcctgctcatcactcagaaaagggcagtactaacccctttcctaaccaagacatggcactccctaagagctcttgtctatagagtttggtccttagaggaaagcagataccttcagcgtgagaagggcttggttgacagttttggggtattatgggaagagtaggttgggtaaagcttgagtctaactcttgatccttacatggacctatgaggccctgccattcagtcaggcactgtccttgggtcctcaaattaactgctgagaacactccccactttccgaggacgctgatgggaaatgggctctgtccatgcagctggaaggatccagtgctggtgccactgtcagtggcaccatccttgccttgaatgatctttcttgcaggctcctgcagctgagtgtttcttgtaagatttttcagggggattgggcaagaagaagaggtgcaaattctgttcccttcccaccttgaagccttcccagaccaccacggtctctgcacaagggaggctcccattactgttctgttggcttctagacccaccatcccctctctttctgtggactctgcccgacttctggccacatgcaaccagcagagtaaactgctccaacacctcgggcatgtcctagggcttgccctcccaccagggccagcccaagattaggtcctcagcagcatcaaggtctgggagagccactggcccacatgtcaccattctattcctcagcctccaacaggactcttcattttggggagggaaagggaagatggggccatagcccctaccttgaaattgtacagtgtggaggggatgttagtgcctacctgtgacctttctgctccactgctcagcaagatgaggtaaggttgggtgtcagaggggacctccagcttctctgaagagccagcccttaaggcacttggagcaaaggtcattgagatcagctttatgtggagtaaggaggaggcctgggaaccgcttgtggcatcagttggggcgacaggtggatgagtgtgctctgatggagcttttacggcccacagccactgccaggagcctgagctcttccccatgcttgggacacgttccttggtccccacagcagaatggacattgaattttggtgcttttccctttggtagaaggtggaggtatctgaggagttgtttctgtcttgctacctctgtctactatatagagcaagagtcgggaatagggagatgtgtgagaatcactctcccatggatcagtgtgggccctgtccctcttccccactgtcaccaaccagcagcttggggaaaaggctctgtcgtggatttttgctgcctgcttcccgcttccactcttcttggcggtagatgttcatggtgatccactttgggcggtctgaaagtaggaggtgggggaagaggcaagcctgcacacacacttcctgtccacagggggttgcctgtggcattggagggtggagtctcagagtccagggactgggaggaaggtacttgatgggatggtcttgattctggaactttagactgaggtgttagaaaggggaattgttggctaggggagaagagcagtttaacgctccacttgctaagtcgtctgtatcagtgtcagaaggtcttgacctcccattcagatttaatttcctaactgccaggtgtggggctggggatagagggcccagaagggggcgcagtcactgacgtgaagggaccacatcccgcttcatgtcagtgactcctgccccttggtcttcagtgtttttctcttccccaggagggactttgatcatgcaggatagaattctcccatcgcacacctgggggcaagttttagatgagcttctttcctccatttcacctggtggtctgaggacacacagagggtgggggtgagcaggcagtgtgggtggggaggggctacctcccccagaccccttacaaactctgtacctctcggtgcgcggcagcctcttgctgtagttcttcttttctggatatgactgtcagtttcgtcatgagatttcttgctctcatttcgaactctttctttcttccactttctttgggggcgacccccgatccatgccaggtcttcctgtgaagaccgttccaacctcgtttccatttcttgaatgttgagtattacaacatcactgcgctagggtgcttcatggtgctgttctcgaagaggccagttgggctgaatctccttcctcccactggctcctgatatcttgctgtattttgtcttctttctgatttttccctaggggtttggggtgggtgacttaggggcggcttttgtgttctccctctctctctctttcttttctgtatgtatgtatggactggttaaagtgagtttgggcagctgactttatggtatgggttggctgacttttgttcaacattaaagacaaaccaacaaattgtacagctgcacacagaacacctttgagtgtgaacttgaatggcaactagaggcttactttttgaacttcaggtatgtaactcaaaagtaaataaaaacactattttttcagtaagcttttttttcttctaaaagatgacttagaaatcaaactataagaacatgaaatcggtgctgtaccaaagccttatatgaacatattctacactctgtataacctgtctgtgaggagctccctgctctatcaccctcttctcaaaagcctgggaatgccagcgcgtgccaagcctggggctgggtcttggggacctgtgggccaagggcaccctgggaagtaaaagatgacggtgaggatgggacacccttctgctgcctgagcagactgcaaggaaaccagatgtgtgtgtgtgcgcgcacctgcatatatatgtgtgcatacctgtgtgtgcgtgtgcgtgtgtgcacgcaagagagtgagagcgggagagagctcacaggtgcacagtgtcatggtgaatgtactaagtacgagcttgaagggaggcccaggttggctctgggagtggggcggtgtgggaatgaaggggggatgctctctcccctgttttctgcctccttcccttctccgtcagggaagggaggtgtattggaaacagctacactctcaatcaggtgctttttttccctcaaaatctccaaactcaaagcatttataaggggcccttccaatgggcaggcacccccagccaccaaatcacagacttccaagagtaggaggaactgtctcctcccgaacccttccttgctttcctggggaagagggttcttcctgcagggaccctgggcatcctgctgctgggcctgggcctatagactgccctgccccttcttcccaaacactgagaagaccccgctggagatgaccccaaagccacgcctgctctacggccctaagcaatagacgcctgccctggctgctgatgatggtgatccctttgtcctttgacttggcagtcaaaaatggagtgacaccccagactcagtcaggaagagaacctgcagcctgcctcagctcaggctaccacgccaggctccactcgctggtatttccaggcttgctaagtactaaccaactcatccccagtaacactgcatgttcatatcctgaattacaaatcaaaatgagcaaacacgtgcataagcaaatgagaaaaaagaaggcacacatcaaatgatgagatgtgcagccagtgcaggtaccccgggagtgttgcaagttaaactgatgaaaagacgtttagtatttaattgctcctcatgtaacattactctgcttcagaaatgttttgtattttgatataaataaacatttgctaaaaaagtt

SEQ ID NO: 7499 - DNA, 959 bp, Homo sapiens
agtctgggatactagctcatgccttgacgccacctccttccctgctcttcctttggtattctctctgttcagagttgcttgggtctttctgatggaaatgtgtatatatgaaaagtttgtaaaataacaaaacaaataacccacctgcaggaaggacaagtgagctgaaggttgtgtggagctgcaggatctgatagccctaaagaaccaggaccaatgtgtctcttgccacttgggagggatgttgacttgaacttctttgcagaggggcttaacagggcaaggctgaggagatgaaaactgtgactccatccccacgtggctgtggaaaggtaaccagttcctcagagaaaacctggcttcacagcattagaaagggggtggttgagactacctagggacctacggtgacacctgtcttggtttgtagcactgtagctcagacagctcagaccgctcatagagggcatggcaatgggagagtttgtgaggctggctgcctgggcttggtcttggagaacacatggcctgtttagtgttgctgcagattcttagagccagtgtgaatgtggtatgtagtataaatatgtcatctatgtttttttcagttatttttaattggaaataaagtgccattgcaaataggatgctccaatcctgggacactgagtggaggatgaggagggagagatgaactgtgggccggcctgggagagggggtcttagtggaaccttccttctggcctccagccggggacttacaaaactgaacaatgtattggcagaactggacccacaatgggagattctggggagcaggagttcacttgtatctgagcaggaagcagtgtgccctgaagaatacctctctgagcaaattccagacctcacacatatgcaagggctctgccttgcagcctcagcaagcgtctcctggtgctagctccttcctgacttgc

SEQ ID NO: 7500 - DNA, 482 bp, Homo sapiens
gccagatggtgcaggcagtgaggagagactcaggactgcaacctttcggctccttattcctgctcatcactcagaaaagggcagtactaacccctttcctaaccaagacatggcactccctaagagctcttgtctatagaggttggtccttagaggaaagcagataccttcagcgtgagaagggcttggttgacagttttggggtattatgggaagagtaggttggggtaaagcttgagtctaactcttgatccttacatggacctatgaggccctgcccattcagtcaggcactgtccttgggtcctcaaattaactgctgagaacactccccaaaccctttccgaggacgctgatgggaaatgggctctgtccatgcagctggaaggatccagtgctggtgccactgtcagtggcaccatccttgccttgaatgatctttcttgcaggctcctgcagctgagtgtttcttgtaagatttt

SEQ ID NO: 7501 - DNA, 959 bp, Homo sapiens; identical to SEQ ID NO: 7499

SEQ ID NO: 7502 - DNA, 959 bp, Homo sapiens
agtctgggatactagctcatgccttgacgccacctccttctctgctcttcctttggtattctctctgttcagagttgcttgggtctttctgatggaaatgtgtatatatgaaaagtttgtaaaataacaaaacaaataacccacctgcaggaaggacaagtgagctgaaggttgtgtggagctgcaggatctgatagccctaaagaaccaggaccaatgtgtctcttgccacttgggagggatgttgacttgaacttctttgcagaggggcttaacagggcaaggctgaggagatgaaaactgtgactccatccccacgtggctgtggaaaggtaaccagttcctcagagaaaacctggcttcacagcattagaaagggggtggttgagactacctagggacctacggtgacacctgtcttggtttgtagcactgtagctcagacagctcagaccgctcatagagggcatggcaatgggagagtttgtgaggctggctgcctgggcttggtcttggagaacacatggcctgtttagtgttgctgcagattcttagagccagtgtgaatgtggtatgtagtataaatatgtcatctatgtttttttcagttatttttaattggaaataaagtgccattgcaaataggatgctccaatcctgggacactgagtggaggatgaggagggagagatgaactgtgggccggcctgggagagggggtcttagtggaaccttccttctggcctccagccggggacttacaaaactgaacaatgtattggcagaactggacccacaatgggagattctggggagcaggagttcacttgtatctgagcaggaagcagtgtgccctgaagaatacctctctgagcaaattccagacctcacacatatgcaagggctctgccttgcagcctcagcaagcgtctcctggtgctagctccttcctgacttgc

SEQ ID NO: 7503 - DNA, 13789 bp, Homo sapiens
tcaagaggaccatgaaaagtactttattgaggtcactgggagtacaagatatctgtccccagccctagcctcagcctctcctcagtacagtctcatgggtggaaaagaccaggcttccggactgctctgggctactacccaggagaggctgggcagtggggaaggggggctggggctccagtccaggacagaggttcggggcaacaggggtgatgaaggctgaggcaggggctgagggaggccaaccccccagggccgaggagggggtggcgtggctaccagccagatgctttttaacaagtcaaacgctgttgggggaccccaggctgttccagatggcgaagacagtgagggaaagtatggtggccagggacctcttggcggtgccagactccccctgtgcgcagtgggcatgctggaggtgtagggcatggggaaggtgaactcctttgtcccttgttgcttcctttgcctctcctgctctgggacttgatcagggctattaatccagaagggtgtcatctttctctcagagaccccaggcttggcccctggcacagaggaaagaagcatagaggctagctgagctagagccgacaaaggaaaggggagtacaggggcaggagggacgctcacctggcaagggtggctggcagccccgaagcaccagggcaaggtcaggcacacaaccatgacaggcctgcaaggtgtgcacgatggcatccctggcatcctgaatcaggttcctccgggggaaggcctgtggcaaactcagctgacactgcagctctgccagcagctgccccacgccagacaactctggggaactgggtgggcctgggcccgaacctccaggcacctggttctctttgtccctggaccgtggggctggttcctgggccctgcctgggcttggggagggcttggcggggagtgtggggctgcctggcaccagggtcccactgctaagcagccttgcaacatctagggatttcacctcgtggttgaagagaccccggtgctcccggctcagccggccctgggttatgaccacgagcttggaggcagtagggaccacaggtggatcccgaatggccacaggaggatcgtggtgggctaatggccggcggctgcccaccagggccttgttacgttcccgcctagtcttccgacgacggacacgaccaggtttctcaggctgctgaaaaggctgggagactggtccctgggtatccatggtgtcctggaatataaagatagggtggccatcagcatgcagataagtcaaggggagtagcaaagtgaatagggagggctgggcgcggtggcttatgcctgtaataccaacactggggtaggccaaggcaggccgatcacttaggccaggtcactttagaccagcctagccaacatggcaaaatgctgtctttactgaaaatacaaaaattggccagccgcagtggcccatacctataatcctagtactttgggaggccaaggcaggcagattacctgaggtcaggagttcgagaccagcctggccaacatagtgaaaccccatctctactaaaaatacaaaaattagccagacgtggtggcatgcacctgtaattccagctactcaagaggctgaggcaggagaatcacttgaacccaggaggtggaggttgcggtgagctgagatcatgccattgcactccagcctgggcaacagagcaagactccatctcaaaaaaaaaaaaaattagctgggcatggtggtgcacgcctgtaatcccagctactcaggaggctgaggcaggagaattgcttgaacccagaaggcagaagttgcagtgagtcacgattgtgccactgcacttcagtctgggcaatagagtgagactccatctcaaaaacaaaacaaaacaaaacaagtgaatagggagatgttttggggtgtggtgggaatactatttagaatgaccagatgaggccaggcatggtggctcaaatctgtaatcctagcactttgggaggctgaggcgggagtatcgcttgaggctaggaattcaagaccaacctgagcagcaaagtgagaccctcatctctacaaaaaataaaaataaaaattagctggatgatgccaggtgtggtgactcatgcctgtaatcccagcactttgggaggccaaggcgagcagatcacttgaggccaggagttcgagaccagcctggccaacatgccgaaatcctgtctctactaaaaatacaaaaattagctgtatgtgatggtgcgcgcctgtaatcccagctactctggaggctgaggcaggagaatcgcttgaacccaggagacggaggttgcagtaagccgagattgcgccactgcgcttcaacctgagtgacagagtgagactctatctcaaaaaaaaaaaaaaaaaaaaaaaaaagctggattcggtggcccacacctgtagtcccagctgctagggaagctgaggtaggaggatcacttgagcccaggagttggaggttactctgagctatgattgcatcactgtgccccagcctgggcaagagagtgagaccttgtctcttaaaagagagagagaagatgagagaaaataagtgagcagagagagattggaaaaggtttggtcagataaggaatcacaggggtaagatgaagtcgaaggagtcacagctaatgggaagataagccaggaaacagagagaggctattaggaacagggacatggggaaacagttaaaagatggagggtgagccgggcgcggtgactcacacctgtaatcccagcactttgggaggccgaggcgggcggatcaccaggtcaggagatggagaccatcctggctaacacggtgaaaccccatctctactaaaaataccaaaaattagccgggcgcggtggcgggcgcctgtagtcccagctactcgggaggctgaggcaggagaatggcgtgaacccaggaggcggagcttgcagtgggccgagatcgcgccactgcactccagcctggatgaccgagcgagactccatctcaaaaaaaaaaaaaaaaaaaaaaaaaaaagatggagggtgggggccaggcgcagtggctcacgcctgtagtcccagcactttgggaggccgaggtgggtagatcatttgaggtcaggagttcgagaccagcctgggcaacatgtgaaacctcgcctctactaaaaatacaaaaattagccggcgtggtggtgaatgactgtaatctcacctactcaaagaggctgaggcaggagaatcgcttgaaatcgggaggcggaggttgcagtgagccgagatcgcgccactgcactccagcctgggggacacaacgagactctgtctcaacaacaacaacaacaacaacaacaacaaaagatggagggtggtgaaggggtcatgagattggagggatttgggggaccagaaagtgattctggacggagaaatccaggggtagacgaggtacaggggaatgcagaaagtggaaagagatagtagagaaagagaagcaggagagggagagcagcaagagaagtctggaaagcctgagaaaacctcaagagaacaggaagggagacagaggcgcgatcagggacagggcctgatcacaaaggaagggcctagggtaggagaggaagcatggtggccagccgcggtagggcagggtgggcagagtgaagggagtggggtacggttggcaggagcagggtgtgggaagggcacctctctcgccccaacgaaccccggcccttcccacttcacgtagctgtggggcgcaatggcttcttttccgcggtgaccccagctctcgaagtcacctggcgctgttccgggcctcgggctcccccacacgcatgcgcgtgccctttccatgccctttggcttcgtggctctgagaggacggaaacctagcggcgcgtgccagggaagcgccggttatagcccctcccctcccagcctcaatttcagaaatctccctttcttggtctcagcacctcccagccctcaattggctgtgaggttcactaggtccgcccccttcctgaatgctgattggttcagatagctatcagcggtctttcgagggctagttgagaccaggcgtgccaaagggaagaagggtcatggtagcccccatgcacagctgtcccccaagcagccacagacataatccctagaaaacttatacagttggccgggcgtggtggctcacgtctgtaatcccagcactttgggaggcagaggcaggaggctggcttgagcccaagagttcaagaccaccctggacaacatagggagaccctgactacaaaaaataaattagctttgggcgtggtggctcacgcctgtaatcccagcactttgggaggccgaggtgggcggatcacgaggtcaggagatcaagaccatcctggctaacacggtgaaaccccgtctctactaaaaatacaaaaaattagccgggcgtggtggcgggcgcctgtagtcctaactactcgggaggctgaggcaggagaatggcgtgaacccgggaggcggagcttgcagtgagccgagatgcatttcagcctgggcgacagagcgagactccgtctctaaataaataaataagctgggcgcagtggctcttgcctgtgggcccagctacttgggaggctgatgcaggaggatcacttaagcctaggaggtggaggcagcagtgagccatgatcacgcccgcctgagggagacggcaagaccctgtaaaagaacaaaaattaggccacatgcattggctcacgactgtatattcagcgactcagcaggctggggcaggagaattgcttgaacctgggaagtggaggatgcagtgagccgagatcacaccactgcattccagcctgggtgacagagaaagactccatctcaaaaaaaagttagtgtagtgttgtgattcatagctaggcttggtttaaatgcccaaaatggcacaactgggctgtgtgaccttggaaatgtttgtaactggtcagacttagttttctgacctgtaaaattgggttggtaataaaactaccttcctcatttggttgctagaaggataaactagaccaatatgtctaacttgaaatgggcctggtgaatgaagaatgcctggaagctttgtttctcactaagctttgcttcaggaactgctccaacttatcctctaagactttatttttaaaaatttttttctcggttgggtatggtggctcacgcctgtaatcccagcactttgggaggccaaggcaggtagatcacgaggtcaggagatcgagaccatcctggctaacacagtgaaacctcttctctattaaaaatacaaaaaattagccgggcgtggtggcacacgcctgtagtcccagctactcaggaggctgaggcaggagaatcgcttgaacctgggaggcagaggttgcagtgagccgagatcgcgccattgcagtccagcctaggcgacagagcgagactctatcaaaaaaaaaaaaaattctctcttatatcactgacttgaaggcataattaagacttttttcttttcttttcttttctttccttttctttttgagatggaatttaaatctgtcactgaggctggagtgcagtggcacagtctgaactcactgcaacctccacctcccgggttcaagcgattctcctgcctcagcctcccaggtagctgggactacaggcgcagaccaccttgcccagctaatctttgtattttttaatagagatggggttttgctatgttggtcagactggtcttgaactcctgacgccaagtgatctgcccacctcagcctcccaaagtgctgggattataggagtgagccaccgtgcctagctgattatgacttcttttttggagacagggactcactctgtcacccaacctggagtgcagtgacaccatcatgggccactgccacctcatctcccaggctcaagctatcctcctgcctcagcctcccaactaactgggactacaggcacttgccctttttttttttttttttttttttgagacggcgtctcgctctgtctcccaggctgaagtgcactggtgccatctcggctcactgcaagctctgcctcccaggttcacgctattctcctgcctcagcctcccaagtagctgggacaacaggcgcctgccaccacgccccgctaattttttgtatttttagtagagacggggtttcaccgtgttagccaggatggtctcgatcctgacctcgtgatctgcccacctcggcctcccaaagtgctgggattacaggcgtgagccaccgcgcccagcctttttttttttttttttttagacagggtctcactgtgttacccaggctggtctcaaacttctgggttcaagcgatcctcgcacctcagcctccccagtagctgggactacaggcatgcatcactgcacctggctccctcagactttatttgtttgtttatttttgtaattaagacagagtctcgctgtgtcacccaagctgggccactgttgcccaggctgggctgcagtggcgcgatctcagctcactgcaacctctgcctcccagactcaagcaattgtcctgcctcagccttcccaagtagctgggactacgggcgtgtgctgccatgcctagctaattttttttttttttttgtatatttagtagacacgtggtttcgccatgttggccaggctggttgacctcaagtgatccgaccatgtcagcctcccaaagtgctgggattacaggcatgagcctccatgctggcctccctcagactttaaaatcaagctattccacgatattccccaaacctaataagaaagtgattacctgtgtcttttctttctgcttgcccattcttcattatctttcagacccagctgagatactactcctaggaaacccatagtcctcagagtccttctcctcttcctccccagaggtccctgtctctccctcaaacacaactttgacacccctacacctctgtgtctggatctgtctccctaaacacattgggacaaggtcaggagctgacccactcatttactactcattcagcaagcacttgtggaataaccactgtgtgcccggcccagttccaggaaagtggattgaaaacataaacacaatgaataacactcatctctgtctcagtatcaatccacctcgaaggaatgaatacatgggaaggtcccacctggagtgaggctacaagaacatgaccaggacgtttagcagggagtgagccccccacctggtcccagagaagagggagatctgagaagacactgaggtctgagattaatttggggcagcgttgggggagaggcgcgaccctaggtggccttggctatggatgtaggtttcagagctcagacatacccagttggcctgtgggtttagagagagtgtagaggctgcagatctgcaagatgatctgccggagggacgccagactggacctgagccctggaggcgtctctaatttcctttctctttctgcaccttcttctaccctccaagcaggtcctatggtgtcttgaatgcaaagatatgtagtttatatgttatgccacgcgcgcgcacacacacacggtgttttgagtaggggtcctgtgatgtcttgaatgcaaagatatgtactttagatttcaacacacacacacacacacacacacacacacacacacacacacccacggtgttttgagtaggggaagcccacgagtagataggctcactaaagccctggcgcggccttagagtggctccttagaagggagcctcgaattttcacattttgtcatcttccttttctgtcccccacatcagtagaaaataggagcgtcccccccagccaggtgcattcgagccaccccttcaagggaatataagaatggactcgtccactcgctcccctccccccaccacgtgaatgggtcacccccccccccgcaacagtaggtggtcccttccgcacatttcactctgtacagcaaatggtttcttcccatttgctagacagagggctagattttccccgcccactctcgactcttcaggtagttcgcccctccccgtgaccggtgggtggtttctccctcctccccgcctcgggagctggatggtctcgcctctccctccccccaccccgtgccgggtgcgcggcctgggagtcagcggcccgagcgggaagcgccgggcgagcccactgtgcggccgtcgtgggggaagcgaaggttcctgattccacctacctcctaagtgaaggcttccgtccctggagaggaggcggcgccctgtatcggccttcgtcctccgcgggtgtgctagcgttgggacggtcctttgttgccgcgaggggtaggagtgggcgtggcggagccagctccgttcggaacactcccgggccgacccgactcgctcatcctgcaggagctgcggcgccaagatgagtggagaggagaacccagccagcaagcccacgccggtgcaggacgtacagggcgacgggcgctggatgtccctggtgagcgttcccacctgggatattgaggagtccgggggcgcggggggtggctcaggagaacggctggttcgtgccactctcactacctgattgggaaactgagggcagttgaggaggcgctgcctaagggagcagggcggggcgggccctggagcgtgcatgccattgactccctctcgcgcgctcccgcagcaccatcggttcgtggctgacagcaaagataaggaacccgaagtcgtcttcatcggggactccttggtccagctcatgcaccagtgcgaggtgagggcagtccctctccccctgccccatccagccctgtgtccatgctgacacatctggaccagaacccaggccaggtgaggtattatgagagtacccagattggcctcaggcagcccgaggctctgagaatcttggtgtaaggtgcaacattctattgagaaagaaatgtatgccttggttttatcagattggatttgtgtataatgtactaagacctaaaatgaggctttcctgccataggcttgcctaaagtgaggctctttcttgtttgctttaagtagtgcgcagccctgttgggtttacacaaagctatagtcactttacaggaagcgaagggcaactctaatggcactccacaaagaggactcaatcataataatatctttccacaaagcatgtccaactgtaatgggtttcatcaaaataagtttcaactgtaatgccattgattcaatgcatggctcaagcagactggattttcatgaagtgagtcttgcttctatggggcttggtttgttttgttggttggttggttggttggttggtttttgagacagggtcttgctctgtcacccaggctggcgtgcagtggtatgatctctgttcactgcaacctctgcctcctgggctcaagtgatcctcccaccttagtctccgagtagctgggactacaggtgcacatcaccatgcacctggctaatttttgtaatttttgtagagatggggttttgccctgttgcgcaggttggtcttgaactcctgggctcaagcagtccgcccacctcagcatgagcaacagagcctggggcttggtttaaagtgagagactctaggcagggtgtggtggcttacgcctgtaatcccagcactttgggaggccaaggcaggcggatgacctgaggccaggagttcgagaccaccctggccaacatggcgaaatcctgtctctactaaaaatacaaaaattagctgggcatggtggcacatgcctatagtcccagctacttggcaggctgaggcaggagaatcgccagaacctgggaagcagagattgcaatgagccgagatcgcactactgcactccagcctgggcaacaagagcaaaactccgtctcaaaaaataaataggctgggcaccatgggctcacgcctgtaatcccaccactttgggaggccgaggcaggtggatcacctgaggtcaggagttcgagaccagtctggcccacatggtgaaaccccatctctactaaaaatacaaaaaattagctggacgtggtggcgtacacctgtagtcccagctactcaggaggctgagacatgagaatcacttgaactagggaggcggaggttgcagtgagccgagatagtgccagtgcactccagcctgggtgacagagtgagactctgtctcaaaaataaaataactctgtctcaaaaatataaaataaaataaaataagtgagagactctaatagatttctataaagtgaggttcagccatgctggagtttgctccaggtaaaattttaagactgcttccatgaagtaaggttcttccataatggcatttggttaacacctggacagagggggatggtccatgcggacagtgcccttgtgcccctaccacttcttgcccacaccacttcttgcccacagatctggcgcgagctcttctctcctctgcatgcacttaactttggcattggtggtgacggcacacagcatgtactgtggcggctggagaatggggagctggaacacatccggcccaaggtgagcggggcttgggtggggctctaaaacatcttttggctgccccctcaccgctgcttcatgtctctttttccacagattgtggtggtctgggtgggcaccaacaaccacggacacacagcagagcaggtgactggtggcatcaaggccattgtgcaactggtgaatgagcgacagccccaggcccgggttgtggtgctggtgagaggctgggagagtgggaaaggaagaatggcagtggtctgggaccccctcagatatagccacagttggcacagttctaggcagcttgacatagagcagtggcttttaggcagaatctcacgttggagcttgctatacccttcagagtggctgtggttgagaatatgctccgagaccaattagccttttttgcccagggatggcttaagactttgggggtattgaaaaactaaaaaacgggccaggcacggtggctcacgcctgtaatcccagcactttgggagaccgaggcaggtggatcacgaggtcaggagatcaagaccatcctggctaacacggtgaaaccccatttctactaaaaatacaaaaaaaaattagccgggcgtggtggcgggcacctgtagtcccagctaacttggcaggctgaggcaggagaatggcatgaacctgggaggcggagcttgcagtaagctgatactgtgccactgcactccagcctgggcgacagagcgagactccgtctcaaaaaaaaaaaaattagttgggcatgggctgggcgcagtggctcatgcctgtaatcccagcactttgggaggccgaggcaagcagatcacctgaggtcgggagttcaagaccagcctgaccacacgtggagaaactccatctctactaaaaatacaaaattagctgggcgtggtggcacatgcctataatcccagctacttgggaggctaaggcaggagaatcgcttgaacccaggaggtggaggttggggtgagccaagattgcaccattgcactccagcctgggcaacaggagcgaaactctgtctcaaaaaaaaaaaaaagccgggtgcggtggctcacgcctgtaaacttgtaatcccagcactttgggaggctgaagagggtggatcacaaagtcaggagatcgagaccatcctggctaacaaggtgaaaccccgtttctactaaaaatacaaaaaattagccgggcgtggtggcaggcgtctgtagtcccagctacttgggaggctgaggcaggagaatggcatgaacccggggggcggagcttgcagtgagccgagattgtgccactgcactccagcctgggcaacagagcaagactccatctcaaaaaaaaaaagaattagctgggtatgatggtgcgcaaaacctgtaaccccagctacttgggaggctaaaggagaaggatcacttgagcccaggaattcaaggtaacagtgagctgtgatcatgctactgcactctcgcccgggtgacagagaccctgtctcaccagaaaacaaaagaaaaaccctcaaaaaaccttgaataggccaaaagttgtcaggcattcctggggtaaatctaggctccatcacttgtaggtagctaggatatttcctcttctgaaaacggattgatcccttggcatgagccatgatgttgatatcttttatttatttatttattttgggacagagtcttgctctgttgccaggccagagtgcagtgacgcaatctggcctcactgcaacctcctcctcctgggttcaagtgattctcctgcctcagccttcacagtagctgagactgcaggcgcgtgccaccacacctggctaatttttgtatttttagtagagatggcatttcaccatgttggccgggctggcctcaaactcctgacctcaagtgatccacccgtctcagcctcccaaagtgctgggattacaggcgtgagcaacctcccttggcctatttattttttgagacaggatctggctctgttgcccaggctggagtgcggtggcatgatctcagctcactgcaacttctgcttccagggctcaagtgattctcccacgtcagcctcccgagtagctgggactacaggcacacgccatcatgtcccactaatttttgtgtatttttgttagagatggggtttcaccatgttgcccaggttggtctcgaactcctgggctcaagcgacctatccagctctgcctcccatcatgctgggattacaggcgtgagccactgaacctagccaatgtcaacatttttctaagtgatacttggaaagaggctaggccgcgcatggtggctcacgcctgtaatcccagcactttgggaggccgaggcgggcggatcatgaagtcaggagatcgagaccatcctggctaacacggtgaaaccccgtctctaataaaaatacaaaaaattagccgggcatgatggtgggtgcccgtagtcccagctacttgggaggctgaggcaggagaatggcgtgaacctgggaggcggagcttgcagtgagtcgagatcgcgccactgcactccagtctgggcgacagagcaagactctgtctcaaaaaaaaaaaaaaaagaaaacgaaagagggtaaaacccagaagtctcttgctaaatgagggctaggatgtgatatttaggaactaccctcccaccctccccacttgcccatccctagtgttttctgcagctggaaacttcatggtggtgggtggaggacaggttggcacagagaacaagatactcaaatgcttgtttccttactacgcctcgtgttcctgctcagggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcagtg

SEQ ID NO: 7504 - DNA, 3500 bp, Homo sapiens
cacacaggtgtgttaaacagctttaatctcgctcattgcggcttctcggcacagtaagaaatattgcacatgatcaacatgttttgttctggggaagggggcaagggcagggggaatcaccttcttagaaagtacaacccaagttgggagggcagagggggtgaggagaaaaccctccccgtgcctgtggcaaagtgcaggagcccccacccccaaactaacctgagtccagcccctctggggaaaaaaggggtgcatgaactccccctattccacaggcgcctccctgtggcccaaggcctgcaccaccctccagcttgcagccctcacaggagccattttgcataaagtgaaaagctctgaaggtcacacgctccaggttatgtacaggggcttggaggagggagactgcccctgcagcccctcagctgccccccagcaccgggagggagcttcgagggaagggggtatttacaagaggagcaggcctcattccgccccaaactggagaggacgaaatggctttacccgggaggagataaccttcctgcccccacatactgtccatgtcctgagggggtactataagtcctggcatcttctcaggggtccctcacctgcctgtggcagctgtggagggacctgggggtgggggggagggctggggagccccctcccagccaggctgtccaggccccgactctgggggtggaggcagtggcggggcagcctgggccgtgccagagtccgagctgggtgaggtggggtcagggccccctgcggggctgggagtgggggcaggggcagcagcggtgccagtggggggcggtacagggagaggagcctcagctccagggggctgctccgtgggagtggcagcctgcatgatcttctggcgcacctcacggatcttcaactgcagacaaaccttggagggaaagatgtctgcatagcgggcctggaaggcggctgtggcctgggctggagatagaaaaacggtggggagcacaggatgagatgtacagataagtcccacccgagtgaccccaagactccgagacaggctcacctgacgggaagaagccatggtcctgaaagagctgcatgaccagggcccggcgctggtccagggtgcgccgcagggaggagtatggcaccttgtcatactctagctccccaagcacgtcctcggcttctgtacctgtgcagggcacaggcagcatggcaaggctgcagcagcggcagggccttcctgccaccgtctgagtgcccacccaagccctcactgcattctatttcacaggggagtcagagaggggtcctgcccacagtcacagggcaacctaggggcctgccagactccagaacccaccactgacaggctgtgcttcctcccagcctggatggacccaccctacctctctcactctctaaccgccttccagagacccactcctcttgcaggtccccaggcccccaaagttctgcccaccacggcacctgtacggtcaaaggtgaagatgtccccctcgcacttggcactcttgggggtgttgggctccgagctgcagctggagcgtcttctcatcttgcgcttgggcgaggtggggtcctcgggtgctgaatccaggtctggccaaacagaagcagactcagtgcaggtggccccagtctgccctccacctaaggaccctgggtgcccaatgctcgcctacccgtggagttcttcctcttcttgcggtaagagcccaggatggcccggggtgaggtggccagagactgcagggtgggggagggcagcacctcctcaggccgaaactcaggcaactcagcaaagcgctcttcgaagtccacttctgacaggaccctgctggagggccggcagggtcacctcccccgcctcagcctgcagctgctcccactcccgccaccctaacacgctccaccaaggccccagcccatgctcacttgtccacagagtcaaaggtcttcttcaggggcgggggccgcaccttcaccttcttgccagtaccagccgcctccttgcgctccggggtgtccccggctgcccgcccactgctgctctcgctgctgccaccaggggctacagctggagctggggccgggctgggaggagtgggaggctccccacgattctccaggccctgcccagggacgcgccagtctgaagatgagctggggaatttgctggcctggggtggagatgggcagggagatggcgaacactgagctcagactctggggcaaaggccagaaacaaagagttggatctgagcccgcccagcagaccccttgagaaggctgtcacacggcctcaggaaggccaagacaggggcctcagatgggagaggagacaacacaggcaggcagaagggacagaggggaccctttaacctgagagacacacaggcatggaaagaagagtaggacagaaaagcaaagacgtcaatggagaggcacagccaagtggcagtgggagccccacggcctgcaggcgctcaccatggtctcagggcccttggcgctggtccgctcctcagcaggtgggggcagtggggggctgctccgggccgtgggagtccaggtctctggcaggggtggaggggctggtggtgtgggctgcccctcaagctcagactctggggcagttggctctcggactgggccaggctccagaggctgccggggtgcagggccaggccgcccagaggcacctgcctcaaaggaccccacgggaatgctggcgatggctgccttcactttctggggggccttcgggctgggccgctgggccttgggggccactaagctgtaggtcatggaacctgctagtggggagaaaattgtttgctgagccaggcctgactggagcccatcccctgggtcccccaactcactctgctctgggttgatctgacacctacctgtggcgctggggaaagggctagtcggggctggggtggcagtggcaggggctggcgggcccttgggcagaatggtggctgcaggtggggttgtgctggtggccacagtgtagaccaggcttgggggggcctgggatggctgggccaggggtgctgaggaggtgggtgcagggctgccagagtaaaatgctgttatgacaggacctccgggggctgcacaggcaggcggcagctggggactgggcacaggtgacacgcccacctgaccgggagccagcagtggggcttggcctgctgaaagacagagaagaagaagcaggagaccaagttagggcccggactgcctcagccccaccctgggtccccagcactgcctgccaggccgcccctcacctgagagcaggggctgcacgaaggcggggccgctgggccccagcgaggtgaagcctagagctacagagctcgtgggcccgtacgaggtgactgttccagcctggctggacgcagggctggtacccaggggcagcgcgtgcccgcccgctgactgcacatagg

SEQ ID NO: 7505 - DNA, 1477 bp, Homo sapiens
atcttctaaaccagcctctacatcagaaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggcttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaa

SEQ ID NO: 7506 - DNA, 1188 bp, Homo sapiens
  misc_feature (919)..(919): n equals a,t,g, or c
gttaggcccaggggtaatttgtttggagagatggcccagctggcagtaggaggaccagagaaagataccatctgtgaactgtgtggggagtcacatccatacccggtgacctatcacatgagacaagctcacccaggtaaatgatactgttgaatgtacgtataagtgcttttttctttaatgaaccagatcactttatttgagctgttctatgaattttgtcaaaggatagggaatttatagtatcttagaatgtcatttttaaagtacattatcagtacagggttttgtgaaaaacagataaattctaatattatgatggccaggtcatttagtgctatttcactttcatgtagcatattttaaaaaatattatgtgttacccaaagggtgtgccattaatgtgtctgtctcacacagcagaaacagtggcatgcccatacacacagggcatctcctttgattttactattttcctgttcagaattgcaaattaaattagattagattgatttctataggctttttcctacggaagtgatattgttttatcagaagactgcattttcagtaaatgtaatgatttctgtaacattgactaatattccaaattcacctaatacaaatttggttaatttttttctttgtctacatattatacctcaaatgtcttatgaatatgtgatttctgaaaatatatcattgttatagaacttttatacttgtattgtctaattttattgacataattaagtatatctaaatatacctatattctatctctcttttaatatgcctgattagaaactaagtatctctcatatttggggcatcatttaattgatgcttttttgatcaagtaagctatttttctgatatagttaatagcctgaaaaataagatatctacttcagtattntgctttctttgagaaggtaaatctgtcattaatgtatgagtaataaggatcaaactattaaggacacttggagtgttaaatatttatttttggtattgtttcaaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagg

SEQ ID NO: 7507 - DNA, 1668 bp, Homo sapiens
gtttaagaaaatgtttggatggggcgattttcattccaacatcaaaacagtgaagctgaacctgttgataactgggaaaattgtagatcatggcaatgggacatttagtgtttatttcaggcataattcaactggtcaagggaatgtatctgtcagcttggtaccccctacaaaaatcgtggaatttgacttggcacaacaaaccgtgattgatgccaaagattccaagtcttttaattgtcgcattgaatatgaaaaggttgacaaggctaccaagaacacactctgcaactatgacccttcaaaaacctgttaccaggagcaaacccaaagtcatgtatcctggctctgctccaagccctttaaggtgatctgtatttacatttccttttatagtacagattataaactggtacagaaagtgtgccctgactacaactaccacagtgacacaccttactttccctcgggatgaaggtgaacatgggggtgagactgaagcctgaggaattaaaggtcatatgacagggctgttacctcaaagaagaaggtcacatctgttgcctggaatgtgtctacactgctgctcttgtcaactggctgcaaaatacactagtggaaaacactctgatgtaatttctgcccagtcagcttcatccctcagtataattgtaaatcatcacagattttgaattcacacctgaagacatgctctcacatatagaggtacacaaacacaccgtcatgcacatttcagcttgcgtctatcatgattcctgttgagagggctttcattgtctgactcataatggttcaggatcaactatcatcaaacggaaggattaactagacagagaatgtttctaacagttgctgttatggaaatctcttttaaagtcttgagtacatgctaatcaataatctccactcatgcattcctactgcttggagtagctgtactggtaaatactactgtaggagtatctgcttgttaaaatggaaaaatgtgtctttagagctcagtattctttattttacaaacacaacaaaatgtagtaacttttttccagcatacagtaggcacattcaaagtggtccaagatggctcttttttctttgaaaggggcctgttctcagtaaagatgagcaaacatttggaatttacatgtgggcagacattgggataacaactttcatcaccaatcattggacttttgtgaagttgacaccagctaaggctgcttaaaataagttctgatcattatataagaagggaaatgcctggcagacaccatgtaagttataagtgtctgtcttatctttactacacatattgtaacaaattcaatatcctagtcttcatttgtatgaatggtttgtattgtacatagtttaaccaagtgttatttgagctgcttattaatattaacttgtacttgtctctctgcttgttattggttaagaaaaaaggatatgaggaattcattttatcaatgtagctgtgaaggccattaaaaagacaaacttaatgtacagagcatttattcagatcaagtattgttgaaagctatacatatacaacattacagtctgtctgtatttagatattttatttctggaaaaaatgaaatgtacataaaaataaaacacttaaagttgagtttcaat

SEQ ID NO: 7508 - DNA, 13422 bp, Homo sapiens
cagtgtgatgcggtgagtgtcctggagaaggagcacgattacagggatgagcatttggactttatccagtcacacctgcggaggttctgccttcagtgtatcctttgggcgctgtgtggggcctgggtcacaggctttcttccaaatggggcatcttcaaagagataaagcacctcccaaacccagaatagtgttctgccaaagagaatttgtatatatctttttactaggtttatgttttactgtatcggagttttaggtttattaacttgtgtctacctttgatcactcatttatttgtttgtttgtttgtttgttttaagatggtgtttcaccactttggccaggctagtctcaaattcctgacctcaagtgatcacctacctcagcctccgaaagtgctgggattatagctgttagctactgcgctcggcgtattttttaattttttttctgagacagagtctgctctgtcacccaggctggagtacagtggtgcagtcttagctcttgtgctcctgggttcaagcaatcctcctccctcagcctcctgagtacctgggacaacaggtgtgcgccaccacttccagatttttgtttgtttgttttgagacagagcttcactcttgtcgtccaggctggagtacagtggcatgatctcggctcactgcaacctccacctcctatgttcaagcgaccctcctgcctcagcctcccaagtagctgggattacaggcatgagccaccacacccggctagtttttgtatttttagtagagaacagggtttcaccatgttggccaggctagtctcgaactcctgacctcatgtgatccacccacctcggccccctcaaagttctgggattacaggcgcgagccaccatgcctggccatctggataatttttgtatttttagtagagacggtttcagcatgttggccaggctattctcgaattcctgacctcaagtaatctgccctccttggcctcccaaagtggtgggattacaggcgtgagccactgtgtctgcccacttttaattaatgctatacatttgataagctttcctattaagaatttaatgtgatcattttatcatcaaattacttttatcatactgtcttagaaatatttttaaactttgcttttatgtagaaaaggtcaattaccaaacagggtattgttttataggctactggtgtttcccatatgtttatgttttgtgctgtccatgatagagaggtggtgtctgtagtcttttgagtcctgttaactataaaaagccaatagcagttggtgccgtggttccacaccctggggtggaggtgagagatgagttcctgccatcttttttgggatggcccattagcctgttggcacccatccctcaaaagatgggtttaatgataaatttggtcgcatgtaggcatctgtctgggaaggaatctgtgtaccttgatactctgagagtgttttcctgggctaacctcagagccaatactttacttctcaggaagtaatctgtgggatcaagacaacaatttacacgttaaaaaataaactctacagcccactagcatcaacatagctttatgcttttgacttcattcatctgctactatgacctttttacttttttatttatttatttatttttaccagtgtgcagtatgcctatgtaatactataagcgttttagtttttaaaattgtaatgctttctgttgctcatatattgatcaaaaactgatcaacctatgagtagtactttgaggttgtatgtgttcgattttgtctcctcctgcagtgaattgatttttcttgagcagattgattagatggagctgccttgatttacacatcagtgaaagaagagaaaaacctcgacttgttgtataagtatattgttcataaaacatacggtttccacttcaccacacctgccttagttgtggaaaaggatgccgtttttatgtgagttattttgagctgatgctttgaaactcttctttttaaagtacatttgctttttacattttaccccttcaaggaaggtgccttctgtctgtgtcttctacagccagctctctcactgcaccttctctctgttcctttccggattatgaggcatctgcctgagggaagtgggtggtgtggtcaggggtgctgcctttcttcctcgagagcaagttgccaaaacctaagccagccatttttggcactcactgtcaactctggtaaaatactggctggggagggaatatagggaattgtgcttgggggatcctgaatgtcttctattaaagcgcctgctttatctgtgtgttggcagggatgactgcaaacatcctctcggcatctctgtcagcatgggctttcgctatattaagtgcttactgtgcttctggcatttcacattttgggagccaccgggattgattgtcctcgatagagacttggatacctgttttcctaagctggtgtctttctctcactggagaatcatagtgttgctggatgcataaatatgaagctgtggtctctgacaagacttgtgttagcagattgatgttcaggcttcagtatcctcctgacttaacaaacaattacattattcattcaggaaaccttattcagcacccactaggtgctcaggttctctgcaaaggacacagaaatgaatgatacgtgttccttgcatatggcactgtctagaggggacatacacagctgaagaagggaagggcagtgatggggttatggaggaagtatggcagggaaagcaggagggtgatgctggaagacaaatggtagatcccaggcggactggaaagaattgcaatagggggagccggggagtgcagtctgtgagaggctggaaatgtgaaagccaggagctctcagggatttgggttgcctcctgcacagtcaaggagagtgtcactcaggctagtcatagatggcatacctacaggcttgggctgattttagatagttgttcagagcagtcaggcaggcgccagaggcacaagccctgtgagaggtgtgtttggaatcacttggtatccaaatcacatgtcatccctaggagcaaggagaccggttggatttggggctggtctggaatgaagaagcatctctcagcttccgaaggctgcatggctcacggcagtatctcaatcatgccctgcccgtttgcacatttggtcctgttggtagttacctctctggtgactggcaaagtcagcaaggatattggggtggagcaccctggctaagcaccctcttgattatagagctatggagtagaagacagatggagaatgagaggcctgtgagaacaatcagtcagttgccatctttcagagctgctcgagttcaaaagtgtgtcatacagggtattttaccattgctacctttaagggattcaggtgggaaccctaggctgtggcttcacataatggaacttgggtgccatcctaccctgtgatgttgagctggccagcactggtgtaggaacctcaaggactctgtgcttctctggtttggggcctaggataaacacaggccctgcttgccccttggttctaggacacatcttcccatgccagcaaagttaatgaaccagtctacaagataactgttgaaagaattcttagagaaacaacccacaggaggggagccatgtcagagcccaagaaaaccatcccatcctgagctctgccttctgtgctgctctctgcatcctattctctgtcggaacaggaccccactgtgtccttgctcttctaggcagagttgtgggagagtgctaaatgcttttgagtggggcagcctgtggaatgggatctcatactggctccttagaccttgggcccatgaactcagtatggagcaggacctgcgatgttctgatggattatacccacagtgtattttggcacatctgccaaaagctacaaacaacccccaacaactacacactatatcttgtgagaagtgtcctacccaggagtcctgaatgtgatctgagtatgctctaaggcagccccaggaaaagcaattcagtccctctctctttgcctttagacctgcaggctgggacaatgaaaagaaaatagctattttacatgaaaattttacaaccgtgaagccggaagatgcatatgaagactttattgtgaaacctcccgtgagaaaggtagtcaaagacaattgctttaagggtttagggccgggcgcggtggctgatgcctgtaatcccagcactttgggaggccaaagcgggcagatcacatgaggtcaggagtttgagaccagcctggcgaacatggcaaaaccccatctccactaaaatacaaaaattagctgggtatggtggcaagcgcctgtaatcccagctacttgggaggctgaggcatgagaatcacttgaacctgggaggcagagattgcagtgaacccagattgcgccactgcactccaacctggcaacagagtgagactccatatcaaaaaaagaaaagaagaaaaagggtttaggtgttttttaatgcaaaaagaagcctataaagatggggcgtggtggctgattcctgtaatcccagcagttgggaggctgaggcaggagaattgcttgaacctgggaggcggaggttgtaatgagccgagatcgggccactgtactccagcctgggtgacaagagcgagactccatctcaaaaaaaaaaaaaaaaaaaaaactataaagaaacaggtcttacacattgtatagtttgtggggggtagtggggagtagtaagtcccagggcctttttgttgatctttaaatgaggtctggcgttatgtaaatggctcagggctggtgggaaggagtgatggaatgctcacctggagttggtggtgtttcccattaagtcctgccagtgctgccgttgcctctggattactgttactggatcccctcatgtgatgtcctgcagaccctgaggtgtttagaacctgccagacttaaaaatgccagttggctacatgctgcggctggttttgggagaggtctgtgccaggctagaaaaatattactctgcagtctcagtagggatctcccagacctgtgttgaagcctgagcctcggactctcctttcggcatgaagtttgacagtggttaggagtattcttggcctgtggccacaaacatgtatgttgtttcacagctggtccacgacaaagagttggcagcagaagatgagcaggtgttcctaatgaagcaacaggtaagaagaccagtgaggttagaacagaggccttctcatgcatgaaatgccagtccctagggtggggttgggggtgtctgcatgtgggaagtcacaaagagcttgcagtggtagaggggttgagaccaggtctcctcattccctccttatttctaggattagttggggatggaccacctccttaggagatcacctacctgccttgcagactctcctacaggaatagtaggattcgcatcttttaagtgctctttctttggaaatgtggttttctggcataatacttcctatgttgacagttaaccaagtaacctgaccacacttccattatttcatgtagcctcacacagccctgtacataaaggcaggtgatgcctgttttgcagatgaggagagtaacttccccaagctgacagtttagaatgcagacttcccatttctgtcacccagattattgttagatgtgtcctgggtccacctatcatctgcccagtggtacaggcaggtcagcaggaagttttgatggttctttttccaactgtttccttctttttccatctttttcctttctgtcctttgcttgcttccttagcttcaaaactggttacttggagtattttttttcaccatataccaaacggctcaattaaaattttttggcatctgtggtataaaacataggacttagttgttgttaatagtgccctctagtggagtacttggagtaagtttttctctagaccttcagtgctctctgcaggccttggttaatagccagtttgtccctctctttgcagtcactccttgccaagcaaccagccactcccacgagagcttctgtgagtaccttacactaaacagagggtcaaggcccagtgttgtgggtgtcatcaaactttataccattatttgtgagagcgtatatttgtgtgggttttgtattttcagtgggaatttggtttccctaaagacccatgaccagaaacataaaagaaactcaagaagtttctgatgaaagaatacaactctgggaattagagtgagctggctttgttatctggatgtctttctctcaggagaaagagagccagaaagggcttgaattgagagcatactcccagtcctgtaccatagcctgtgaaaaatatccctcagaagcatgtctccatttgtggcatatgtattttttgttattgttatgcctgtgtgtgaccttagctgcttttggacttaggaatctcctgcaagaggaccctctggctctccaaggacccagggtcggggagggccagccagtgtgcctagctcctccccaggcacgtcagtaaaaaagccggacccaaacatcaaaagtatgtattcctcaaaagtatgtctctttggagagtagtttagttttagacctgagccctgcaggggctgggtggctgagtctataaggtggagactcatggaagccaggctattctcttccccgataagggctactttccatttcccccattccagaggaagaaggtccatggtaggcagagaccagggcctgttcctttgttagaattggtagcccatgcacctggctctgtgtgagacctcacttaggccctgctcattccttcagagaggaatgcaaaatagtaactttatttttttagagacagggtctcactctgtcacccagcctgtggcacagtgatacgatcatagcacactgcagcctcaaactcctgggctcaagtgatcctcccatgtcaactctggagtagctgggactataggcgtgtgccaccatgcccagctaatttttaaaatttttattgtaggccagatgcagtggctcatgcctataatcctagtactctgggaggccaaggtgggaggatagcttgagctaaagagttcgagactagcccgggcaacatagtgagacctcgcctctacagaatattgaaaaattagctgggcatgatggtgcttgcctgtagtcccatctactcaagtggatgaagcggcaggattgcttgggcccagggcattgaggctgcagttgagctgtgattatgccaccatgctccagccagggtgacagagtgagagactgtttcaaaaaaaaaaaggcctggcgtggtgactcaagccagcactttgggaggctgaggcgggcagatcacttgagggcaggagtttgagaccagcctggccaacatggtgaaaccttctctgtacaaaaattagccaggcgtgatggtgggcacctgtaatcccagctactcgggaggcagaggcaggagaacggcttaatcctgggaggtggaggttgcagtgagccgagattgtgccattgcactccagcctgggtgacagagcaagactccatttcaaaaaaacacaaacaaaaatattttttatagaggtaggggtctcacttacgttgccgaggctgatctcaagctcctagcctcaagcagtcctacgcccttggtctccccaagtgatgggattacaggcgtgagccaccacccctggctgagggagtcactttaaaatgtgtattttgaatctgtaactttgtttctcattatgtttatatgatgactgtctatgaattgtggggatttttcccccttcacttctcttgtcaagctcaattacttttcagattaagtagcttttatcccagtaacttagtgatactcacagatactgcctgcagtaaaatcattaaaaaacagttttatttaatgcttgtttgatgggtgtcttctattcaggatgtgagcttttcacagcaggtttggaatgttaagtgctcatgcaactttgaaaaacactgtctcatggacggggaggtggtgtggagcacaggttatctattctgctcccaaacaagtgggaaatgtaaacatggttccacttagtaatcatgctaagtagcctcagcagtagcagtgtaaaggcatcgtagcgaatgaatgttatcaatatcctaggaagctgatagccacaagtggctaatgccaagctgagaactagggtgtttaattttaagtcttccagtttatatgatgcttttttttctctttaattttccttagataatgcagcaagtgaaggggtgttggccagcttcttcaacagtctgttgagtaaaaagacaggctctcctggaagtcctggtgctggtggggtgcagagcacagccaagaagtcaggtacagaagggccctggagacttgtgactcttgtggttgagtagtgctgcaaggatggagaggcagacacctgccctgcagaccctgcagtgtcctgaatagccaagcaaggaagcaggtcttcatttcctactgagcagtgtgccgtgctttcagtgggattgccttactaccatgcaggtttccttggcacattgagagtgggatttgtgtacatttgggttctcgggaactgggtgttgggtgagttgaggtatagcctaaattacatatgtggccctgttgtagaacctctccagtagaagtcatggtccatggagggtgtaccagtgactttttttttctttttccaaggtggagttttgctcttgttgcccaggctggagtgcaatgacgtgatctcactgcaacctccgcctcccaggttcaagcgattctcctgtctcagcctcccgagtagctgggattacaggcgcgtgccatcatgcccagctaattttttgtatttttagtagagatgtggtttcatcatgttggccaggctggtcttggaattcctgaccccaggtgatccctccatcttggcctcccaaagtgctgggattacaggtgtgagccaccgtctgcggctgactttttttttttttttgatagagatggagtcttgctctgtcgcccaggctggagtacagtggcatgatctcaactcactgccaacctccaccacccgggttcaagcaattctcttgcctcagcctcccgagtagctgggactacaggcacgcgccaccacatccggctaatttttttgtatttttagtagagacggtttttcgccatgttggccaggctgttctcgaactcctgacctcaggtgatccacctgccttggcctcccaaagtgctgggattagtgcacctggcctacttttaattttttaaaattatactaaagccttagttgttctgaaccagtgatgttttatttgttctatttttttttctgtgatgctttgtaaggatttttgtttactccactgcccccagtttggctgtgaaccctcactgtctcactgcagagtcaaggcctcctcctccctgaagctccctacttgtcacatacacacctctgtggcagccacccacctgtccttccatgtaagcaggtagggcgggtctatgtcttggagatctctgaaacaaaacaaaacatgttttccttgggaattacacattttcccaagaagctggaggacattttaaggggtttttgctttccattttccattggctataaggtatgtttatacattgttttccctaattgatgtcttcagggcagaggagaccctcaggaaatcacttggggcagcctgggcctccagtggctcctatgttctaagaaactcagagtctggtctagtggcccagactctgggctggtagtattcccttctgggaaataggtgtctatttctaggcctgttcgtgtctgacagcagaaaaatacaagtatagattttgtgcaggactgaactatcttattcttattgaaacataatgttttcaggctatccatttgagtcagtctagaatgttataaacaaaaacacctatctggggcaaagaaaatagtttccttcgttgctgaaattcaggtactacctctaggaagatggtggtgagagtgcacaggggtcagggttgggtggtgagagggttttcagaaaggttcttgtatttggcacaaaggcaccccccgccagagagcagtcaagtcactcccttggagttggaggaagcactggcctgtgacttttgggattaggatgtgccgagttggggtctcctcaccactgcagtagaaaagggctttcctcattcttattaaggttactgtcatcaagtgattatagaaggcgtataattttaaatgctcctttaaaaaaaattgtttcctcttctcacatcattactttgcttttttgctttttttttttttcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttacaa

SEQ ID NO: 7509 - DNA, 102 bp, Homo sapiens
tttctttttcttttctttcctttttttttttttttttgagacagtcttgctctgttgcccaggctggagtgcaatggtgcaatctcagctcactgtaacctc

SEQ ID NO: 7510 - DNA, 779 bp, Homo sapiens
gacacaaattctgttttctgttttgaagattagcaccacagacaggtgatcattaatgaaatatggcccttaaaatacacattacaaaagagaaactgatggtaaaattgctggtgaagttaacttttatcatttctccactaattaaaagttcagattctgggatcacatctctaagctgttcatatcaaagagctattttttaaagatcctgattataggcaacaaaagcaaaaataaacaaataggattacatcaaaactgaaaagcctctgcacagcaaaggaaacaacagaatgaagagccaacctacataatgggagaaaatatttgtaaattatacatctgataaggggttaataatcaaaatatataaggaactcaaagaatgcaatagtaagaaaacaacccaattaaaaaacaggcaattccagcctgggcaacatggtgaaaccctgtctctacaaaaaatagataaaattggccgggcacggtggctcacgcctgtaaccccagcactttggttggccgagtgggtggatcgcctgaggtcaggagatcgagaccagcctggccaacatggcaaaaccccacctgtactgaaaatacaaaaaattagcccgggtgcagtggtgggcgcctgtaatcccagctactcgggaggctaaggcaggagaattgcttgaacccgggaggcggaggttgccatgagccgagtttgcaccattgcactccagcctgggcaacaagagcaaaattctgtttcaaaaaaaaaaaaa

SEQ ID NO: 7511 - DNA, 801 bp, Homo sapiens
agattactaacatttttaatatgacacaaattctgttttctgttttgaagattagcaccacagacaggtgatcattaatgaaatatggcccttaaaatacacattacaaaagagaaactgatggtaaaattgctggtgaagttaacttttatcatttctccactaattaaaagttcagattctgggatcacatctctaagctgttcatatcaaagagctattttttaaagatcctgattataggcaacaaaagcaaaaataaacaaataggattacatcaaaactgaaaagcctctgcacagcaaaggaaacaacagaatgaagagccaacctacataatgggagaaaatatttgtaaattatacatctgataaggggttaataatcaaaatatataaggaactcaaagaatgcaatagtaagaaaacaacccaattaaaaaacaggcaattccagcctgggcaacatggtgaaaccctgtctctacaaaaaatagataaaattggccgggcacggtggctcacgcctgtaaccccagcactttggttggccgaggtgggtggatcgcctgaggtcaggagatcgagaccagcctggccaacatggcaaaaccccacctgtactgaaaatacaaaaaattagccgggtgcagtggtgggcgcctgtaatcccagctactcgggaggctaaggcaggagaattgcttgaacccgggaggcggaggttgccatgagccgagtttgcaccattgcactccagcctgggcaacaagagcaaaattctgtttcaaaaaaaaaaaaa

SEQ ID NO: 7512 - DNA, 235 bp, Homo sapiens
gttgcagtgagccgagatcacgctgctacattctagcctgggggacagagtgagatgctgtctcaaaaggcaaaggaccagatagacatttcttaaaagaagactggccaaaaggtatatgaaaaactgcttaacattaaggcttaacactaatgatcagggaaacacacttaaaaccacaatgagatatcatattacaccagttagaatggccgttaccaaaagataaatgata

SEQ ID NO: 7513 - DNA, 651 bp, Homo sapiens
aaaatataaaaaatcagccgggcacggtggcaggtgcctgtagtcccagctactcagtgggctgaggcaggagaatggtatgaacccgggaggcggagcttgcagtgagctgagatcacgccactgcactccagcctgggagacagagtgagactctgtctcaaaaaaaaaaaaaaaattattttaaatgtaaggatgcaagaatagtacaaaaaattcttgtatatccttcactaagtttcctgattattacattttttaccatatttgcctgattatattctctctctttataagcatgcacatatatgtattattttgctaaactagtcttgagtaaattgcaggcatgatatcccattattcttaaaaacttaagtctgcacttgccaaaaacaaggacattttcctgcataaccacagtgtgcaatcaaatcaggaaattaacattaataccgtttattttatagtccccattcaaatttttccaattgtcctaataatatccttttttaattatttttaattaatagagatgggatctcgctttgttggccaggttggtcttgaactgctggcctcaagcaatcctcttgcctcagcctcccaaagggctaggattataggcacaggccactgcacccagcccta

SEQ ID NO: 7514 - DNA, 235 bp, Homo sapiens; identical to SEQ ID NO: 7512

SEQ ID NO: 7515 - DNA, 1601 bp, Homo sapiens
tctgaaataagtattaatacctaacatttaatattaattctgtcctatgtgcaacttacaaatacgtcatataagtatataaattgactttacctattatatgcagaaattgaaggggggaatttctgtgtttctagctttcttgttaatgtgaagggtggggcattttatgttttttcaggattgccttattcaatgaagcaagctgggtttcctttgggaatattgcttttattctgggtttcatatgttacaggtaaaatactatataatttcttatttctgcaacttcaactgtgcaataactacacacatacacacacacacacacacatgctgcaactgaatttcctagttaattaaaaagtgcatcaaagaatcctaaagaatttaagcatttatgcctgaggagatttacttttcttactaatcctttaaacagattagaaaaagtagaaaagcattatatattaccaagcctaaatccttttcatgtgcctttttcactttttgcagaaagtagtagatggggaagtcattttaaagcttcattaaggctaagagacgactgtgctctgaaagtgcagatagcagggcttcgtgggcaggtgcgtgtgaatgagcaaccttattcagctgttgtttgtggaggtagaaatgaagctctggtgatcaaccagcagggctcatcaagcctctccgcctggcttatgcctgcccaaactcgctgcctgctactgtctttaaatgcagcaataagttgcttctgtatcacatcttctcttctgcttccccttcttcatgtaaatagttcattcacacccacgttttgtcactctcccatttaaatgcaggctttacaactcataatcatctcctctttttgttgtcctcgtccccgccttgtcatcccaccatctcaccttatgacaaacatggcgtctcctctaccttaggatcactgtgaaagaggtggtggcaatgatcaaaaacagacaccactcacaggagttgctgctgtggtggattagatgcccttttaccagctagtgcaaaacacctcagctgccctttgctctggagtgttgccctgggcctccagggggtctccttgcctccacggggaccaatgtgtggtacagttggagctccagggctccaccactgcagtacttgctgaactctttcccctgccctgtcctctcattccccttcttctggagcatttcatccacagaccccttgcccaagaatgtctgtctcagctctgcttctagagatcctccaagatgccatccctcgtaaaacctcaggcttccaagacctgcccaacactcagctattttttctcaggctgacgaagacagagtaaagcatgaaatagttttcaaattcaaagctagagaggcattgagctccctgccttcttcctaccacctccacccttaagacctaaactgcttctagttattacagctcttaatttgtaacttaagacccataaattagcagcatgagacctaagtgtgcttattaagagttgctggtgtttaaaaattgcagtctacttattggggcatttattacactaaaaaaaaaaa

SEQ ID NO: 7516 - DNA, 781 bp, Homo sapiens
gcaagtttttctaagttctgttttcatgttatgaaatgttggggaacaaaaagaattataaaaatttacagcaaataattctaatttgctttaagattttcaaatttgttgattaacataaaataatttttattgtctgagcatacaaaattatttaaaagaaaattcttttgttaagtaacagattcattcatgaatttttaaaaaggttgcatacaatatattcaaagggagatcaaaatattatagtgattaatacctaagatacctaaaacttttaagggaatatatttgtagcctgtattttataagcaaatgaaagcatttacatttattattgactaaattcttaacacatctttacctttaagtgatcattgtgaacttttataaaatgctcagtgttctcatcccaaccatacccttcttcagcaagccttcataccatctctgaaattggttgcctcctctctgtgacataagtatataaattgtatataaattatatgagaatcaatgagaatcaaggaggagaatcaatgccaactctgttgccagtaacttcagaccttggctaagccgttttaacctactgaagtccaaattttctcctccaaaaaagtaaaacatgaacacctacctcaaaaagatttcacgttatggctgcattattctcagcatctagctctttgattctccttggccagtgacctgctgttcagttttcctgcttccagcatctgtctactttctcatcagtcctccatgctgctgcaagtta

SEQ ID NO: 7517 - DNA, 233 bp, Homo sapiens
agtgtaacagtatgtatgcatgtcttttatgctgaagatggggctgtaattcacactgtttccacagttgagagcatcttccacatgtggtagattaaggtgaaactgcatatgggtggtggtgaatcatttttctgtaggctgcgtggttgattgctagtgttaccgaatgtactttttccacttactgaagggtccatcattatttgaatcatctttctttaactttctag

SEQ ID NO: 7518 - DNA, 648 bp, Homo sapiens
agggagacaataatgagggactttcagttttactttacataattttcttttaagtattggaatttaggtgatttttcctttggggttttctgtattttccaatcacaataaataaaataagttataaatatttgttgcatgaatgaaatgtataaacccatttatgtatgtatttttttaaaattagtatattattaagtctatacaatattagtatattgttatgtatgtataagctttttaacatgaagtttgcagaatatagtacttcttccaaactctatgacatggggggaactgaagtatggggatatcttgtaccagtgtaagaattcaagaagagaccgtgtgtggtggctcatgcctataatcccagcactttgggatgccaaagcaggatgatctcttggagctaggcgttcaagaccagcctgggcaacatatcaagaccccatctctaaaaaaaaaaaaaaaaattaactgggtgtggtagtgcgggcctatagtcctagctattccagaagctgaggtgggaggattgcttgagcccaggagtttgaggctgtagtgacctataccagtgattataccagtgcactctagcccaggcaacagagtgagacctggtctcaaaaaaaaaaaaaaaaa

SEQ ID NO: 7519 - DNA, 648 bp, Homo sapiens; identical to SEQ ID NO: 7518

SEQ ID NO: 7520 - DNA, 102 bp, Homo sapiens
atcaggcctccattttttactaagagaaaaatgcaccctttttttttttttagacaggatcttgctctgttgcccagggtggagtgcagtggtgcaatcacg

SEQ ID NO: 7521 - DNA, 102 bp, Homo sapiens; identical to SEQ ID NO: 7520

SEQ ID NO: 7522 - DNA, 1045 bp, Homo sapiens
tttaaaagttaccttgatgacagagtcattgctatacttgcaacttattttattgtgggggatcagtgaaataccctctagtaatactgagatgtatagaaaatgcccctaaactaaatgcccccactgttttaagttaaactgtattgttggcctgggagcaagggtaatgggtagtttttccttgtagttaagctttgagctgtcatttcttattttagttattgtacttgcctatgaaggctcttctaatttttaattcttaactcgttttggtgaagtagatgaacaaccaagtttattgaagctttaatcatagttgaacatgtaattgagtcactgggatctgcataaaagtttgcagattctgatatacagtctttataggagttagaatatgaagattgtagtagctattttcatcacccatcagacttatatgtttattcagtagagctgaaattattaaatgtatgaatattactggctttttcctgaccattcacacttcatggtgatttcacaagagaaggtatatgattctggtttccttgcagacttgttttttataatcacgtttattgaggcttaattttcatacaataaattttatatatattttaagtttacaatttgccactcagatcaagatacggaaaattctcatctattggagaaagtttcctcatacttctttgcagccatcctccccaacctgccacttggcccaggcaatcactaatctaatttttaacactacagattagtttgccacttcatctaaatagaaacatattttatgtagttgtttgtctggcttttttccttcaacaatgtctgccaataatattgcatttattgaaagttacttcatttttattgctgagtagtaagtagtctattgtgtaatggataccacagtttatacattcgtctgtggatggacatttggggtttttacgcttttaagttgcaatgaacatgcatacaagtattgctgtgatcattgtttttccttctcttgaataaataactagaagtggaa

SEQ ID NO: 7523 - DNA, 1045 bp, Homo sapiens; identical to SEQ ID NO: 7522

SEQ ID NO: 7524 - DNA, 1045 bp, Homo sapiens; identical to SEQ ID NO: 7522

SEQ ID NO: 7525 - DNA, 564 bp, Homo sapiens
tagcttgtgattttttttttttactattttttactgtgataaaaaatgctgtggtaaacacctttgtgtcacatacattgtcattctgtccagttttctctatagaaaccaatttttagaatttcttggttaaagtatatacatttcacgtgcttttttactagtttttatattagacaacttctgattaaacatttagtttaaatgattaaaagtatggcattacaataagaatttatggcttatttgattttaaaagtaggtcttaaaacaggcaatatactgtgacaagcaaaatatttccatgtcattatttcgtaagtatccttaagaggaacagtatctctctcaggacttggaccaaggaatgagatcaaaggggaataatgattagcagcttaattcagctgatctcaaatgcttaggggaaaagtttttttaaaaagttcaaacatatgccctatttaacatgtgataacacatattctatattaaatatcctgaattgattatagtgcatgccacacaatcacttgttctgttgctaacaatcagatattgatt

SEQ ID NO: 7526 - DNA, 520 bp, Homo sapiens
ctgttttcaaaagtgattttaccattttacattcccacactcacaatgtctgagaattcatgttccttgctataatttagggaattttcttttactttctgccacacaggagttttttacttcattagattaacactttgctaatataattattaacttttaaagagcaaaaaaaaaaggctttgcagatgaaaagaccaaagcctataatcaaaacatgacatgaaaagagtttagaacaccctggcttcataagttatcagaaaggtgaattttatcctcagacttttagcaacacctttaatggctagccacttgagaccttctataatacttctttcagagttcctgctgctgcttgaattgtaaaagctgcaatagaaatatgtttctttacttctttccaggccaaacgagagttggctttattttcaatatcaaagatagcatcatagattccaggaaatgattctccagcatatttgttgtggctacttggagcaaatatgatgtgcctaaa

SEQ ID NO: 7527 - DNA, 1688 bp, Homo sapiens
gtctcactcagtattgggtttagggctcctctagattctagtacatcatgatagatcatgcagtcagtaaaagtcctgctgattttccccagtaaagtgctttagtccacacaaagcctgatctttaatccatgcctagaattggcaaatgatgccaggaaagaaaacagttggtagtctcagctatgtagaaaagacaaagacttttagtacatctagtcttaagcgcttccacagctctttcgtatctgtaatgtattttgcatttgatccattttttcctagttactgcacctgggagcgactgccagtactaccacatcatttcggtagtggaggtccccattgaaggtttttttcatagcacatagcatgatcacgtctaggaagatcgttctggctgtagatagtataattatctactaatacaaagggggaaaggacgtgagatgatgtgaaaggaagttttgcatcatttacttgaaagatactgttcttctgaatttaatcacattggggattggaaaaagtagatgaataaaaattaaaaagaaaaaaacaaatgagttcatgaagttaagcaattaaagaaaaagacaaatctaatacagtactgtaattatttcaaaggttactattttaccctaaactcatttctatacttgaaagttcaaggatcgattgatatttttgaaattctgaactaaatggaaatattaagatggctcatgtgtgcatatataaatgttatttgtatcctcagaataaactaataaatttcaagggtacaaaataggattactatttgtgaactgtattgtatcccagaactctgtacttttgtctgttcaaaatgaaaacagtagttattatattattttaacccttataaaagggaatatgatgtaaaaaattttagccattcagtacagagtacaagtcacataaaagtctaccaccgaaatgcaagcactatttgtattttgtttgatattcatatatttagttttatcactttttttaaccagtaagtcatggacaacttactatataagtgaaaaatgtatatatgatcattgtatgatcatttttatattatactataatccattctcccttgatatttagcttgtgattttttttttttactattttttactgtgataaaaaatgctgtggtaaacacctttgtgtcacatacattgtcattctgtccagttttctctatagaaaccaatttttagaatttcttggttaaagtatatacatttcacgtgcttttttactagtttttatattagacaacttctgattaaacatttagtttaaatgattaaaagtatggcattacaataagaatttatggcttatttgattttaaaagtaggtcttaaaacaggcaatatactgtgacaagcaaaatatttccatgtcattatttcgtaagtatccttaagaggaacagtatctctctcaggacttggaccaaggaatgagatcaaaggggaataatgattagcagcttaattcagctgatctcaaatgcttaggggaaaagtttttttaaaaagttcaaacatatgccctatttaacatgtgataacacatattctatattaaatatcctgaatgattatagtgcatgccacacaatcacttgttctgttgctaacaatcagatattgatt

SEQ ID NO: 7528 - DNA, 518 bp, Homo sapiens
ctgttttcaaaagtgattttaccattttacattcccacactcacaatgtctgagaattcatgttccttgctataatttagggaattttcttttactttctgccacacaggagttttttacttcattagattaacactttgctatataattattaacttttaaagagcaaaaaaaaaggctttgcagatgaaaagaccaaagcctataatcaaaacatgacatgaaaagagtttagaacacccgggcttcataagttatcagaaaggtgaattttatcctcagacttttagcaacacctttaatggctagccacttgagaccttctataatacttctttcagagttcctgctgctgcttgaattgtaaaagctgcaatagaaatatgtttctttacttctttccaggccaaacgagagttggctttattttcaatatcaaagatagcatcatagattccaggaaatgattctccagcatatttgttgtggctacttggagcaaatatgatgtgcctaaa

SEQ ID NO: 7529 - DNA, 4507 bp, Homo sapiens
atgtagtaattttgcctggatggttttggatataatagccaattcatcacttgtgatttgatgactcttagggtctctagtttttcttaacagcctccaaattgaagtttcagaatccttactgcaaaaagcacaaaagttttcattgccattttgatagtgatatgtagctcgtaaataataattcttacctctgtgttagataaaacatccagtaaaacagcatcaagtttagctttgatagaagggaacaattagagttggtgtagagacagaccagttaggatgagggcatgaaatacagcagaagcagtaggaagagaagagagactgaggatcttgaattagggtctagatgaaaatttaggatgattcctaggtttgggaatggagggagagcttaaacaagatagagaatatagacacagattttggaggaaatgattttctcaagggactgctgagtccaaggaatgtttacaaatcctcaagaagtactccaggctatttgtaagatctgaggctcataggccttttctggctctcaggatttagagtcgtaataggcagtaatgtaaattcactagctaactttgaggttgcaacattcatagcactctgaactttgagggcatcttgttttaattcaaaaaactggtaatccctgcttttgattgtgatgtaagtagcagtacacaagcatgggaataagtaaatccaataaaggagtatttaggctcacctgctaaatactcagtgtgccacccaaaccatctgtaatgggtccccttattgaaaacattctttttccagaatgggcaaggaaggctggatgggcaaaagcaaaataaatgtaccacagacccttgattctgttagtatcagtgataaaacatgattgataaaactaggcatgatacattcttaaggtacagaaaaatgtggaaattgtgtcaagaaaattcacaaattttaaatggttctttaggctgatagtaataaatgggatcattataattttatgtaaaaccttcaaaggcttcctactaaagaaagctgaattccagtaacagattgagcccagactactcagttcatatttgaggccaacttagactatttttgatgccttaaagattccttcaagtcccctttctctttctaccatacccccagtaaagctacttaaaatcctctgtaggaaagagctgagtaattgggggcagagatggaggacaaatttaagggaacagaaagccattgggaagacaaatgaaagccagaatctgaagataattttaaaaccttcagggaaagtaggtgtctaatcacaggacttaattcacttgagtagaaatttgtaatttagccataggaatttaggaagtgttagttacaagaggtaacttgaagctgtggacatgatgatagcttttgttgcataattagaatgtgccaaacactttgctaagtgcttatgatagcttttctcttcagaacatcaccatgattatttacagtataacctgtattttacagatggagaaatgtaggcaaaggaaaggggcataacttgcctccagggtcacatagatagcaaatgatgaaatttaattttaaaattagaaactgattccaaagtccttacactcttaaccatgaaactgaagacatctaagtcaccacgcaaaacccagaatctaaatggccatttattagtgcttattcctttatttcctaatattaattaaatgacttaattaccatgagaagataatgtgctttcagttttcgcagtagttagttcagccattgattttcttactaagaacctctaaaaggccaatgggcagttgacaaaaattagggatggattctgcagctgtaagaccaagtgaaagtaaaaggcccatggcggtaaatttgtcccttgcaggcagtttgttctaaatgcttgtgcctagaaataaacttagccttattatcatctggactctgagcaatttttgcatctcagtattcttagatgtggatgattaaaaggccacgtatgaaggcagctaacataagacactttgtgggagtgagataattcattaaaatcaaatattagtgtattaggcaaacaaattcaatcatttcagttatgtaaagctagctgggttctcagttttagcaagttagggaagatatcacattacaggagaaagacaatctaaaagtttttgaagttttaatggatttaaccacttgtaaaatgttataaattgtaggacacttctcccagagagatcctctagcatacatggatgatttacttttcatatttatgatttggcaggaaagtttgagttcatttgaagttaggctttttaatagtttttctcctcccagtgaatttttctgagttgataggtgtaaaatttatagattttattgataataaaagtttgtaagcatctttaatgtagcgattccattgcttattttttattcagcactcaggtcacttcctatgtgctggagataattaaagactccacttccaagaaaggatacaacaaggaaaataagaggttgttaaataaaaattatgccaaagataagcctgtagaaagcttctgtggtgcgtatttggtagattttatggatggatttcgtgaaggataaatagcagagtcctgaggggggaaaaaaggatagaagtggccaaatacaagagaggaaatgggagaaagaataggatatgaagaagcctggcattgagaggtggtattggcctgttaagaaaacttgtttgcctagcccctaagttctagtctcactcagtattgggtttagggctcctctagattctagtacatcatgatagatcatgcagtcagtaaaagtcctgctgattttccccagtaaagtgctttagtccacacaaagcctgatctttaatccatgcctagaattggcaaatgatgccaggaaagaaaacagttggtagtctcagctatgtagaaaagacaaagacttttagtacatctagtcttaagcgcttccacagctctttcgtatctgtaatgtattttgcatttgatccattttttcctagttactgcacctgggagcgactgccagtactaccacatcatttcggtagtggaggtccccattgaaggtttttttcatagcacatagcatgatcacgtctaggaagatcgttctggctgtagatagtataattatctactaatacaaagggggaaaggacgtgagatgatgtgaaaggaagttttgcatcatttacttgaaagatactgttcttctgaatttaatcacattggggattggaaaaagtagatgaataaaaattaaaaagaaaaaaacaaatgagttcatgaagttaagcaattaaagaaaaagacaaatctaatacagtactgtaattatttcaaaggttactattttaccctaaactcatttctatacttgaaagttcaaggatcgattgatatttttgaaattctgaactaaatggaaatattaagatggctcatgtgtgcatatataaatgttatttgtatcctcagaataaactaataaatttcaagggtacaaaataggattactatttgtgaactgtattgtatcccagaactctgtacttttgtctgttcaaaatgaaaacagtagttattatattattttaacccttataaaagggaatatgatgtaaaaaattttagcaattcagtacagagtacaagtcacataaaagtctaccaccgaaatgcaagcactatttgtattttgtttgatattcatatatttagttttatcactttttttaaccagtaagtcatggacaacttactatataagtgaaaaatgtatatatgatcattgtatgatcatttttatattatactataatcaattctccattgatatttagcttgtgattttttttttttactattttttactgtgataaaaaatgctgtggtaaacacctttgtgtcacatacattgtcattctgtccagttttctctatagaaaccaatttttagaatttcttggttaaagtatatacatttcacgtgcttttttactagtttttatattagacaacttctgattaaacatttagtttaaatgattaaaagtatggcattacaataagaatttatggcttatttgattttaaaagtaggtcttaaaacaggcaatatactgtgacaagcaaaatatttccatgtcattatttcgtaagtatccttaagaggaacagtatctctctcaggacttggaccaaggaatgagatcaaaggggaataatgattagcagcttaattcagctgatctcaaatgcttaggggaaaagtttttttaaaaagttcaaacatatgccctatttaacatgtgataacacatattctatattaaatatcctgaattgattatagtgcatgccacacaatcacttgttctgttgctaacaatcagatattgatt

SEQ ID NO: 7530 - DNA, 520 bp, Homo sapiens; identical to SEQ ID NO: 7526

SEQ ID NO: 7531 - DNA, 3915 bp, Homo sapiens
gggagctgctctgggcagggggaaaatgtgctcatctcaggaagctggtgtggatggtactggacctggctaggcctgatactgaccagcagatgggcgctgtgtttgtagccccagaggtggtaggccggcagcggtatggacgccctgtggactgctgggccattggagtcatcatgtacatcctgtgagtggacagatggacaagcaggcttgcagtcagatggggtgggggcatgtgtctgtggcctttctgtgtgacccttcccccatgcaggctttcaggcaacccacctttctatgaggaggtggaagaagatgattatgagaaccatgataagaatctcttccgcaagatcctggctggtgactatgagtttgactctccatattgggatgatatttcgcaggcaggtgaggaggtgcctgcccagcacttggtagaacgcaagggagtggggagggtgtcctgctctcatcttcctctgtggtattctgcttctgtcccccagcccatttatcacctctagacattgagatggggtgcccatgactatcccctccttggttttgtccacagccaaagacctggtcacaaggctgatggaggtggagcaagaccagcggatcactgcagaagaggccatctcccatgagtggtgagcagggtccaggggagggtgggagaggccagggtccccctcacacccagcagccccatctttgaggcctagaaggggtgcaggtacctagagctcagggcagcccagaggctctgcctggtagtccctggatgccacatagaagggctgagcagagtctccacaaaggctcattctctcagatccagacacacttgcaccctttccaggatttctggcaatgctgcttctgataagaacatcaaggatggtgtctgtgcccagattgaaaagaactttgccagggccaagtggaaggtaaggcttggataactcccttcttggctctatcccaagtattgcttctggcactcagtttcttgcctgcatcacacccctgcagccacacacaagcttttctcaggccatcaggtgtgggtgtagccactgtgattaccttaagtaggagtgctgagcagctgagtacttggccctggggtggatggaggtggccgggggtactatggaaggagtttggtttggtcactgccaagcaatggatccagcaagcctcacccttagcctttctccactgtgctcctttcagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttaatgggtccttaccatgggccaaacagggagggctgatacctccttgctcttcctagatgcccacctcctacaatctcagcccacaagtcctctccacctagggggcttgctgcatggcaataactcataatttgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcctctggccaccctctcgcctttgcttcctctgtcctactggggaggagcccctggaaggcagtggggaagggagaggctgggagcaggttcacaagtagtggctgggagtagtagtgaacagtgccctgtggatttcttgggctgagggtgaagatcatcctcaccacagtgtattcctcaatggtggtggtggtgggggtcctctgaactctagaaatccatgtgagtagtgggtcttgggctgcatttggaccaaggaatactccctgggctgagagctcaagtaagggctgctgtttttgactcctgttgaccgaggagccttactcttgatttaggcatagagctggaatctacctgggccagccagcgcaaggacagaccctgctcatagccaaagatagcttccctgagctagggagagggtgtagggtgagcaatgcacaaagattctatgctgctctgtgttgattccttctttctgtgaacacctgtgctttccacctatgccccaaatgaaatctcactctgggtctatttcagctggagcagatcagctttatattatgggactatgcacagggtttcttctgggtagagggagtaacactgccacagatactaagcctaaaaacccaaaagttgacttactccagcccaggtgggcctgggtgaactcaccagggatgctgctctctgggaggacctcaaagataacctcctcaaggataacttctctgatgtgggaataataaaaaggatttgttagtctcta

SEQ ID NO: 7532 - DNA, 148 bp, Homo sapiens
aagccggacctgtagcagtttctttggctgcctgggccccttgagtccagccatcatgcctatccgtgctctgtgcactatctgctccgacttcttcgatcactcccgcgacgtggccgccatccactgcggccacaccttccacttg

SEQ ID NO: 7533 - DNA, 3915 bp, Homo sapiens; identical to SEQ ID NO: 7531

SEQ ID NO: 7534 - DNA, 148 bp, Homo sapiens; identical to SEQ ID NO: 7532

SEQ ID NO: 7535 - DNA, 20268 bp, Homo sapiens
attatagctacctgttaaagaatcatctggattatagaccagtggcactgttgtttcacaagatgatgtttgaaactattccaatgttcagtggcggaacttgcagtaagtgcttgaaattctcatccttccatgtattggaacagttttcttaaccatatctagaagtttacataaaaatttagaaagaaatttaccacatttgaaatttatgcaggagactatatttctgaagcatttgaacaaattaattagctttgttgttcaactcattgggctaaagaagccaaaagcaatgggttttaatgtagtcgaagccaaattatatttatgaaagaaatattctgtgttataaccaccaaatacagcccaattctgactagatgatggaagaacctgtcccatcagaggtccagcatgaggtccagcagaggtccaccagaggagttcagcaatttgctgctcttagggcagggatcaattccttaatatcttaggaagactaggtattgacagtaatggtgacaaagcaatgaaaaggaaaggaagaagtgataagacatggcagcaagctgaagtatgatgagtaaagaataggaatcaaagtatgtggagtgttagagaaaacctggatttagatccagattctagtcctatctctgtcattaatctattgcgtaaccctgagcatatcatctacctctctttgagtttgcttgtcaataaaatgaagagactttgaaatctgagacttcctggataagtactaaatacagattatgtcactgatgtctgcctctatttatttctcccttttaccctaatctctataagtctacctcagtcatcctgatcctattctacttctctgatgttgttgtcagataggtgtgatcatcctcatcagatcttttctgtattcttagagacagataactttatcaaagaccacagatttattagtatagcatgttaaagtcttctaaagagtctcattgatgctcttttcatctcagtacaatttttaaaactgctgaatgcaaggtactgagctgttggaagtgactgacagatgaatgtaacagattcatagagaaggaaaaaggaagaaaaactcatgctcttcctatagtattgatatcagtgtaagagccaagagaaaggtataaagtatcatgcagatattaagggaaagaaaacattcactttagtaatctttcctcattttctagtttcctcttatgtactatgatttaatactgtagtaaagttttaataaaatatgagctatatgtaattaagtgggaggttgtggggctaggcacgaggctcacacgtgtaaccccagcactttgggaggctgaggcaggcggatcgcttgatctcaggagttcgagaccagcctggacaacaaggtgaaaccccatctctactaaaaacacaaaaattagctgggcatagtggcacacacctgtagtcccagcttcttgggaggctgaggcaggagaatcgcttgaatccaggaggcagaggttgcagttagccgagatcatgccactgcactgcagcctggacatcggagcaagactttgtcttagaaataaataaataaatataaaataaaataaatgggaagttgtgtatataaattataaatgctacattcagaaaagcttttgaaggttgtcagacagtttcttaaaggaagttcaccagttctttattgaacattgaagaaaacatacagtttagactggcattaaaactgaaagaagtggccagacgcagtggtagacgcagtggttcacgcctgtaatcccagcactttgggaggtcaaggtggatggatcacctgaggtcaggagtttgagatcaggctggccgacatggtgaaaccctgtctctactaaaaatacaaaaattagccaggcatggtgatgcgtgcctgtagtcccagctacttgggaggctgaggcaggagaattgcttgaagccgaaggtggaggttgcagtgagccgagattgcgtcattgcactccagccagggcggtaagagtgaggctccgtcttaaaaaaaaaataagtaaataaattaaaaactactgaaagaagtattacaggcaatgggaaatagcttgagtggaagtgcagcagaaggaaaaagctggacaagaatgtagtgtcagagaataggtatggaacgtgtgagtgactgttagaggatcttgaatggggataacagacttgatttcataaatactgagatgtcatgataatacttgaggactaaaccatgttttaaggacagttgtatgcaaagttgtaatcgcaagaggaaaaaatagtggaaaagaaaccagtaataaaacttgccttaatgcaggtatgctaagacaatcaaatgggatttcattaattttttatttgccatttatagccaaagattttgtaaaagttttgagcccagtcaggtgaaatagtctcagaaagaaagaaaagtgaatctgagacttggagacattaatgttgatattttggttttaaacgtgttttaaatccggtaaaagtgagcttctcacatgacaatattcagtgggtacttgggagtatgggttcgaatctaggtaggagatatatcgatattttgggcatcatcaggaaagggagagtagttaagcctttcatataaataatggtgtggcgtttgggcatgggaagtcttggaggaaaggaagaaaaggagagggtgaggactgagataagaatggcaacttgggtttaggaagaagaagaggaatcaatgtagagaacagatagtgctgaaaaatacagcatcttctgtagggattggcagctttttcttgatttttgtcttaatatttctaagagatggaaaaagctactatattctagacatttaacagggttaaaaatgttactaaaagatgatcaatgtggttttcattcaagactataacaatatgtatatatccaaggaaatttaattctgacttaaaaaaattgttttgcttgtatagatttagggacacaagtgtaattttgttacatgcatagagtgtatagtttcaagtcagggcttttaggttgtccatcatctgaataatatacattgtacccattaagtaatttctcatcttctactcaccgtttcaagtctccactatttatcattccattctttacattctgattttcatttactaggtgtattagtctgtttttgcattgctttaaagaaatacctgagactgagtattaaacaggtttaacctgttttctttatgaattcttctttaattggctcatggttctgcacgctgtacagaaagcatagcagcatctgcttctggggaggcctcaggaagcctccaatcatggctgaaggcaaaaggggagcatggtgagaatgggagcaagaaagagaaggagtggtggggagaaggtgccacccacttttaaatgccagctcacttaccaccaagaggatggcccaagccattcatgtgggatctgcccccatgattcaagcttcttccaccaggccccacctctagcactggggattacaattcaacctgagatttgggagggaaagatatccaaactatatcactaggtctggatcttgttatttattttttggaacatagtcatatatatccaaggatatatattgtagaagtccacagaaccatactaatattggacttctgcttagttaggtcttatctatctgaaacatgatattcatattgcagagaagattattttctttagtgattgaggaaatctttactacttatacatttttaatataatactataatatttgaagatgcacattttagatgtagtttaattgaaacctggaaatactattaatttgctttttaaagtcctaaaatcaggattatcagattctgaattaatggagtttaaatcaaaaagattacaaggcagtttttcagttttattctggttaattttatcacagctttggaatcctactttgtttatttgcttcttgaagttagatttcccagtgaaatttcagtatcacataaagtcttatgaaatggctcattgcactttgaactttgagtcaaggaagtgaaatttattgatagattgttggtgtaatatttatcctgtttgtggtagcttttttgaataataagtgtcttagaagaccatgttggagtagcctgcatgcttttatcaaacatattaattatgtgatggctgatactgctttagatattacatagaaatagtagtaggtgtttactaaactggaaatttcatttaacttggtttagctttgccttgttctcagtcacattgataaaaatgtaagacttttgtttatcttttagaataatgacaccttttggtgctgagaattttttgttttatatatatatatatatatacgtaatataaatacaaaatatatttaaatatgtataatatttctcatacactttatgtaactttgtgttcctgtttctctattatcttggcatgttttcttcaaatggcacttcttaacctcctaaggttaataaatttctttgtaatggacttttgttttctaattcctcagcgtatgacaaatgaattatactttgtcaaattatttaggtaactttcagtttttgaagtcctgggatcataacattcatcagtctttaatttctgtcattaaggtcattagctataaatgaatttatgagtagatttaaaaaataaaacatacaatccttcccttaacacactttcccaccatttggttcaactgctagtgtaaaagcatgatgaattttgagaagttatattttaccagttactttattttttaccagttatttaaaacagacatgagccaaagccagaatacttgttaatgaaaatgaggtgttttggaggaaaggaaggttgtgctgcagtttttacttgaaatctgttacatttctttacagaaatttcaaatctcttgtttcctgttatgatggtggcattatatacctttaaaatgtgagctataggaaaatgaatgatggttaattttttaataaatatttagacttgtgtttttgaaattttttataacattgttataggttttatcctctttctcttgtgaacatgtagtgatttgtattttgtgatctttgccgcatgctagagacttaagaatactatagcaaatatctgtcttctttacatttaaaaatttttcgtgactactccctgttgatatctgtcttaaaagttacttttgatgtagttcacaaatgtaccagataattatttcatcgtttttaatgcttaaagtttttatttgtattaggatttttagtatgattttaatgttaaagttttgaagttactctgccactagaagtctaattttgggacttactattcatgaaataggaattgacttttatataagtaataggaccttattttgaaggttcaaactggagaaaatcttacattgtttatatttttatttcatttatttcagttgatttgcttgagatcaagattgcagatacagaatccatatttcgtgtatattgctgatattaatcattaaaatcgtttttgacagtttgacagttaaaggcatttcctgtgaaataatactggtatgtatttaaccatgcagatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggtttgtactttactttcattgggagaaatatccaaaataaggacagattaaaagctatattttattttatgacatgtaaggaactataatttgttttctattagatctgcaggtgttttgcttactctggcattggtgagacattataagggtaaataatcctgtttgaaggaaaaggccttatggcattgtaacatgagaggaatttttcttaacaaggatggttaactgagaagaaattagcatgggaccaatattttaaaaattttggtctataggtagaaatgagatctgttctgtggtcttatgtagtgacacaaaccactttttctccattttggcttatgtttctttttctttccttttttttttttttcctttttgttagagacagggtcttgttctattgcccaggctgagtagctaagactacaagcatgtgccaccacacccagctaattttttttatttttatttttgtagggacagggtctcactatgttgcccaggctggtctcaaactcctgggcacaagcagtcctcacgctttggcatcccaaagagttggaattacaggtgtgcgccatcatgcctggccttaacgtttcttaagacttgattattttctatttagcttctgtggatttactgattaattttttaactaggagagaaatcagtatgaagaggaagtaataaagaatgaaaacatggtatttaaatgtgcaggtttagaaagttaatgaagtttgaatttgattgatctgtatttagagaaggcaacgtcttattattttaaaaccaactatccgccctgtgcggtggctcacgcctgtaattccagcactttgggaggctgaggtgggcagatcagctgaggtcaggagttcgagaccagcctggccaacatggttaaaccccatctctactaaaaatacaaaaaaattagccgggtgtggtggcaggcgcctgttttcccagctactcaggaggcttgaggcaggataattgctgaacccgagaggcggaggttgcagtaagccaagaatgcaccattgtactccagcctgggcaacaagagtgaaactccatctcaaaaaaaaagaaaaaaaaaacaacaactatcttcatttaaaatattaaatgtgaatatttaaagtgagactaaggtgcaacatttttagatagtaatgaagaaaaggactaactttgtagtgttgctgccttgttaaacatactagatagcatattgccaatctttaaacattctcaatgataggatttatttactttttctgatttttagcttttcttttgaaagaaaataagaggaagtttcatttactgcaaaattttaaatgctgctttgatgtatcagtagagatataattttcctttatccagaatccaagtagctggaaaaaaaaatcaaaatatgctgaacttttttttttttagccagaaacccatttcctatcgtctgtacaaataaaagttaaatatatctcaataacttagaaaaattattttttgataatccaggaagtattagcaactgttttaaaattaagataactagtaagttttatttagctttcaaaaataggcatctacatcatcatctctgcatacctttaggaatttcctaattcttatttcccttcatctgtactttaacacatgcaaaattgaaggttagattaaatatttatgatttatttgtttatccttgactacataaatttccattttattgattttccctgccttatttaagaatatgctatgattaaaacacaaaaaattttagtataacccatatatatatagaattcacctttttgttatttaaatattattggcttattttcttctaagtaaaatacaattactggctaaaataattgaaataagcaaaaaaaaaattttaaagaccttgtatacaagattactttgccaggtactgttaaaagatgcaatgacatttaagacgtaacatccttaaggatcttattttctgggggataaaaaactttaagataaattagaataaaagatttaaatggcattttaaggtaccaggtaccagataagatgtcacaaggctgtatatcattaattgccaaatgatttatacaggccagatttctttgttggtcaatagaggtttaaagtgatgaacttctgttgtgtttttttattaagaaggtattatcttattagtaagaagtgattttttttaagaacaagcattttataacatcaaaagaaatcagtagtactctttcctaccccctcatatttattctgaaagtattcaagcattatattgtcatgtaagaaactggagcttctcatgtttgtattgctgtagaagtaaacatgtatttgccatgcgtcatcagggaagttgcactcaccgtccaagaacttttgttaaagtaaatcttggaataggtagctcatttgaaatgtagaaaaaattaaatccatatctgaattttgtttatatgtatgtacacgtaaactaaaaacgtatttaaagctagtattagatgagaaaagaggtttttttacttaaaattttaaggcaaaagtagtttatcttagatcttgtgagattgtatttttggtttaaaatttgagaatttgagtgaagaaaaatcatgtgaatgaaaatgcaacagataactcagattgccttataatagtctttgtgtttacctttattcagaatatcaaatgatagtttattttgttgactttttgcaaatgtttaacataggtgacagattttcttttttaaaaaaataaaacatcattaattaaatatgtcatttcatttctttttcttttctttttttttttttttaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtcagttaaattaaacattttgtgggggttggtgacttgtatgtatgtgatgtgtgtttaattctaggagtacagctgatgaagaacttgcttgacaagtttttaacttatgtattatttcgaagcagtgtttacgtagcagtaacatgaaagtttctaataaaatacccaatgtacacagcgtcaaaaaagctgcatttttccttttcctaattctttgttgtttgctgaaatctggggcaaaggtgcgggagggggctaaatgactgggatatgaagtaggaatgggagaggaaagaaatagatgggaactcagtcatttgggaatgattcatatggaatgtttttactgcttccactcctgtctgccttccaatttattctcaatccctcagagtgatcttaaaaatagacttgattgtgtcacttctgtttacactttataaggaccttgtgtttttttttttaccatgacctacaaggcccagcataatttagcacagggctacctcctacatcagcactagtcaccttctctccttgtttcttgagattcagtcatactggtctttcttcagttcttcaaaatgctaagcttctgcctcttctagtctttccagttattttccttctccctgtaccttttcatctcagccttttcccctgaccttccatagctatcttcatatttccagccttagcttcaatctcatattctctgaagtcctttgattgtcctcccgttattctttttttaaaaatcctatttccttatattgtatcttagaattatttggtttgtttcatttttgcctatgtgtgatatatgtatttctacataggtatatatatctacttatagacaagaattcttcagattaaaaaaatctgatttgtaaacattcccaagtggttgtttaccatttttttcttcccccttcctatttcttattctacctgattttcccctgttcattcaccacactcgtttctttctcttttttactctctcttaatttttcattcaatttttataacatgtaataaatctaactgtagcgtctgagtattaagaatattgctagtaatacttcacctgtaatcccagcactttgggaggctaaggcaggcggatcacttgaggcccaggagtttaagaccagccggccaatatggcgaaaccctatctgcactacaaatacaaaaattagctgggcatggtgtcgcacacctgtaatcccagctacttgggaggctgaggcacaagaattgcttgagcctgtgagatggaggttgcagtgagccgagatcacaccagtgcacgtgcacttcagcctgggcaacagagcaagactctgtcttaaaaaaaaaaaaaaaaaaaaatatatacacacacacacacacacacacacacacacacacacacactattactaccaatatacatacatatatgtatgtatgtatgtatgtatattggtagtaatagtaatacttgggcccctgcacgttttaagtgaaaatagatctaatattaaatgtctttagcccttaaattttttttaagtgttcagaagtttccctttaaaaaaatttttaatatataataattgtacatatttatgggatacagagtgatattttcatgtatgcagtgtgtgatgatcaaatcaggataattagcatatggatcacctcaaacatttgtcatttctttgtgttaggaacattcaaaattctgtcttctagctatttgaaaatatacagtaaattattgttgactagttacagttctatagaacactataatttattcctcctgtgtgtaattttttatcttttaaccaacatctccctatcctcccctcccactccctttcccggcctctaataaccacactcttatgagctcaacttttttagcttccatatatgagtgagaacatacggtatttatctttctgtacctgacttattttacttaacatcatgtcctccgggctagacattctctttagaatccacaggtttcctttcttttctctaaatctgcattttgctcagccattaacttttaaaatgtctttttccctttagttttattgttttctattttaatattgcaagatgttttatatttgtgattacaaataaaaactccattattagtaaacaaatacaatgtcatatagtagtaagtgctataaaaaatagacaggatagaaagtaatcttggtttgtatgttttttgttttttagcaaagatgattagagaaggcccaaccaagcagataacatttaagcagaggcctaaatcatataagtgagttatacaaatatctgggaaaagagttaagagtacagatgcaaaagcccttagacaagagaatgagcttggtatatctgaagagtggataagtcattttgactgaaacagagtggacaagaaaaccagtccaagtgtaaagatactagtgtgtgttcagcataggaaggatgtaatctgaattttgtgtttaatattccctgtgttcatgctttcaaaatacagatgagtgaggaaagtagggagaaggggtaataaaggaagctgagagatcagttaagaggtacttgaatagtttagtaaagatgagagaagatgtttgcttcttgttgcccctcactgcttagaatagtggcagtgaagggtaacaagaagctgtcagattaacttaaagagtttactgatgcagtggatgttggttgtaagagaagaattgataatgactcttggataataggggagggaggggctgtcaatataatataatgaagaagggatttgaagtcatttctgatttaaatctcacatccactacctacttttaatagatatgtagcctttaacaagttccctaacctttctgggccttagctacctccccttggaaatggaaatacctaacatgtaaggttgttttgacagttattttcactaggcatgtaaaggcacttgactctctgttatagaccactgtattatgttaatgtccctctccttcctccctttaggtaaagtttttagggctaataaatcccaaatatcaatgttgatcagtagtttgtgtttgtgtagtgttgtttatatcaaaaactacattgaagccgggcacagtggttcacgcctaaaatcgcaacactttgggaggccaaggtgggcctcccaccttgaactaaggagtttgagaccagcctgggcaacatggtgaaatcccatctctacaaaaaatataaaagctagctgggtgtggtggcatgcacctgtagtcctagctacttgggaggctgaggttgatcctgggagtttgagcctgcagtgagctgtgaagatgccactgcactctagtctgggtgacagagcaagaccctgtctcaaaaacacacacacacacacacacacacacaaagaaatacattgatttttcacataggtagtaagagaaacattctttttgaactcagctgtttgtgaattgaattttgtaattcaaatgctatattatgtaaactattgatgactttcaatctgcatttattttgtataattatttagttaatatttgccacttatattccttaaaaaataaaattgaggttgggcgtggtggctcacacttgtaatcccagcactttgggaggctgaggcaggcagattgcctgagctcaggagtttgagatcagcctgggcaacatcatgaaccccatttctactaaaatacaaaaaattatctgggcatggtggtgtacacctgtagccctagctgtttgggaggctaaggcacgagaattgcttgaacccgggaggcagaggttgcagtgagccaagatcatgccactgcactccagcttggcaacagagcaagactcttgtctccagaaataaaaataaataaattgtattaacatcctgatagtttatctgtttagtacctagcaagaaagaaaatgttgaacatcttaagaagagggtcatttaaaaggcctcttaaagatcatgtttgttacagtgcttaaaaattaatatgttcatctgcaaaatggaataaaaaatctgttaaaaatatatttcactaaatagtttaagatgagtcatatttgtgggttttcattttaaattttctttctctaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggttttttttttttttttttttttttttaaatgtgcagtgttgaatcatttcttcatagtgctcccccgagttgggactagggcttcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcattgtgtgggtgttttattaaatgagagtttataattcaaattgcttaagtccattgaagttttaattaatgggcagccaaatgtgaatacaaagttttcagtttttttttttcctgctgtccttcaaagcctactgtttaaaaaaaaaaaaaaaaaaaaacatggcctgagagtagagtatctgtctactcatgtttaattaaggaaaaacacttatttttagggctttagtcatcacttcataaattgtataagcacattaaatagcgttctagtcctgaaaaagtccaagattcttagaaaattgtgcatatttttattatgacagatgtttgaagataattccccagaatggatttgatactttagatttcaattttgtggcttttgtctattattctgtactctgccatcagcatatggaaagcttcatttactcatcatgacttgtgccatataaaaattgatatttcggaatagtctaaaggactttttgtacttgaatttaatcatgttgtttctaatattcttaaaagcttgaagactaaagcatatcctttcaacaaagcatagtaaggtaataagaaagtgtagtttgtacaagtgttaaaaaaataaagtagacaatgttacagtgggacttattatttcaagtttacattttctccatgtaattttttaaaaagtaaatgaaaaaatgtgcaataatgtaaaatatgaagtgtatgtgtacacacattttatttttcggtatcttgggtatacgtatggttgaaaactactggagtctaaaagtattctaatttataagaagacattttggtgatgtttgaaaaatagaaatgtgctagttttgtttttatatcatgtcctttgtacgttgtaatatgagctggcttggttcagtaaatgccatcaccatttccattgagaatttaaaactcaccagtgtttaatatgcaggcttccaaaggcttatgaaaaaaatcaagacccttaaatctagttaatttgctgctaacatgaaactctttggttcttttatttttgccagataattagacacacatctaaagcttagtcttaaatggcttaagtgtagctattgattagtgctgttgctagttcagaaagaaatgtttgtgaatggaaacaagaatattcagtccaaactgttgtaaggacagtacctgaaaaccaggaaacaggataatggaaaaagtcttttaaagatgaaatgttggagccaactttcttatagaattaattgtatgtggctatagaaagcctaatgattgttgcttatttttgagagcatattattcttttatgaccataatcttgctgtttttccatcttccaaaagatcttccttctaatatgtatatcagaatgtgggtagccagtcagacaaattcatattggttggtagctttaaaaagtttgtaatgtgaagacaggaaaggacaaaatagtttgctttggtggtagtactctggttgttaagctaggtattttgagactacttccccatcacaacaacaataaaataatcactcataatcctatcacctggagacatagccatcgttaatatgttagtgactatacaatcatgttttcttctgtatatccatgtatattctttaaaaatgaaatttatactgtacctgatctcaaagctttttagcttagtatatctgtcatgaatttgtaggatgttccattgcatcagaaaacggacagtgatttgattactttctaatgccacagatgcagattacatgtagttattgagaatcctttcgaattcagtggcttaatcatgaatgtctaaatattgttgacattaggatgatacatgtaaattaaagttacatttgtttagcatagacaagcttaacattgtagatgtttctcttcaaaaatcatcttaaacatttgcatttggaattgtgttaaatagaatgtgtgaaacactgtattagtaaacttcatcacctttctacttccttatagtttgaacttttcagtttttgtagttcccaaacagttgctcaatttagagcaaattaatttaacacctgccaaaaaaaggctgctgttggcttatcagttgtctttaaattcaaatgctcatgtgacttttatcacatcaaaaaatatttcattaatgattcacctttagctctgaaaattaccgcgtttagtaattatagtgggcttataaaaacatgcaactctttttgatagttatttgagaattttggtgaaaaatatttagctgagggcagtatagaacttataaaccaatatattgatatttttaaaacatttttacatataagtaaactgccatctttgagcataactacatttaaaaataaagctgcatatttttaaatcaagtgtttaacaagaatttatattttttattttttaaaattaaaaataatttatatttcctctgttgcatgaggattctcatctgtgcttataatggttagagattttatttgtgtggaatgaagtgaggcttgtagtcatggttctagtgtttcagtttgccaagtctgtttactgcagtgaaattcatcaaatgtttcagtgtggttttctgtagcctatcatttactggctatttttttatgtacacctttaggattttctgcctactctatccagttgtccaaatgatatcctacattttacaaatgccctttcagtttctattttctttttccattaaattgccctcatgtcctaatgtgcagtttgtaagtgtgtgtgtgtgtgtctgtgtgtgtgtgaatttgattttcaagagtgctagacttccaatttgagagattaaataatttaattcaggcaaacatttttcattggaatttcacagttcattgtaatgaaaatgttaatcctggatgacctttgacatacagtaatgaatcttggatattaatgaatttgttagtagcatcttgatgtgtgttttaatgagttattttcaaagttgtgcattaaaccaaagttggcatactggaagtgtttatatcaagttccatttggctactgatggacaaaaaatagaaatgccttcctatggagagtatttttcctttaaaaaattaaaaaggttaattattttgactattcggttttaaactttttattcaacaaataccaagtccctgctgtatatatgggtttggaatacattagtgatcaaaacacaccctctatccctgcccttgaagagtttacactccagtagaggaaacagaatttacattaacaattataaattgtgatacatgctgtggaaagtgaggtgcatgtgataatggttatcaaacattatgctccccaaaatttccatcaccttgcagttgaatgaggcctatgtaactagtttattctaatgtaatacagaaagtagtgtgacactccactttctgtaaaggcaatgaaaaaaatttaccatccagtttcttcccctactgctgtgattaaggattttgcatgttctagatggtgcagctttgtcagcctgggtcttgagtgatactggagcagaactccctcaaattgttccttctgccacgctaaacttgttagatattagcataaataagaaataaaccatt

SEQ ID NO: 7536 - DNA, 4312 bp, Homo sapiens
aaatagtttaagatgagtcatatttgtgggttttcattttaaattttctttctctaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggtttttttttttttttttttttttttttttaaatgtgcagtgttgaatcatttcttcatagtgctcccccgagttgggactagggcttcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcattgtgtgggtgttttattaaatgagagtttataattcaaattgcttaagtccattgaagttttaattaatgggcagccaaatgtgaatacaaagttttcagtttttttttttcctgctgtccttcaaagcctactgtttaaaaaaaaaaaaaaaaaaaaacatggcctgagagtagagtatctgtctactcatgtttaattaaggaaaaacacttatttttagggctttagtcatcacttcataaattgtataagcacattaaatagcgttctagtcctgaaaaagtccaagattcttagaaaattgtgcatatttttattatgacagatgtttgaagataattccccagaatggatttgatactttagatttcaattttgtggcttttgtctattattctgtactctgccatcagcatatggaaagcttcatttactcatcatgacttgtgccatataaaaattgatatttcggaatagtctaaaggactttttgtacttgaatttaatcatgttgtttctaatattcttaaaagcttgaagactaaagcatatcctttcaacaaagcatagtaaggtaataagaaagtgtagtttgtacaagtgttaaaaaaataaagtagacaatgttacagtgggacttattatttcaagtttacattttctccatgtaattttttaaaaagtaaatgaaaaaatgtgcaataatgtaaaatatgaagtgtatgtgtacacacattttatttttcggtatcttgggtatacg

SEQ ID NO: 7537 - DNA, 169 bp, Homo sapiens
ttttaagggaggagagttattctgatatcctttgtattgatattgctcttatttattattgagctggatttaagtattaatcatttaaggtcaaatttctaatgtatatatgttcttaaatggctacgacccagttaccatagcaatttagtgaaataactataatgga

SEQ ID NO: 7538 - DNA, 4826 bp, Homo sapiens
tttttttttttttttttttgagactgagtcttgctctgtcaccaggctggagcagtggtgcaatctcggttcactgcaacctccgcctcccgggttcaagtgattctcctgcctcagcctcccgagtagctgggattacaggtgtgtgccaccatgtccacctaatttttgtagtttttagtagagatgaggtttcaccatattgatcacgctggtctcaaactcctgacaggtgatccacccacctcggcctcccgaagtgctgggattacaggcatgagccaccacccccagcagacatacttcattatacagtgcaaaaaaagtcacattttaaaaatatcaccaccgagctcaccaggatagtctttacatattcggaagctgtcaagttcatggtagcaggtataagattttaaaaatactaattttggcttaaaagcttgaattttatcacttataacccacaggggtcatgggccacactttgaggatcactggtgttagaggtttggttggagagacgcaagtaagagaacatttccctaacatgcccaaacacattccttttcagagtgctgaaggaatttgaaaatgaggtctcagaattaccagcagtaattcctgataaattaagaaaaatgggagagagttcagagacaaagacatgagaaaagattgccataactctccagaaggatggattctgggtaatgaaggccagtatgtttaacactgattcccagaaaaagactttaatatattcagtagcagttagtttaagaacattagaagataattcggtgattaccagatgtcaatgagggctaggtaggtcatttcaaagccttctcaaatttcattttttctttatgatcacctgtcacagtgctttacgtgatgtacatacaaaaatatttgcataactgtataaaacagttgaataataactgtatagcatattgcttatataaactgcacaaatctcatttgaataaaaaccatttataaagtacttgcagtatgcaaaatgtgttgggcaaagggcaggtctgagaggcacacacgaggaaaactaaaacagaacagaagtctaatggtattttcaagtgttataaaatatgtgaagtctgccttgtgagagaaggtagcattggcttgtggaaagagcatagcacaggaaattagaacatctggttgctcatcctggctttaccatcaacttaatgaatgacctggagtaagttacttcacttcgagacctatgctctatatctgcaatattgaaaatgctggataagataatctctaaagccccagaaaaagatggagttgtactctttcactcccaggaacatatactggaacttatgagtagaactttggagagaccaagtttgcctcacaatgagtaatattctagttctgcactgtcgtatagtgacttcagtcactaagctacatgtctcctatggaagcacttgaaatggactggttcaaagtgagatttgctgtaagtatacatttacacatcagattttgaaaacttagtataaaaagtagaaggcaaaatatcttgtcaattttttagcattgattacatatgtgataatatttttgatatagtgagttacaattatatatataaattttttttttttttagatggggtttcactctgtcgcccaggctggggtgtggtggtgtgatcttggctcactataacctccaccacccaggctcaagccatcctcccacctcagcctctcaggtagctgggaccacagttgtgcaccaccatacatggctaattttctgcatttttggtagagatagggtttcaccatgttgcccaggctggtctcgaactgctgagctcaagtggtccaccttccttagcctcccagagtgctgggattacaggtatgagccacctcccagtctaaattaatatattttaaaaacatttcacctgatttcttttactttttaagatatatatggctaatggaacacttaaaattacatatatggctcatattatatttctactggacagggtaattctagctaatagagtttccaacaaaataataataacttgaagaggaacctaattttacttttcattttgcattttgaggtacacaagcagagactgggtcatagttctgacaagaggacctcacagaagactccatttggtgtgcatttgatctaaatttgtgttctcaatctgtgctcagatgaatgcttgggctccagcagcacccagatttgtcataggggaaggaggaggaggacaaagaggtctttctgtcttcccttcctctttcaaacagagagctgatcagtatgtattactgaataaatgaatgagtgtacaaaatatatttatgtatttcaggtaaaatggatgaagtttagggttcaggctttggaccaggtctggccgctggtttaattcttggtgccactgtttactagctctatgaccttacttactccctctgtgcctcagtttcttcatctgtaaatgtggggtttgcatgtacagttttgaatacagtatagtatatttccctagaaacatggcttgctcctaaacatttggcaatgctattgcataaattaatcttgcaagacaaaactacacacaacaagaaactcttatcttgcctgtaaacaggttgttaaacatgttctcacttccttctgtcaccacctgtacagcatgtttttgaaggaattccacagtgcttgtgattaaagcaaatttgtacactgcctggacacccttagcaacttgatcttatggtagaagaacaatttgtggagatttggagacttcatattcaataaggacctgttaggggcaaagtgatacaaggtgccttctctttacttttgcctttcccatccaaacatgaccctgaacatctggcagcatgaaaaggggacatgcttatccaatacacctgctagctgactgccaggattctaaaacttaggtccaaatggtgagtagtgtttgcttttgtaatctaacactagttgacatcctactacagttctcttccattccacagactttctttcttatttatttatttatttatttttgagacagagtctcatttcgtagcccaagctggagtgcagtggcgtgatctcgactcactgcaagcgttgcctctgggccttaagtgattctcctgcatcagcctcccaaacacctgggactcgaagtgtgtgccaccacacccagtaaatttttttttaatttttagtagagacggggtttcaccgtgttgccctggatggtcttgaactcctgagctcaggcgatccatctgcctcgccctcccaaagtgttggaattacaggcgtgagccactggatccagcttccacagactttctttgcgctgcttggtccaaccctcgcacctcttttattctcagaaacttcctttgccttctactgaatagagaaaattaaggctatcatgctgcctggactgcttcaacatcctgtccttcttttctctattatcaaccaactctctacctcccttgacctgcctccctctcattttagaggaaaaaaatatttcctttcttggttttttttttttttccccaagagggaatttcgctcctgttgcccagtcaggagtgcaatgtcacgagttcggctcactgcaacctctgcttcccgggttcaggtgattctcctgcctcaagcctcctgagtacttgggattacaggcatgcaccaccatgcccggctaatttttgcatttttagtagagacagggtttcaccatgttggtcaggctgctgttgaactcctgacctcaggtgatccgcccaccccagcctcccaaagtgctgggattacaggcgtgagccaccgtgcctggcctcccttcttgtttaaagctaacttttctacagtgctctttctttcccaggacaaagattgtgttttattggattatctctttctcttcttattttcaacatttgactctcttttggatcatttcttggagttgaaaaatattcttaaatctctccatttttatcaataaacagagaaaaaagaaagctttctctatcttgtattctatttagttatcactctcctctttctcttaaaactcaagttcaaaaaggaaaatctacccttgtctctacttcctcacatctcattcactaatttttctatttgtaatatctactattttaatttagttacaaatgcacatatgtgaaagaatatatgtaaaataatatatttaatatcaatttggatatattctatacccccctgacccaatcatttccactgaccttttccttccctccaccccaatcaccagctcccattgtaataggcttgattctgccatttccagttagcaaagatctcgcaaacctgtgttttccagcatccacctctctatcacctccagaattttcactcacttatttttttttattttttttttttattttttttttgagacggagtctcgctctgtcgcccaggatggagtgcagtggtgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgccttggcctcccaaagtgctgggattacaggcgtgagccatcgcgcccggcccactcacttattttta

SEQ ID NO: 7539 - DNA, 1363 bp, Homo sapiens
actaactgtaataaatgtatgacattattttgattgatacattaaaaaagagtttttagaacaaatatggcatttaactttattatttatttgcttttaagaaatattctttgtggaattgttgaataaactataaaatattattttgtattgcagctttaaagtggcacactccataataatctacttactagaaatagtggtgctaccacaaaaaatgttaaccatcagtaccattgtttgggagaaagaaacagatcaagaatgcatattattcagtgaccgctttcctagagttaaaatacctcctctttgtaaggtttgtaggtaaattgaggtataaactatggatgaaccaaataattagttcaaagtgttgtcatgattccaaatttgtggagtctggtgtttttaccatagaatgtgacagaagtacagtcatagctcagtagctatatgtatttgcctttatgttagaagagactttcttgagtgacatttttaaatagaggaggtattcactatgtttttctgtatcacagcagcattcctagtccttaggccctcggacagagtgaaatcatgagtatttatgagttcaatattgtcaaataaggctacagtatttgcttttttgtgtgaatgtattgcatataatgttcaagtagatgattttacatttatggacatataaaatgtctgattaccccattttatcagtcctgactgtacaagattgttgcaatttcagaatagcagttttataaattgatttatcttttaatctataacaatttgtgttagctgttcatttcaggattatattttctacaagttccacttgtgggactccttttgttgcccctatttttttttaaagaaggaagaaagaaaaataagtagcagtttaaaaatgagaatggagagaaaagaaaaagaatgaaaaggaaaggcagtaaagagggaaaaaaaggaaggatggaaggaatgaaggaaggaagggaggaaggggagaaggtaggaagaaagaaaggatgagagggaaggaagaatcagagtattagggtagttaacttacacatttgcattcttagtttaactgcaagtggtgtaactacgtttttcaatgatcgcatttgaaacataagtcctattataccattaagttcctattatgcagcaattatataataaaaagtactgcccaagttatagtaatgtggggtgtctctgagacactaaaagatttgagagggagaatttcaaacttaaagccacttttgggggggtttataacttaactgaaaaattaatgcttcatcataacatttaagctatatctagaaagtagactggagaactg

SEQ ID NO: 7540 - DNA, 5878 bp, Homo sapiens
cacgttgtcatatagcagaatcagatatgaacttcagtctgtctgactccaatgtcagtgctttccccgatgcacctggctaccttttgattattgtcaagatcctggaagacacaaattagattttgatttaatcttttccatttctttccagctccaagtacagcccagtatggaattaccgggagcgctgatgttcttttctcctgctggtaccttgtgttgacactgtcctctttcaccagcatattctacctgaagaatgccattctacaataaattcaaagacccataaaaggcttttaaggattctctgaaagtgctgatggctggatccaatctggtacagtttgttaaaagcagcgtgggatataatcagcagtgcttacatggggatgatcgccttctgtagaattgctcattatgtaaatactttaattctactcttttttgattagctacattaccttgtgaagcagtacacattgtcctttttttaagacgtgaaagctctgaaattacttttagaggatattaattgtgatttcatgtttgtaatctacaacttttcaaaagcattcagtcatggtctgctaggttgcaggctgtagtttacaaaaacgaatattgcagtgaatatgtgattctttaaggctgcaatacaagcattcagttccctgtttcaataagagtcaatccacatttacaaagatgcatttttttcttttttgataaaaaagcaaataatattgccttcagattatttcttcaaaatataacacatatctagatttttctgctcgcatgatattcaggtttcaggaatgagccttgtaatataactggctgtgcagctctgcttctctttcctgtaagttcagcatgggtgtgccttcatacaataatatttttctctttgtctccaactaatataaaatgttttgctaaatcttacaatttgaaagtaaaaataaaccagagtgatcaagttaaaccatacactatctctaagtaacgaaggagctattggactgtaaaaatctcttcctgcactgacaatggggtttgagaattttgccccacactaactcagttcttgtgatgagagacaatttaataacagtatagtaaatataccatatgatttctttagttgtagctaaatgttagatccaccgtgggaaatcattccctttaaaatgacagcacagtccactcaaaggattgcctagcaatacagcatcttttcctttcactagtccaagccaaaaattttaagatgatttgtcagaaagggcacaaagtcctatcacctaatattacaagagttggtaagcgctcatcattaattttattttgtggcagctaagttagtatgacagaggcagtgctcctgtggacaggagcattttgcatattttccatctgaaagtatcactcagttgatagtctggaatgcatgttatatattttaaaacttccaaaatatattataacaaacattctatatcggtatgtagcagaccaatctctaaaatagctaattcttcaataaaatctttctatatagccatttcagtgcaaacaagtaaaatcaaaaaagaccatcctttatttttccttacatgatatatgtaagatgcgatcaaataaagacaaaacaccagtgatgagaatatcttaagataagtaattatcaaattattgtgaatgttaaattatttctactataaagaagcaaaactacatttttgaaggaaaatgctgttactctaacattaatttacaggaatagtttgatggtttcactctttactaaagaaaggccatcaccttgaaagccattttacaggtttgatgaagttaccaatttcagtacacctaaatttctacaaatagtccccttttacaagttgtaacaacaaagaccctataataaaattagatacaagaaattttgcagtggttatacatatttgagatatctagtatgttgccctagcagggatggcttaaaaactgtgattttttttcttcaagtaaaacttagtcccaaagtacatcataaatcaattttaattagaaaaatgaatcttaaatgaggggacataagtatactctttccacaaaatggcaataataaggcataaagctagtaaatctactaactgtaataaatgtatgacattattttgattgatacattaaaaaagagtttttagaacaaatatggcatttaactttattatttatttgcttttaagaaatattctttgtggaattgttgaataaactataaaatattattttgtattgcagctttaaagtggcacactccataataatctacttactagaaatagtggtgctaccacaaaaaatgttaaccatcagtaccattgtttgggagaaagaaacagatcaagaatgcatattattcagtgaccgctttcctagagttaaaatacctcctctttgtaaggtttgtaggtaaattgaggtataaactatggatgaaccaaataattagttcaaagtgttgtcatgattccaaatttgtggagtctggtgtttttaccatagaatgtgacagaagtacagtcatagctcagtagctatatgtatttgcctttatgttagaagagactttcttgagtgacatttttaaatagaggaggtattcactatgtttttctgtatcacagcagcattcctagtccttaggccctcggacagagtgaaatcatgagtatttatgagttcaatattgtcaaataaggctacagtatttgcttttttgtgtgaatgtattgcatataatgttcaagtagatgattttacatttatggacatataaaatgtctgattaccccattttatcagtcctgactgtacaagattgttgcaatttcagaatagcagttttataaattgatttatcttttaatctataacaatttgtgttagctgttcatttcaggattatattttctacaagttccacttgtgggactccttttgttgcccctatttttttttaaagaaggaagaaagaaaaataagtagcagtttaaaaatgagaatggagagaaaagaaaaagaatgaaaaggaaaggcagtaaagagggaaaaaaaggaaggatggaaggaatgaaggaaggaagggaggaaggggagaaggtaggaagaaagaaaggatgagagggaaggaagaatcagagtattagggtagttaacttacacatttgcattcttagtttaactgcaagtggtgtaactacgtttttcaatgatcgcatttgaaacataagtcctattataccattaagttcctattatgcagcaattatataataaaaagtactgcccaagttatagtaatgtgggtgtttttgagacactaaaagatttgagagggagaatttcaaacttaaagccacttttggggggtttataacttaactgaaaaattaatgcttcatcataacatttaagctatatctagaaagtagactggagaactgagaaaattacccaggtaattcagggaaaaaaaaaaatatatatatatataaatacccctacatttgaagtcagaaaactctgaaaaactgaattatcaaagtcaatcatctataatgatcaaatttactgaacaattgttaatttatccattgtgcttagctttgtgacacagccaaaagttacctatttaatcttttcaataaaaattgttttttgaaatccagaaatgatttaaaaagaggtcaggtttttaactatttattgaagtatgtggatgtacagtatttcaatagatatgaatatgaataaatggtatgccttaagattctttgaatatgtatttactttaaagactggaaaaagctcttcctgtcttttagtaaaacatccatatttcataacctgatgtaaaatatgttgtactgtttccaataggtgaatataaactcagtttatcaattaaaatatgtatttgactcattttaaaactctattagcttaagagaaagaaggaagaaataataatttgaagatatttctgctattctctttatttcctgtattacactcatctttctgcttactctaaagcagtacagggtaaaaattctagatgctacagtttcaaatgactccacactatattctttcttgctgttgctgattcctaaaaggtttgatgagctgaactacatctaaactaaaaataaattttctggaaacattttattattaattatttagaacctttacctggtaaaatacagcagagttagcaacagagactaaatatcctgttgataaaatcctgatgatcttacaggctaaacaactgaaaactcaaacgcttgtaagagccaggcagagtgtaatttcttaacagctgggtataaaacaacgggcacctgaaggtattcagatacaatttccttaaaaataccttggtttccaagcaaaacacgttatttggctgagaacctttagtttgtaaataccaaaccataatatacaaatgagatctcaagccaaatgaattttttaagccctctttcccatatctgttcatctatgatagtcaactgaataaatgagaacaatgtgatagataaaacaacaaagcataaaaaagattcatgcttggttttataagctattttgaaatataagtatcattgctattctgagaaatctatatacaccaaagccctccctccacaaaaaaactggaaatgttctaataaatgtctgatttcccccacagcttcattatttcttcccttttcaacatctatcttatctatcttgcataaattacatcacagaaacagaaacatcaagtatcagacatggaaaaccagcacatgaaacagagctagtttccctctcaaaagaatagggcaaaacatagatgcttcaaaatcatatcttggtatacagaaaataattattcactttaacctgacagtcagaaatgtaagtaagaatttgtagagataattttccaaggtaattcattcaagttagtggaatttgatccaaacacccgtcaatgtactccctctgaactttccaagaatcatacaccttcacatttacattcactgtttttctagtaattccaaacttactcaaaagtatttcagaattgatatcactggtggaaagagagcaatttagcaaacaaatacatgctttccggtattcctagagaaaaggaaaagaggaatacgtctcattcttctccctagaagctctacccacagtcatcctaaagctagaccaatctctcccagggctttccttcagtctaagaaacatgcttcatttcagagacaattgtggcaactatagttttccccaaagggtcacaactacctctcctttgcattttacaatggagcacttttgcaagcgttgctattgtggctttctcaacactttcaaatacttaaaggagaaaatattactattgtcatgtattgatggtgaaaacgagattcagaaattttgagtcacttgctgaagattatacttcaactaagtggcagatctgagccaaatatgcaatgaaaaatgttcccaatttgtttccagtcccagactacctaggaaaaagaaaagcatataatcacattgctagcttcatagacaactatttgcatatttttatttatatatttatataaatataagcacattttaaatataaatatagatatttatgacatccttgtattttccaatacctgcagagggtatgagatttaaaggctaatcagattgtacatgtcatctaaaactttggaaacgtgaaactcacagtacagttgcctttggacacacagccttgggt

SEQ ID NO: 7541 - DNA, 1465 bp, Homo sapiens
cacgagggagatcagtgtgaagggcattgccaaagtggaatcagtaaggcttggcagttgaccttgtttgttggagagaagggataagattttaaagctacatgtctgaaagaatgatgctgctgattgaaataaaggaagaaaggatgcatttcgggctccaacctgtcctaggaaggcctagacctcaaacaccatcacctccatgcatttcctctttggctactatgtcttttccctgacttctgcctctccagctctctgggctgctgcttccacctgttcatctgacttagaccctccctgctgggtccttgttcacctactcatttggtgcttcgtctgccatcagtacctccattgcagctggtgggatgtcagtcaccatctcttatatttgcttcccactagaaagatcaagagaagttatttctttcccttgcgctccaatttttctctagacagttggtatccacaattttaaaaaatgttccatgttgtataaacaagcattcgctgagaggggctgttaatacacatcgtgccccttttataaaaattcatgcatggaatcctacattattatgcatcaaaatctccagaaatgtcttaggatttttgcagggagaatattaaatgcattgttttgctttgttttgaagagactagatgtgcagaggaagagaggtggcatggtgggagggtacatttgagttgtcaacagtctctgcagtgtcaggtcaattacatcagcacttggactggaccagggaaaggaatgattctgcttcctgggaatgtcagaaggacctgatgattatatttggcaaagccaggaggagtggctttgaatgtcattgctaagaattacactttgagtagcatttctggatgtctgagcttttcaaatgatacttcttttctgctgtggctttcctttctgttggactggttcccagagggtcctcttgtttgtccttgccctcgcttttatatcagttcatgttttctcttctgtcatcttccttcccagcgctgtttctccaccccctcctgctgcactcacaacagcttcccctctcctgtttagaggtggaagcatgtaagaatgcgtttgagggggatgcttgccaaaggacagcatattcaacatctggtatcaacaaggtaatgtttaaccttagactagccaaactagtgatgacctgcttccatgctgcatctgctgctttttgtgttgatgggactcagaaatcatgagaaaggtcttcagtgatccatgactgcaacaaattcttttcctaattgtgccgtatattatgcccctcaatacaacttactaatctctgcctcagtttctccatctgtgaaagtggtgtaatacttatctacctcccttgaatgttgtgaagattagtatatgttggtaaagcacttttaaaataaagaatgatataaagcattg

SEQ ID NO: 7542 - DNA, 1465 bp, Homo sapiens
cacgagggagatcagtgtgaagggcattgccaaagtggaatcagtaaggcttggcagttgaccttgtttgttggagagaagggataagattttaaagctacatgtctgaaagaatgatgctgctgattgaaataaaggaagaaaggatgcatttcgggctccaacctgtcctaggaaggcctagacctcaaacaccatcacctccatgcattttctctttggctactatgtcttttccctgacttctgcctctccagctctctgggctgctgcttccacctgttcatctgacttagaccctccctgctgggtccttgttcacctactcatttggtgcttcgtctgccatcagtacctccattgcagctggtgggatgtcagtcaccatctcttatatttgcttcccactagaaagatcaagagaagttatttctttcccttgcgctccaatttttctctagacagttggtatccacaattttaaaaaatgttccatgttgtataaacaagcattcgctgagaggggctgttaatacacatcgtgccccttttataaaaattcatgcatggaatcctacattattatgcatcaaaatctccagaaatgtcttaggatttttgcagggagaatattaaatgcattgttttgctttgttttgaagagactagatgtgcagaggaagagaggtggcatggtgggagggtacatttgagttgtcaacagtctctgcagtgtcaggtcaattacatcagcacttggactggaccagggaaaggaatgattctgcttcctgggaatgtcagaaggacctgatgattatatttggcaaagccaggaggagtggctttgaatgtcattgctaagaattacactttgagtagcatttctggatgtctgagcttttcaaatgatacttcttttctgctgtggctttcctttctgttggactggttcccagagggtcctcttgtttgtccttgccctcgcttttatatcagttcatgttttctcttctgtcatcttccttcccagcgctgtttctccaccccctcctgctgcactcacaacagcttcccctctcctgtttagaggtggaagcatgtaagaatgcgtttgagggggatgcttgccaaaggacagcatattcaacatctggtatcaacaaggtaatgtttaaccttagactagccaaactagtgatgacctgcttccatgctgcatctgctgctttttgtgttgatgggactcagaaatcatgagaaaggtcttcagtgatccatgactgcaacaaattcttttcctaattgtgccgtatattatgcccctcaatacaacttactaatctctgcctcagtttctccatctgtgaaagtggtgtaatacttatctacctcccttgaatgttgtgaagattagtatatgttggtaaagcacttttaaaataaagaatgatataaagcattg

SEQ ID NO: 7543 - DNA, 1464 bp, Homo sapiens
cacgagggagatcagtgtgaagggcattgccaaagtggaatcagtaaggcttggcagttgaccttgtttgttggagagaagggataagattttaaagctacatgtctgaaagaatgatgctgctgattgaaataaaggaagaaaggatgcatttcgggctccaacctgtctaggaaggcttagacctcaaacaccatcacctccatgcatttcctctttggctactatgtcttttccctgacttctgcctctccagctctctgggctgctgcttccacctgttcatctgacttagaccctccctgctgggtccttgttcacctactcatttggtgcttcgtctgccatcagtacctccattgcagctggtgggatgtcagtcaccatctcttatatttgcttcccactagaaagatcaagagaagttatttctttcccttgcgctccaatttttctctagacagttggtatccacaattttaaaaaatgttccatgttgtataaacaagcattcgctgagaggggctgttaatacacatcgtgccccttttataaaaattcatgcatggaatcctacattattatgcatcaaaatctccagaaatgtcttaggatttttgcagggagaatattaaatgcattgttttgctttgttttgaagagactagatgtgcagaggaagagaggtggcatggtgggagggtacatttgagttgtcaacagtctctgcagtgtcaggtcaattacatcagcacttggactggaccagggtaaggaatgattctgcttcctgggaatgtcagaaggacctgatgattatatttggcaaagccaggaggagtggctttgaatgtcattgctaagaattacactttgagtagcatttctggatgtctgagcttttcaaatgatacttcttttctgctgtggctttcctttctgttggactggttcccagagggtcctcttgtttgtccttgccctcgcttttatatcagttcatgttttctcttctgtcatcttccttcccagcgctgtttctccaccccctcctgctgcactcacaacagcttcccctctcctgtttagaggtggaagcatgtaagaatgcgtttgagggggatgcttgccaaaggacagcatattcaacatctggtatcaacaaggtaatgtttaaccttagactagccaaactagtgatgacctgcttccatgctgcatctgctgctttttgtgttgatgggactcagaaatcatgagaaaggtcttcagtgatccatgactgcaacaaattcttttcctaattgtgccgtatattatgcccctcaatacaacttactaatctctgcctcagtttctccatctgtgaaagtggtgtaatacttatctacctcccttgaatgttgtgaagattagtatatgttggtaaagcacttttaaaataaagaatgatataaagcattg

SEQ ID NO: 7544 - DNA, 565 bp, Homo sapiens
agcctgtgaagactagtcttctttgaaagaaaagatccttttgtaaggatttatgttcttaatttagtttttaccaaatggacccttttagagaaagaagcatcaggataaagtcccaatcttcagtggtttgtggaagagagaatctgatgattcatgccctcctaccctgttagaattaggacagggaatggcagaccctaaacatacatgtgaactgagcaaagattgcctttgcttcacctattgacacatttaagaacctcgttttatagagagtacggagtggggtctgagattctacatttcttacaagttcctggtttatgccagttctgtttgtctggtcaccacacttctgaatagcaaggtttcagaggactctatgaagtttttatttctcaaaaatttggcttaggtacatctttacatacagtggtgctagatattattctttcagaacttaaccatgcaacaatgcagaagaatacaaaaaatgcttgcacacagtagtgtattttaatggaactataaaagcattgaactgattcctaactttacatat

SEQ ID NO: 7545 - DNA, 565 bp, Homo sapiens; identical to SEQ ID NO: 7544

SEQ ID NO: 7546 - DNA, 240 bp, Homo sapiens
gatcacgaggtcaggagatcgagaccatcctggctaacacggtgaaaccccatctctaactaaaaatacaaaaaattacccgggcgtggtggcgggcacctgtagtcccagctactcgggaggctgaggcaggagaatggtgtgaacccaggagacggagcttgcaatgagccgagatcgcgccactgcactctagcctgggcgacagagcaagactccgtctcaaaaacaaaaaaaaaa

SEQ ID NO: 7547 - DNA, 1275 bp, Homo sapiens
cagaattcctttctcatatttcaagtgtccctgtgaattatgaggggaaaaaaatctttattaaagaaaaaagtgaaaataaatatgcatggatacttggatttttcttttagtaacaaagatatttaaattatttgtatacacacacacacacacacacacacacacacacacgtatctgtacctagaaatgtttataggggaggtcagttttctgaagattaaatgcagccctaatgtcagattaatgttataaacacatcgtttaatcacaagttttcagagagcaggctccacagatagtctctaactttctatcattacaaatcgctatttttatatcattgctaatttaaataataaagtaaattatgaagaggaatcattggttgcaagtcaccatgggagtttagtccctgtgaaaatataaagcatttaaataatttgtattcttttaccattttttattacatctctttaatttttgtcacttgaatatattaggatgatgatgatactataatcactggaacaaagacatttgcttggacatcttttcttttttcccccatttttgttctgttaataatttttaactatagcttttcctttcttgtccttatctgtcccttatcgatcatagatagtttcactactatttttaagtttttattgttaaattgaagatgaatctgtacagttacttgtgaattaagatgcagctaagttaaaatcaagtataattttgaagctgattttacatttaactagatgattaaatatattttttcaggtgcttcttcaatttaaatcaagttttatggtttcagcaaaatttagaaaatatgtactttacctaaaaacttttcttttagtgctttggatatatacagaagcttaaatgagtagagtatcccaaacatccagatgcttctcaaaatagcatttccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatagcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaaa

SEQ ID NO: 7548 - DNA, 242 bp, Homo sapiens
tcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaggc

SEQ ID NO: 7549 - DNA, 90 bp, Homo sapiens
gatcgcgccactgcactccagcctgggcggcagagagagactccgtctcaaaaaaaaaaaaaaaaaaaaaaaaaaaaaaaaaaaaaaaaa

SEQ ID NO: 7550 - DNA, 181 bp, Homo sapiens
aattagccgggcgtggtggcaggcgcctgtagtcccagctacttgggaggctgaggcaggagaatggcgtgaaccagggaggcggagcttgcagtgagctgagatcgcgccactgcactccagcctgggcgacagggcaagactccgtctcaaaaaaaaaaaaaaaaaaaaaaaaattgtg

SEQ ID NO: 7551 - DNA, 142 bp, Homo sapiens
cgggcgcctgtagtcccagctactcgggaggctgaggcaggagaatggcgtgaacccaggaggtggagcttgcagtgagccgagattgtgccactgaactccagcctgggcgacagagcgagactctgtctcaaaaaaacaa

SEQ ID NO: 7552 - DNA, 295 bp, Homo sapiens
ggccgggtgcagtggctcacacctgtaatcccagcactttgggaggctgaggtgggcagagcacgaggtcaggagatcgagaccatcctggctaacacggtgaaaccccatctctactaaaaatacaaaaaattagccaggcgtggtggcgggtgcctgtagtcccagctactcgggaggctgaggccagagaatggcgtgaacccgggaggcggagcttccagtgagccgagatcatgccactgcactccagcctgggcaacagagcgagactccgtctcaaaaaacaaaacaa

SEQ ID NO: 7553 - DNA, 319 bp, Homo sapiens
tttggccgggcgcggtggctcacgcctgtaatcccagcactttgggaggcagaggcgggcggatcatgaggtcaggagatcgagaccatcctggctaacacagtgaaaccccgcctctactaaaaatacaaaaaattagccgggcgtggtggcgggcgcctgtagtcccagctactcgggaggctgaggcgggagaatggcgtgaacccgggaggcggagcttgcagtgagccgagatcgcgccactgcactccagcctgggcgacagagcgagactccgtctcaaaaaaaaaaaagaaaaaaaaaaaaaagagcacaa

SEQ ID NO: 7554 - DNA, 316 bp, Homo sapiens; identical to SEQ ID NO: 6716

SEQ ID NO: 7555 - DNA, 102 bp, Homo sapiens; identical to SEQ ID NO: 6331

SEQ ID NO: 7556 - DNA, 322 bp, Homo sapiens
taattacaaaaaaatcggccaggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagccacttgggaggctgaggcaggagaatggcgtgaacccgggaggcggagcttgcagcgagccgagatcccgccactgcactccagcctgggcgacagagcgagactccatctcaaaaaaaaaaaaaaaaaaaaaaaaa

SEQ ID NO: 7557 - DNA, 286 bp, Homo sapiens
cactttgggaggcccaggcgggcggatcccgaggtcaggagatccagaccatcctggctaacacggtgaaaccccgtctctactaaaaataccaaaaattagcccggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaagaaaagaaaaaaaaaaaaaaaga

SEQ ID NO: 7558 - DNA, 305 bp, Homo sapiens
gggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagaaa

SEQ ID NO: 7559 - DNA, 284 bp, Homo sapiens
gctcacacctgtaatcccacactttgggaggccaaggtgggcagatcacgaggtcaggagatcgagaccatcctggccaacacggtgaaaccccatctctactaaaaatacaaaaaattagccgggcgtggtggcaggcacctgtagtcccaactacttgggaggctgaggcaggagaacagcgtgtacccaggaggcggagcttgcagtgagccaagattgcgccactgcactccagcctgggcgacagagggagactccgtctcaaaaaaaaaaaaaaaaga

SEQ ID NO: 7560 - DNA, 316 bp, Homo sapiens
aatttgttcaattcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaatttg

SEQ ID NO: 7561 - DNA, 283 bp, Homo sapiens
cgcctgtaatcccagcactttggaaggccgaggcggccggatcacgaggtcaggagatcaagaccatcctggctaacacggtgaaaccccgtctctactaaaaatacaaaaaattagccaggcgtggtggcgggggcctgtagtcccagctactcgggagactgaggcaggagaatggcgtgaacccgggaggtggagcctgcagtgagccgagatcgcgccactgcactccagcctgggcgacagagccagactccatctcaaaaaaaaaaaaaaaaaaaaa

SEQ ID NO: 7562 - DNA, 93 bp, Homo sapiens
aggcggagtttgcagtgaccggagatcgcgccactgcactccagcctgggtgacagagcaagactctgtctcaaaaaaaaaaaaaaaaaaaaa

SEQ ID NO: 7563 - DNA, 293 bp, Homo sapiens; identical to SEQ ID NO: 6719

SEQ ID NO: 7564 - DNA, 295 bp, Homo sapiens
gtggctcatgcctgtaatcccagcactttgggaggctgaggcgggcggatcacaaggtcaggagattgagaccatcctggctaatatggtgaaaccccgtctctactaaaaatacaaaaaaattagccgggcgtggtggcacacgcctgtaatcccagctacttaggaggctgaggcaggagaatggtgtgaacccgggaggcggagcttgcagtgagccgagttcgggccactgcactccggcctgggcaacagagcgagactccgtctcaaaaaaaaaaaaaaaaaaaaaaaa

SEQ ID NO: 7565 - DNA, 170 bp, Homo sapiens
tcgggcgcctgtagtcccagctacttgggaggctgaggcaggagaatggcgtgaacccgggaggcggagcttgcagtgagccgagatcccgccactgcactccagcctgggcgacagagcgagactccgtctcacaaaataaaaaaaaaataaaataaaataaaataaaa

SEQ ID NO: 7566 - DNA, 109 bp, Homo sapiens
ggcgtgaacccaggaggcggagcttgcagtgagatgagatcgcgccactgcactccagcctgggcgacagagcaagactccatctcaaaaaaaaaaaaaaaaaaaggac

SEQ ID NO: 7567 - DNA, 263 bp, Homo sapiens
cccagcactttgggaggctgaggcaggcggatcacgaggtgaggagatcgagaccatcctggctaacacagtgaaaccccatctctactaaaaatacaaaaaattatccaggcgtggtggcgggcacctgtggtcccagctacttgggaggctgaggcaggagaatggcgtgaacctgggaggcggagcttgcagtgagccgagatggcgccactgcaccccagcctgggtgacagagcgagacacggtctcaaaaaaaaaaa

SEQ ID NO: 7568 - DNA, 300 bp, Homo sapiens
agcgcggtggctcacgcttgtaatcccagcactttgggaggccaaggcgggaggatcatgaggtcaggagatccggaccatcctggctaacatggtgaaaccccgtctctactaaaaatacaaaaaaattagccaggcgtggtggctggcgcctgtagtcccagctactcgggaggctgaggcaggagaatggcgtgaacccgggaggcggagcttgcagtgagccgagatcgcgccactgcactccagcctgggcgacagagcaagactccgtctcaaaaaaaaaaaaaaagtgcaaac

SEQ ID NO: 7569 - DNA, 226 bp, Homo sapiens
gagaccatcctggctaacacagtgaaaccctgtctctactaaaaatacaaaaaattagccgggcgtggtggcgggcgcctgtagtcccagctactcaggaggctgagacaggagaatggcgtgaacccgggaggcggagcttgcagtgagccgagatcgcgccactgcactccagcctgggccacagagtgaaactcagtctcaaaaaaacaaacaaacaaacaaa

SEQ ID NO: 7570 - DNA, 306 bp, Homo sapiens
tttaggccgggcgcgggggctcacgcctgtaatcccagcactttgggaggccgaggcgggcggatcacgaggtcaggagatcgagaccatcccggctaaaacggtgaaacccgtctctactaaaaatacaaaaaattagccgggcgtagtggcgggcgcctgtagtcccagctacttgggaggctgaggcaggagaatggcgtgaacccgggaggcggagcttgcagtgagcggagatcccgccactgcactccagcctgggcggcagagcgagactccgtctcaaaaaaaaaaaataataataat

SEQ ID NO: 7571 - DNA, 294 bp, Homo sapiens
gcgcggtggctcacgcctgtaatcccagcactttgggaggctgaggcgggcggatcacgaggtcaggagatcgagaccatcctggctaacacggtgaaaccccatctctactaaaaatacaaaaaattagccgggcgaggtggcgggtgcctgtagtcccagctactcgggaggctgaggcaggagaatggcgtgaacccgggaagcggagcttgcagtgagccgagattgcgccattgcactccagcctgggtgacagcgagactccgtctcaaaaaaaaaaaaaaaagaagt

SEQ ID NO: 7572 - DNA, 184 bp, Homo sapiens
cgtggtggcgggcgcctgtagtcccagctactcgggaggctgaggcaggagaatggcgtgaacctgggaggcggagcttgcagtgagccgagatcgcgccactgcactccagcctgggcgacagagcgagagtccgtctcaaaaaaaaaaaaaaaaaagaaaagaaaaaagaacaaacaacagc

SEQ ID NO: 7573 - DNA, 305 bp, Homo sapiens
tggctaggcacggtggctcacgcctggagtcccagcactttgggaggccgaggcgggcagatcacgaggtcaggagatcgagaccatcctggctaacacggtgaaaccctgtctctactaaaaatacaaaaaattagccaggcgtggtgtcgggcgcctgtaatcccagctactcgggaggctgaggcaggagaatggcatgaacccgggaggcggagcttgcagtgagcggagatggcaccactgcactccagcctgggcaacagagcgagactccgtcccaaaaaaaaaaaaaaaaaaaaaca

SEQ ID NO: 7574 - DNA, 258 bp, Homo sapiens
ccgaggcgggcggatcacgaggtcaggagatcgagaccatcctggctaacacggtgaaaccccgtctctactaaaaaaaacaaaaaattagccaggcgtgtggcggcaccctgcagtcccagctacttgggaggctgaggcaagagaatggcgtgaacccggaaggcggagcttgcagtgagccgagatcgcgccactgcactccagcctgggcgacagagcgagctccgtctcaaaaaaaaaaagaataaaaatgga

SEQ ID NO: 7575 - DNA, 299 bp, Homo sapiens
  misc_feature (18)..(18): n equals a,t,g, or c
  misc_feature (27)..(27): n equals a,t,g, or c
taatcccagcactttggnaggccgagncgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccggaaggcggagcttgcagtgagccgagatcccgccactgcactccagcttgggcgacagagcgagactccgtctcaaaaaaaaaaaaaaaaacaaaacaaacaaacaaaaaaaaacaa

SEQ ID NO: 7576 - DNA, 147 bp, Homo sapiens; identical to SEQ ID NO: 6794

SEQ ID NO: 7577 - DNA, 312 bp, Homo sapiens
acaccaggccgggcacggtggctcatgcctgtaatcccagcactttgggaggccgagacgggcggatcacgaggtcaggagatcaagaccaacctggctaacacggtgaaaccccgtctctactaaaaatacaaaaaattagccgggcgtggtggcggtttgccttttgtcccagctactcgggaggctgaggcaagacaatggcgtgaccctgggaggcggagcttgcagtgagctgagatcgcgccactgcactccaccctgggtgacagagcgagactccgtctcaaaaaaaaaaaaaaaaaaaaaaaa

SEQ ID NO: 7578 - DNA, 169 bp, Homo sapiens
aaaattagccaggcgtgatggtgggtgcctgtagtcccagctacttgggaggctgaggcaggagaatggcgtgaacccaggaggtggagcttgcagtgagctgagatcgcgccactgcactccagcctgggcgacagagtgagactccatctcaaaaaaaaaaaaaaga

SEQ ID NO: 7579 - DNA, 278 bp, Homo sapiens
cccacactttgggaggccgaggcaggcagatcacgaggtcaggagatcgagaccatcttggctaacatggtgaaaccccgtctctactaaacaaaatacaaaaaattagccgggcgtgatggcgggcgcctgtggtcccagctactcgggaggctgaggcaggagaatggcatgaacccgggaggcagagcttgcagtgagccgagatcgcgccactgcactccagcctgggtgacagagtgagactccgtctcaaaaaaaaaaaaaaaaaaaaaaaa

SEQ ID NO: 7580 - DNA, 316 bp, Homo sapiens
tcagccggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtggtcccagctacttgggaggctgaggcaggagaatggcgtgaacccgggaggcggagcttgcagtgagccgagatcccgccactgcactccagcctgggcgacagagcgagactccgtctcaaaaaaaaataaaataaaataaaaaaaaagaata

SEQ ID NO: 7581 - DNA, 293 bp, Homo sapiens
tggctcacgcctgtaatcccagcactttgggaggccaaggcgggcagatcatgaggtcaggaaatcgagaccatcctggttaacaaggtaaaaccccgtctctactaaaaatacaaaaaattagccaggtgtggtggcgggcgcctgtaatctcagctacttgggaggctgaggcaggagaacggcgtgaacctgggaggcggagcttgcagtgagccgagattgcgccactgcactccagcctgggggacagaccgagactctgtctcaaaaaaaaaaaaaaaaaaaaaaaa

SEQ ID NO: 7582 - DNA, 207 bp, Homo sapiens
attaaaaccccatctctactaaaaatacaaaaaattagctgggcgtgggtggcaggcgcctgtagtcccagctactctggaggctgaggcaggagaatggcatgaacctgggaggcggagcttgcagtgagccgagattgcgccactgcactccagcctgggtgacagagcgagactctgtctcaaaaaaaaaaaaaaaaagaaata

SEQ ID NO: 7583 - DNA, 131 bp, Homo sapiens; identical to SEQ ID NO: 6213

SEQ ID NO: 7584 - DNA, 188 bp, Homo sapiens
ttaaaaatacaaaaaattagctgggcgtggtggcgggtgctgtagtcccagctactcaggaggctgaggcaggagaatggcgtgaacccaggaggcggagattgcagtgagccgagatcgcaccactgcactccagcctgggcaacagagcgagactccgtctcaaaaaaagaaaaaaaaaagaaagt

SEQ ID NO: 7585 - DNA, 241 bp, Homo sapiens
ggcggatcacgaggtcaggagattgagatcatcctggctaacacggtgaaaccccgtctctactaaaaaatacaaaaaattagccgggcgtggtggtgggcgcctgtagtcccagctacttgggaggctgaggcaggagaatggtgtgaacccgggaggcagagcttgcagtgagctgagatcatgccactgcactgtagccagggtgacagagtgagactccatctcaaaaaaaaaaaaa

SEQ ID NO: 7586 - DNA, 160 bp, Homo sapiens
  misc_feature (30)..(30): n equals a,t,g, or c
  misc_feature (82)..(82): n equals a,t,g, or c
ggtgggcgcctgtagtcccagctactcggnaggctgaggcaggagaatggcgtgaacccaggaggcggagcttgcagtgagntgagatcgcgccccctgcactccagcctgggtgacagagcgagactctgtctcaaaaaaaaaaaaaaaaaaaaaaagt

SEQ ID NO: 7587 - DNA, 227 bp, Homo sapiens
taagaccatcctggctaacacggtgaaaccccgtctctactaaaaatacaaaaattagccaggcgtggtggcgggcgcctgtagtcccagctacttgggaggctgaggcaggagaatggcatgaacccgggaggtggagcttgcagtgagctgagatcgcgccactgcactccagcctgggcaacagagcgagactctgtctcaaaaaaaaaaaaaaaaatcaagta

SEQ ID NO: 7588 - DNA, 68 bp, Homo sapiens
  misc_feature (28)..(28): n equals a,t,g, or c
cgcgccactgcactccagcctgggcgancagagcaagactccatctcaaaaagaaaaaaaaaaaaaaa

SEQ ID NO: 7589 - DNA, 235 bp, Homo sapiens
  misc_feature (230)..(230): n equals a,t,g, or c
agatggagcccatcctggctaacacggtgaaaccccgtctttactaaaaatacaaaaaattagccgggcgtggtggcggacgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaanaataa

SEQ ID NO: 7590 - DNA, 268 bp, Homo sapiens
ttgcgggggcccaggcaggcggatcacgaggtcaggagattgagaccatcctggctaacacggtgaaaccccgtctctactaaaaatacaaaaagattagctgggcgtggtggcgggcgcctgtagtcccagctacttgggagactgaggcagaagaacggcgtgaatctgggaggcggagcttgcagtgagccgagatcacaccacagcactccagcttgggcgacagagcgagactccgtctcaaaaaaaaaaaaaaaaaaaaaga

SEQ ID NO: 7591 - DNA, 127 bp, Homo sapiens; identical to SEQ ID NO: 6580

SEQ ID NO: 7592 - DNA, 187 bp, Homo sapiens
cccatctctactaaaaatacaaaaaattagccaggcgtggtggcgggcgcctgtagtcccagctacttgggaggctgaggcaggagaatggtgtgaacccgggaggcggagcttgcagtgagccgagatcgcgccactgcgctccagcctgggcgacagagcgaaactccgtctaaaaaaaaaaaaa

SEQ ID NO: 7593 - DNA, 298 bp, Homo sapiens
gcggggctcacgcctgtaatcccagcactttgggaggctgaggcgggcagatcacaaggtcaggagatcgagaccatcctggctaacatggtgaaaccccatctctactaaaaatacaaaaaattagccgggcgtggtggcgggcccctgtagtcccagctatttgggaggctgaggcaggagaatggagtgaatccgggaggcagagcttgcagtgagctgagatcgtgccactgcattccagcctaggcgacagagccagactctgtctcaaaaaaaaaaaaaaaaaaaaaaaatt

SEQ ID NO: 7594 - DNA, 44 bp, Homo sapiens
gcaaaactccgtctcaaaaaaaaaaaaaaaaaaaaaaaaaaaga

SEQ ID NO: 7595 - DNA, 220 bp, Homo sapiens
taacacagtgaaaccccgtctctactaaaaatacaaaaattagccgggcctggtggtgggcgcctgtagtcccagctgctggggaggctgaggcaggagaatggcgtgaacccgggaggcggagcttgcagtgagccgagatggcgccactgcactccagcctgggcgacagagcgagactccttctcaaaaaaaaaaaaaaaaaaaaaaaagagagaaa

SEQ ID NO: 7596 - DNA, 306 bp, Homo sapiens
ccttccggctgggcacagtggcttacgcctgtaatcccagcactttgggaggccgaggcaggcggatcacgaggtcaggagatcgagaccatcctggctaacacggtgaaaccccgtctctactaaaaatacaaaaaattagctgggcgtggtggcaggcgcctgtagtcccagctactcaggaggctgaggcaggagaatggcatgaatccgggaggcagagcttgccgtgagctgagatcgtgccactgcactccagcctgggcgagagagcaagactccgtctcaaaaaaaaaaaaaaaagaa

SEQ ID NO: 7597 - DNA, 143 bp, Homo sapiens
gtagtcccagctactggggaggctgaggcaggagaatggcgtgaacctgggaggcggagcttgcagtgagccgagatcgcgccactgcactccagcctgggcgacagagcgagactccgtctcaaaaaaaaaaaaaagaaatg

SEQ ID NO: 7598 - DNA, 170 bp, Homo sapiens
gccgggcgtggtagcgggcgcctgtagtcccagctactcgggaggctgaggcaggagaatggcgtgaacccgggaggcggagcttgcagtgagccgagatctcgccactgcactccagcctgggcgacagagcgagactccgtctcaaaaaaaaaaaaaaaaaaagactg

SEQ ID NO: 7599 - DNA, 271 bp, Homo sapiens
cactttgggaggctgaggcgggcggatcacgaggtcaggaaatcgagtccatcctggctaacatggtgaaaccccgtctctactaaaaatacaaaaaattagccgggcgtgctggtgggcgtctgtagtcccagctactcaggaggctgaggcaggagaatggcgtgaacccgggaggcggaggttgcagtgagctgagatcgcgccacagcaactccagcctgggcgacagagcgagactctgtctcaaaaaaaaaaaaaaaaaagaaaa

SEQ ID NO: 7600 - DNA, 98 bp, Homo sapiens
cggagcttgcagtgagccgagatcgcgccactgcactccagcctgggcgacagagcgagactccgtctcaaaaaaaaaaaaaagaaaaccaagttaga

SEQ ID NO: 7601 - DNA, 296 bp, Homo sapiens
gcctgtaatcccagcactttgggaggctgaggcgggcggatcacgaggtcaggagatcgagatcattctggctaacatggtgaaaccccgtctctactaaaaatacaaaaaaaattagccgggcgtggtagcgggcgcctgtagtcccagctactcgggaggctgaggcaggagaatggcgtgaacccgggaggcgcagcttgcagtgagccaagacagcgccactgcagcccagcctgggcgaaagagcaagactctgtctcaaaaaaaaaaaaaaaaaaaaaaaaggaaggaaa

SEQ ID NO: 7602 - DNA, 135 bp, Homo sapiens
agactgagcaggagaatggcgtgaacccgggaggcggagcttgcagtgagcagagattgtgccactgcactccagcctgggtgacagagggagattctgtctcaaaaaaaaaaaaaaaaaaaaaaaaaaagaatc

SEQ ID NO: 7603 - DNA, 171 bp, Homo sapiens
aaaaaattagccgggtgtggtggcgggcgcctgtagtcccagctgctggggaggctgaggcaggagaatggcgtgaacccgggaggcggagcttgcagtgagccgagatcccgccactgcactccagcctgggtgacagagcgagactccatctcaaaaaaaaaaaaaaaa

SEQ ID NO: 7604 - DNA, 184 bp, Homo sapiens
aaatacaaaaaattagccaggcgtggtggcgggtgcctgtagtcccagctactcgggaggctgaggcaggagaatggcatgaacctgggaggcggagcttgcagtgagctgagatcgtgccactgcactccagcctgggcaacagagcaagaccccgtctcaaaaaaaaaaaaaaaaaaaggaa

SEQ ID NO: 7605 - DNA, 125 bp, Homo sapiens
ctgaggcaggagaatggcgtgaacccgggaggcggagcttgcagtgagccgagatggcgccactgcagtccagcctgggcgatagagcgagactctgtctcaaaaaaaaaaaaaaaaaaaaaatt

SEQ ID NO: 7606 - DNA, 196 bp, Homo sapiens
  misc_feature (106)..(106): n equals a,t,g, or c
tctactaaaaatacaaaaaattagccgggcgtagtggcgggcgcctgtagtcccagctacttgggaggctgaggcaggagaatggcgtgaacccgggaggcggacntgcagtgagccgagatcccgccactgcactccagcctgggcgacagagcgagactccgtctcaaaaaaaaaaaaaaaaaaaaaagaaata

SEQ ID NO: 7607 - DNA, 183 bp, Homo sapiens; identical to SEQ ID NO: 7394

SEQ ID NO: 7608 - DNA, 105 bp, Homo sapiens
ctggaacctgggaggcagagtttgcagtgagccgagatcaggccactgcactccagcctgggcaacagagcaagactctgtctcaaaaaaaaaaaaaaaaaaaag

SEQ ID NO: 7609 - DNA, 319 bp, Homo sapiens
aagaatagaaatcaggccgggcgcggtggctcacgcctgtaatcccagcactttgggaggccgaggccggcggatcacaaggtcaggagatcgagaccatcctggctaacatggtgaaaccccgtctgtactaaacatacaaaaagttagccgggcatggtggcgggcacctgccgtcccagctacttgggaggctgaggcaggagaatggcgtgaacccgggaggcggagcttgcagtgagccgagatggcgccactgcactccagcctgggcgacagagcgagactccgtctcaaaaagaaaaagaatagaaatcta

SEQ ID NO: 7610 - DNA, 307 bp, Homo sapiens
gggccgggcgcggtggctcacgcctgtaatcccagcactttgtgaggctgaagcgggctgatcacgaggtcaggagattgagaccatcctggctaaaacggggaaacccggtctctactaaaaatacaaaaaaattagccgggcatggcggcgggcacctgtagtcccagctacttgggaggctgagacaggagaatggcatgaacccgggaggcggagcttgcagtgagcctaaatcgcgccgctgtactccagcttgggcgacagagcgagactccgtctcaaaaaaaaaaaaaaaaaaaaaaaa

SEQ ID NO: 7611 - DNA, 311 bp, Homo sapiens
acattggttaggccgggcgcggtgcctcacacctgtaatcccagcactttgggaggccgaggcgggcggatcacgaggtcaggagatcgagaccatcctggctaacacggtgaaaccccgtctctactaaaaatacaaaaaattagctgggcatggtgacgggcgcttgtagccccagctactcgggaggctgaggcaggagaatggcgtgaacctgggaggcagagcttgcagtgagcagagatcacgccactgcactccagcctgggcgacagagcgagactccatctcaaaaaaaaagaagaaataca

SEQ ID NO: 7612 - DNA, 300 bp, Homo sapiens; identical to SEQ ID NO: 6727

SEQ ID NO: 7613 - DNA, 175 bp, Homo sapiens
cgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaatcac

SEQ ID NO: 7614 - DNA, 196 bp, Homo sapiens
tctactgaaaatacagaaaaattagccgggcgtggtagcgggcgcctgtagtcccagctactcgggaggctgaggcaggagaatggcgtgaacccgggaggcggagcttgcagtgagccgagatcgcgccactgcactccagactgggcgacagagcgagactccgtctcaaaaaaaaaaaaaaaaaaaaaatgac

SEQ ID NO: 7615 - DNA, 277 bp, Homo sapiens
tgtaatcccagcactttgggaggccgaggcgggcggatcacgaggtcaggagatccagaccagcctggctaacatggtgaaaccccgtctctactaaaaatacaaataattagcctggcgtggtggtgggcacctgtagtcccagctactggggaggtgaggcaggagaatggcgtgaacccgggaggcggagcttgcagtgagccgagatcgcaccactgcactccagtctgggcgacagagcgagacaccgtcaaaaaaaaaaaaaaaaaaaaga

SEQ ID NO: 7616 - DNA, 159 bp, Homo sapiens
ctgtggtcccagctactcgggaggctgagggaggagaatggcgtgaacccaggaggcagagcttgcagtgagccgagatcgcgccactgcactccagcctgggtgacagagcgagactccgtctcaaaaaaaaaaaaaaagaaaagaaaaagaaaaata

SEQ ID NO: 7617 - DNA, 296 bp, Homo sapiens
gggtgcggtggctcatgcctgtaatcccagcactttgggaggccaaggcaggcggatcacgaggtcaggagatcaagaccatcctggctaacacggtgaaaccccgtctctactaaaaatacaaaaaattagctgggtgtggtggtgggtgcctgtagtcccagctactcgggaggctgaggcaggagaatggcatgaacccgggaggcagagcttacagtgagcctagattgcgccactgcactccagcctgggcaacagagcgagactccatctcaaaaaaaaaaaaaaaaagg

SEQ ID NO: 7618 - DNA, 219 bp, Homo sapiens
catcctggctaacacagtgaaaccccgtctctactaaaaatacaaaaaattagctgggcgtgctggtgggtgcctgtagtcccagctactcgggaggctgaggcaggagaatggcgtgaacccaggaggcggagcttgcagagagccgagatctcgccactgcactccagcctgggcgacagagcgagactccgtctcaaaaaaaaaagaaaaaagaaa

SEQ ID NO: 7619 - DNA, 301 bp, Homo sapiens
gccgggcgcggtggctcaagcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggtgacagagtgaaactccgtctcaaaaaaaaaaaaaaaagagaat

SEQ ID NO: 7620 - DNA, 154 bp, Homo sapiens
tggtagtcccagctactcggtaggctgaggcaggagaatggcttgaacccggtaggcggagcttgcagtgagccgagatcacgccactgcactccagcctgggccacagagcgagactccgtctcaaaaaaaaaaaaaaaaaagaaagaaattg

SEQ ID NO: 7621 - DNA, 2548 bp, Homo sapiens
agcttgcaaatggccgggcgcggtggctcacccctgtaatcccagcactttgggaggccaaggcgggcggatcacgaggtcaggagatcgagaccatcctggctaacacggtgaaaccccgtctctactaaaaatacaaaaaattagctggccatagtggcgggtgcctgtagtcccagctactcgggaggctgaggcaggagaatggcgtgaacccgggaggcggagcttgcagtgagccgagactgtgcccctgcactccagcctgggcgacagagagagactccgtctcaaaaaaaaaaaaagcttgcaaacgcagaaaagaatgaaaaacaatgaagatggtaaatatgtttataaacctgaattgatgctggctgcataaagcaataataataacatgaggttggaaatgaaattaaaacgtataacaacaatgacgtaaaagccaagacagtaaatggagtaaaagtgttccaaggttcttgcactatcctggaagaagataaattcctattagacttaaataagtcaagggtggatatagtaatccctgtagtattactaaaagaatagtgaaagggtgcataatttccaagccggtagagaaaaaatgtagaaaagttaaaaatatattatcaattcaaaagaaggcaagaaaggagagaaaagggaatatagagcacataaagagtgctctttcagcatacaaacatgctctggtatctctcactcttaaaattcttccttggcctattatttcttttcatactccacctcatttctctgctttccttcatagcgaaacttctagaaacagttgcccccaaaatgctatttctgctccctcaatctgttcactcccaccctattccaatataactttcctctctaccattccacaaagtcttctcacgtcaaagccactgatgatgactgaggatgactgaggagacaaatacaaagcatttagggctgggcgcggtggcttacgcctgtaatccagcactttggaaggccgaggcaggtggatcatgaggtcaggagctcaagaccagcctagccaacatggtgaaactccgtctctactaaaaatacaaaaattagccgggcatggtggcatgcgcctgtaatcccagctaccttgggaggctgaggccagagaatagcttgaacctgggaggcagaggttgcagtgagccaagttcatgccactgcactccagcctgggcaacagagcaagactccgtctcaaaaaaaaaaaaagaaagaacttaataaaattatagattcagactgaaatataccaatagttacagtgaatataaatggaaaagaaattctccagttaaaatacaagaattagtagacaggtttaaaaaacaaacaacatgctatttaccagagacagaggtaaggcataaggatacagtaaggcataaggatacaggtaaggcataaggatatggaaaaaaggatacagtaaaaggactgagaaatataaaattggaagactctaaaagaaagctgatatagctgtattttatatatatatgtgtgtatatatacgtgtatatatatgtatatatatagtgtgtgtatatatatatataaaataaaaggttggtttcctccttccttttaaagtatataattcaattttttttcagtatgttcaaaatattatgcagccatcaccactatataattcctagataaaatttactttaaggcaaaaattctttttttttttttttttttgagacccagtctcactctgttgcctaggctggagtgcagtgtcatgatctcagctcactgcaacctctgcctcccaggttcaagcaattcccctgcctcaacctcccgagtacctgggattacaggcgtgtaccaccattgcctggctaatttttgtagttttagtagagatggggtttccccatgttggccaggctagtctcaaactcctgacctcaggcaatccgcccacctctgcctcccaaagggctggcattacagctgagagccactgcgcccggccaaaaagtcttaaacccagaagatacaacaatcctaaattgctaaatctctaataacatagtctcaaagcacaagacgtaagaactgatagaactacaaagacaaatagaaaaagctacaagcctagtgggaaattttcaacaagcaaagagtatagaagatttgatttcaaaattcattaaggtagggccgggcatggtggctgatgcctgtaatctcagcactttgggaggctgagacgggcagatcatgaggtcaggaattccagaccatcctggctaacacagtgaaatgccgtctctactaaaaatacaaaaaattagctgggcgtggtggcaggtgcctgtagtcccagctactcgggaggctgaggcaggagaatggcatgaacccgggaggcggagcttgcagtcagccgagattgcgccactgcactccagcctgggaaacagagtgagactccatctcaaaaaaaaaaaaaaaaaaaaaaaaaaaaaaaaaattc

SEQ ID NO: 7622 - DNA, 6141 bp, Homo sapiens
agtggctgggcgcagtggctcacgcctgtaatcccagcactttgggaggccgaggcgggcggatcatgaggtcaggagatcgagaccatcctggctaacacggtgaaaccccgtctctactaaaaatacaaaaaaattagctgggcgtggtcgtgggcacctgtagtcccagctactcgggaggctgaggcaggagaatggcgtgaacctgggaggtgagcttgcagtgagccgagatcacgccactgcactccagcctgggcgacagagcgagactctgtctcaaaataaaaaacaccagatgttaaataaaatataattcacaaattttttaatgcatagatgaatgtacaaactaaaggaattttccaggagctggaaacaaagagcacttcagctagtgtaagctaacctgcagcttagcctgcggcagaaagaaactggcggtcttagtaattgaggcatttcaatttcagcttgcagagttggaggcaatattcctacataaaagtagacccacaaagggctagataagaaaagggataagatactgaagcatctctgtcatggatggggctgtaggggtatacgggagtaggagaggagaaatcttctcatgaccacaatcccaagtgggtaataaggtttgagtttacactacctgaatattgctgagaaattaatataaaaaaacgagcacaagcctatggaaacctctggagcacttcacagaagcgaatacaaaaccgcctcagggacacgccaatccattctaaaatgaattctcagaaaaataagccctgctaaagttgacttcacaatccaaaactgcccccactcaacataacacacataataagatcagataaagaccacaaaataattacttttaaagaagaaaaaaaataggaatatctggaaaagaagcaaataaaaagttcagacatttaaaaatgtatcactgaaattaaagacagtccaagagcagatttagacccagttggctgggtacggtggctcacacctataatcccagcactttggaaggctgaggtgggtggatcacctgaggtcaggagtttgagaccagcctgtccaacatggtgaaatcccttctctactaaaaatacaaaaacttagacgggcatagtggtgggcctctgtaatcccagctactcaggaggctgaggcaggagagtcacttgaacccaggaggcagaggttgcagtgagctgagatcatgccactgcactccagcctaggcaacaagagcgaaactgtctcaaaaaagaaaagaaaagaaaaagatttagacccagttaaagagaaataggccagacatagtggttcattcctgtaatctaagcactttaggatgcctgggcaggaggatcaaggcaatgtagtgagaccatgtgtctacaaaaaataaaaaaattagctgggtgtgatgctacatagtcccagctattcaggaggctgaagtgggagagtcacctgagcccaggttgaagcagcagtgagctgtgactgtgccactgcactccagcctgggcgacagagtgagaccctgtttcaaaaaaaaaagtaaaagaaaaattacctatcaagaaatgataattaggctgacagtagaccccaacagcaacaatagaaaataatgaaaatggccaggtgtcgtggctcatgcctgtaatcccagcactctgggaggctgaggcgaacatctaaggtcaggactttgagacccagaatggccaacatgatgaaacccggtttctactaaaaatacacaaaaaattagccaggtatggtggtgcatgcctatagtcccagctacccaggaggctgaggcaggggaaccccttgaacctatgaggcagagatcacgccactgcactccagtctgggcgacagagactgtctccaaaaaaaaaaaaaaaaaaaaaaaactaaaagaaaatatttttctcccaaatgctaaaataaagtaagtaactatctggaattctacatccagctatattattatttaagagtaagaataggggtggggtgacaaagagattttgtcagtaatgcactatcaaaacctgaatccagaaaaggagtggtgggggttaaaaaaaagaaaaaaaaaaaaaaaacaagcagtgatgagcaaagaaaatggtattcagcaaattgaggccaggcgccgtggctcacgcctgtaatcccagcactttgggaggccaaggcgggtggatcatgaggtccggagatcgagaccatcctggctaacacagtgaaaccccgtctctactaaaaatacaaaaaaatttagccgggcatggtggcgggcgcctgtagtcccagctacttgggaggctgaggcaggagaatggcgtgaacccgggaggcagagcttgcagcgagccaagagtgcaccactgcactccagcctgggtgacagagcgagactccatctcaaaaaaaaaaaaaaaatggtatttagcaaattgaaataagccttgactgtaaaatagtaacacctaaactatctttaaggatatgaaaacaaggtagaactaaaatatatttattagtcatgttcttggatagaaatactcatttgtggctgaacatggtggctcatgcctgtaatcctagcactttgggaggctgatgcaagaggatcactcaagcccaggagttcacaaccagcctgggcaacatagcaagaccctgttgctttttgttttgaggtgtttttttttttaatttaaaagaaaaaaaattaaatactttttttaaagaaatactcatttgtcatagggatgggaattatctttaggttgacttataaatctaacatgatgctgataaaaatactgtaagggttgctctttttggggagaaccccaggcatggtggtgtatacccatagtcccagctatttgggaggctgaggtgacagcatcacctgagctgagactgcagtgagctgtgatcaagccgctgcacttcagccttggcaatgaagtgagaccctgtctcaaaaataaaataaattaaactaaattaaaattaaataaattttaaaaataaaataaaataagatgcttacccttctagttgttgtgaagattaaatgagttattcataaagtgcttacaacattgcctggcacataataagtactcaactgaattctagtttcggttagtttctcctgttataactgtatgagtctgtttcagggctattctgatccaatcatctgctatctatctattcatacgtcagaaccactcatggcaccattttacaatgttaagagaagtctatgtgcaagctcctaaaaaccacatttctttccttctttcttatcttagagacaggagtcttgctctgttccccaggctggaagtaggcagttgcctgatcatggctcactgtggccttgaattcctgcacaagtgatcctcctatcttggcctcccaaagtgctgggaatacaagtctgagccaccaggctgagcccataaaaaacatttttctggccagatgcagtgtctcatgcttgtaattccaacactttgggaggctgaggcgggcagatcacctgaggtcacaagttcgagaccagcctggccaacatggtgaaactctgtctctaacaaaaatacaaaaattagccaggtgtggtggtgggcacctgtaatcccagctactcgggaggctgaggcaggagaattgcttgaacccaggaggcagaggttgcagtgagccaagatagcaccattgcactcccgcctgggcaacaagagtgaaactccgtctcagaaaaaaacaaacaaacatttttgttagttctttcctgttgattctgtcagataaactttagaataattttcagatcctccatctcttacctattcagttgaattatattacattaataaactgaaaagaaatgacatctatatatctaataggtcattccatcttagaaaatggaatggtctcataattatttcaggcttttaaattatctcatagtttactgcatgtctcattacctgttaaaggcattttaaaatactttatgtttttgttaataaagtgagtggtggtatattttcccttattacattttctgatttttgctggcattataaaactattgggttttatacacttgctttacagctagtcaacaagctaaacttttaattctaaaaagtgtctcttgggttttcttgtgtaaaataaatagctatatctcctatatacaatgaaaaattgtataacagtctcaacaagggatatcaacggaaaatctcaaggggatttatttttttaagacagagtgcagtggcactaacatagatcactgcagactcgaaatctgagcttaagggatacttccactttggcttcactagatggatgccacacatacctggctaattttttttttaatgtaaaaaacatgggtggggtcttgctatgttgccctggctggtctcaaactcctggcctcaagcgatctcctgcctcggcctcccaaagtgctgtaatcccagcactttgggagacacctcacctggcctcaaaagggattttaaattgcaaaacatgcagaaatatttaatctgtctgggaaataacccctgactcctggcctcccagtctcccagagaccattacacagaagcaggtccatgttttactaaaggaagagtgtcagcaataaactgttgagtgaaaagaccaagctataggacagcatgcacagaatgagcccactttgttaaaaaatatatttcatatatacagcacatactaaatatagcatggatatagaaaagtatctgggagattaggtatcaaattattaacggtgcttgtctgtggggaatacaagtaggagcaaacttttactttttattttgcttgctatctacccccaaatagattactaattctgaagcattgctttaagctagtaatatcttttttcagtttctttttaaacacacctaaattcagaggacagaggtagacaatttttgcacatccatcttgaacttaatcattacacagaaaaatagctggaaaactattatgttttgaatatatgttgaatacatacgatttttactgcagacatgatacatagcccatagtgcccagagctgaacctctggttgagagaagttgccaaggagcgggaaaaatgtcttgaaagatctaaaacaaaaaaaagtacaaagatgttaatccagaacagttaggccagtgctcagggatataataatttgtactatataattaatataataatgtatataattttcacagccgggcatggtggctcatgcctgtaatcccagcactttgggaggccaaggtaggtggattgcttgagcttaggaattcgggaccagcctaggcaacaaggtgagcccccgtctctacaaaaaaaaaaaaaaaaaaaaaaaaaaaattagctgggcctggtggcacacgcctgtagggccaagtgggaggatcctcaagtgggaggatcacttgagcctgggaagtcaaggctgcattgagatgtgatcccgccactgcattccagctccagcctgggcaacagagagagaccctgactcaaaaggttgaaaaaaaaagaattttcaaattttaaacattttccccacagggtcaacttctccctgtgaccgagcatacaatgaagctattatttaagaaattgcattctgtattaaaccctttattatgatcagtatctcattgcatcctcaatcttgcacactgtcagcctcattttacagacaaggaaagctgaccttctagaaatgactttcccaatatcagagaaataggatttgaacataaggctaactgactctaacacgttatcactgtatcactgagtacagcctttaagaaaagctcaacactgggccaggcacggtggctcacgcctgtaatcccagcactttaggaggccgaggcgggcagatcacgaggtcaggagatcgagaccatcctggctaacatggtgaaaccccgtctccactaaaaatacaaaaaattagccgggcatggtggcgggtgcctgtagtcccagctactcgggag

SEQ ID NO: 7623 - DNA, 169 bp, Homo sapiens
aatacaaaaaattagccaggcgtggtcgcgggtgcctgtagtcccagctactcaggaggctgaggcaggagaatggcgtgaacccgggaggcggagcttgcagtgagcagagattgcgccactgcactccagcctgggcgacagagtgagactccgtctcaaaaaagaa

SEQ ID NO: 7624 - DNA, 176 bp, Homo sapiens
cgggtgtggtggagggcacctgtagtcccagctactcgggaggctgaggcaggagaatggcgtgaacccaggaggcggagcttgcagtgagctgagatcgtgccactacactccagcctgggcaacagagcgaaactccgtctcaaaaaaaaaaaaaaaaaaaaaaaaaaagtcca

SEQ ID NO: 7625 - DNA, 207 bp, Homo sapiens
aaccccgtctctactaaaaatacaaaaaaatagccgggcgtagtggcgggcgcctgtagtcccagctacttgggaggctgaggcaggagaatggcgtgaacccgggaggcggagcttgcagtgagcccagatcccgccactgcactccagcctgggcgacagagcgagactccgtctcaaaaaaaaaaaaaaaaaaaaaagactgcg

SEQ ID NO: 7626 - DNA, 230 bp, Homo sapiens
ccatcttggttaacacggtgaaacccggtctctactaaaaatccaaaaaattagccgggcgtggtagcgggcgcctgtagtcccagctactcgggaggttgaggcaggagaatggcgtgaacccgggaggcggagcttgcagtgagccgagatcgcgccactgcactccagcttgggcgacagagcgagactccgtctcaaaaaaaaaaaaaaaaaaaaaaaaagaataa

SEQ ID NO: 7627 - DNA, 288 bp, Homo sapiens
tcacgcctgtaatcccagcactttgggaggccgaggcaggtggatcacaaggttaggagatagagaccatcctggctaacacggtgaaaccccgtctctaccaaaaatacaaaaaattagccgggcgtggtggcgggcgcctgtagtcccagctactccggaggctgaggcaggagaatggcgtgaacccaggaggtggagcttgcagtgagccgagatcgcgccactgcacgccagcctgggtgatgacagagactccgtctcaaaaaaaaaaaaaaaaaaaaaaaa

SEQ ID NO: 7628 - DNA, 282 bp, Homo sapiens
cctgtaatcccagcactttaggaggacgaggtgggcggatcacaaggtcaggagatcgagaccatcctggctaacatggtgaaaccccgtctctactaaaaatacaaaaaattagccgggcgtggtggcgggcgcctgtagccccagctactccggaggctgaggcagaagaatggcttgaaccgggaggcggagcttgcagtgagccaagatcgcaccactgcactccagcctgggtgacagagcgagactccgcctcaaaaaaaaaaaaaaaaaaaaaaa

SEQ ID NO: 7629 - DNA, 275 bp, Homo sapiens
ccctttgggaggccgaggcaggcggatcatgaggtcaggagatcgagaccatcctggctaacacggtgaaaccccgtctctactaaaaatacaaaaaaaaatgccaggtgtggtggtgggcgcctgtagtcccagctacttgggaggctgaggcaggagaatggcgtgaaccaggaaggcggagcttgctgtgagccgacctcgcaccactgcactccagcctgggcgacagagtgagactccgtctcaaaaaaaaaaaaaaaaaaaaaaaaaaa

SEQ ID NO: 7630 - DNA, 189 bp, Homo sapiens
caaaaaaattagcggggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaatgaca

SEQ ID NO: 7631 - DNA, 207 bp, Homo sapiens
aaccccatctctattaaaatacaaaaattagccgggcgtggtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaga

SEQ ID NO: 7632 - DNA, 116 bp, Homo sapiens
agaatggtgtgaacccaggaggcggagcttgcagtgagctgagatcgcgccactgcactccagcctgggcgacagagtgagactctgtctcaaaaagaaaaaaaaaaaaaaaagaa

SEQ ID NO: 7633 - DNA, 150 bp, Homo sapiens
  misc_feature (21)..(21): n equals a,t,g, or c
ctgtagtcccagctattcggnaggctggggcaggagaatggcgtgaacccgggaggcggagcttgcagtgagccgagatcgcgccactgcactctagcctgggcgacagagcgagactccgtctcaaaaaaaaaaaaaaaaaaacaactt

SEQ ID NO: 7634 - DNA, 162 bp, Homo sapiens; identical to SEQ ID NO: 6214

SEQ ID NO: 7635 - DNA, 304 bp, Homo sapiens
cttgcggccgggcgcggtggctcacgcctgtaatcccagcactttgggaggccgaggcgggcggatcacgaggtcaggaaatcgagacaatcctgggtaacatggtgaaaccccgtctctactaaaaatacaaaaaattagctgggcgcagtggcgggcacctgtagtcccagctactcgggaggctgagacaggagaatggcgtgaacccggggagcggagcttgcagtgagccaagatcatgccactgcactccagcctgggcgacagagcgagactccttctcaaaaaataaacaaataaa

SEQ ID NO: 7636 - DNA, 311 bp, Homo sapiens
tattccattgacgggcgcggtggctcacgcctgtaatcccagcactttgggaggccgaggcaggcggatcatgaggtcaggagatcgagaccatcctggctaacacggtgaaaccccatctttactaaaaatacaaaaaattagccgggcgtggtggcgggcacctgtagtcccagctactcaggaggctgaggcaggagaatggtgtgaacccaggaggcagagcttgcagtgagctgagatcgtgccacattgcactccaacctgggcgacagagcaagattccatctcaaaaaaaaaaaaaaaaaaaa

SEQ ID NO: 7637 - DNA, 301 bp, Homo sapiens
  misc_feature (98)..(98): n equals a,t,g, or c
cggtggctcacgcctgtaatcccagcacttggggaggccgaggcgggcggatcacgaggtcaggagatcgagaccatcctggctaacacggtgaaacnccgtctctactaaaaatataaaaaattagccaggcgtggtggtgggcgcctgtagtcccagctactcaggaggctgaggcaggagaatggcgtgaacccgggaggcggagcttgcagtgagccgagatcgtgccactgcactccagcctgggcgacagagtgagactccgtctcaaaaaaaaaaaaaaaaaagttattcttcg

SEQ ID NO: 7638 - DNA, 171 bp, Homo sapiens
agccgggcgtggtggcgggcgcctgtagtcccagctacttgggaggctggggcaggagaatggcgtgaacctggaggtggagcttgcagtgagccgagatcgcgccactgcactccagcctgggcaacagagcgagactccgtctgaaaaaaaaaaaaaaaagaaatagag

SEQ ID NO: 7639 - DNA, 301 bp, Homo sapiens
ccgggcgcggtggctcacgcctgtaatcccagcactttgggaggccgagacgggcagatcacgaggtcaggagatcgagaccatcctggctaacacggtgaaaccccgtctctactaaaaatacaaaaattagccgggcatggtggcatgcacctgtagccccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaagaataaga

SEQ ID NO: 7640 - DNA, 611 bp, Homo sapiens
cagttgttggccgggcgctgtggctcacgcctgtaatcccagcactttgggaggctgaggcgggcggatcacaaggtcaggagatcgagaccatcctggctaacacagtgaaaccccgtctctactaaaaatacaaaaattagccgggcgtggtggcgggtgcctctagtcccagctgctggggaggctgaggcaggagaatggcatgaacccgggaggcagagcttgcagtgagccgagatcccaccactgcactccagtctgggtgacagagcgagactccgtctcaaaaaaaaaaaaaaaatttcagttgtgggctgggcgcggcagctcacgcctgtaatcccagcactttgggaggctgaggcgggaggatcacgaggtcaagagatggagaccatcctggctaacacggtgaaaccctgtctttactaaaagtacaaaaaaaaaaattagccgggtgtagtagcgggcacctgtagtcccagctactcgggaggccgaggcaggagaatgacgtgaacccgggaggcggagcttgcagtgagctgagatcccgccactgcactccagcctgggcgacagaacaagactccgtctcaaaaaaaaaa

SEQ ID NO: 7641 - DNA, 291 bp, Homo sapiens
ccacgcctgtaatcccagcactttgggaggccgaggcgggcggatcacgaggtcaggagatcgagaccatcccggctaaaacggtgaaaccctgtctctactaaaaatacaaaaaattagccgggcgtagtggcgggcgcctgtagtcccagctacttgggaggctgagtcaggagaatggcgtgaacccgggaggccgagcttgcagtgagccgagatagcaccactgcactccagcctgggcaatagagcgagactccatctcaaaaaacaaacaaacaaacaaacata

SEQ ID NO: 7642 - DNA, 308 bp, Homo sapiens
ggtggctcacgcttgtaatcccagcactttggaaggccgaggcgggcggatcacgaggtcaggagatcgagaccatcctggttaacacggtgaaaccccgtctttactaaaaatacaaaaaaaattagccgggcgtgatggtgggcgcctgtagtcccagctactcgggaggttgaggcaggagaatggcgtgaacccgggaggcggagcttgcagtgagccgagattgcgccactgcactcccgcttgggccacagagcgagactccgtttcaaaaaaaaaaaaaaaaaaaaaaaaaaggaacaaga

SEQ ID NO: 7643 - DNA, 303 bp, Homo sapiens
tgctgccgggcgcggtggctcacacctgtaatctcagcactttgggaggccgaggcgggcggatcatgaagtcaggagatcgagaccatccaggctaacacggtgaaaccctgtctctaccaaaaatacaaaaaattagctgggcttggtggcgggcgcctgtagtcccagatactcgggaggctgaggcaggagaatggcatgaccccgggaggcagagcttgcagtgagccgagatcacaccactgcactccagcctgggcgacaaagtgagactccgtctcaaaaaaaaaaaaaaaaaag

SEQ ID NO: 7644 - DNA, 267 bp, Homo sapiens
agatcacgagtcaggagattgagaccatcctggctaacacagtgaaaccccgtctctactaaaaatacaaaaaatcagccgggcgtggtggcgggcgcctgtagtcccagctactcaggaggctgaggcaggagaatggcgtgaacccggtaggcggagcttgcagtgagccgagattgcgccactgcactccagcctgggcgacagagcgagactccgtctcaaaaaaaaaaaaaaaaaaaaaagaaaagaaaagaaaagaaaaac

SEQ ID NO: 7645 - DNA, 129 bp, Homo sapiens
gaatggcgtaaccgggaggcggagcttgcagtgagccgagatcgcgccactgcactccagcctgggcgacagagcgagactccgtctcaaaaaaaaaaaaaaaaaaaaaaaaaaaaaaaaaaacaaaga

SEQ ID NO: 7646 - DNA, 311 bp, Homo sapiens
atagaaggccaggcgcggtggctcacgcctgtaatcccagcactttgggaggcccaggcaggcagatcatgaggtcaggagattgagaccatcctggctaacatggtgaaaccccgtctctactaaaaatacaaaaaattagctgggcgtggtggcgggtgcctgtagtcccagctactcgggaggctgaggcaggagaatggcgtgaacccgggaggcagagcttacagtgagccgagattgcgccactgcattccagcctgggcaacagagcaagactccatctcaaaaaaaaaaaaaaaaaaaaaagt

SEQ ID NO: 7647 - DNA, 193 bp, Homo sapiens; identical to SEQ ID NO: 7396

SEQ ID NO: 7648 - DNA, 240 bp, Homo sapiens
gatcacgaggtccggagatcgagaccagcctggctaacacagtgaaaccccgtctctactaaaaatacaaaaaaattagccaggcgtggtggcgggcgcctgtagtcccagctacttgggaggctgaggcaggagaatggcgtgaacctgggaggcggagcttgcagtgagccgagattgtgtcactgcactccagcccgggtgacagagcgagactccatctcaaaaaaaaaaaaaaaa

SEQ ID NO: 7649 - DNA, 297 bp, Homo sapiens
ctaggcgcggtagcacgcctgtaatcccatcactttgggaggccgaggcgggcggatcacaaggtcaggagatcgagaccatcctggctaacacggtgaaaccccgtctctactaaaaatacaaaaaaattatcagggtgtggtggtgggtgcctgttgtcccagctacttggcaggctgaggcaggagaatggagtgaacccgggaggcggagcttgcagtgagctgagattgtgccactgcactccagcctgggcaacagagcgagactctgtctcaaaaaaaaaaaaaaagaaa

SEQ ID NO: 7650 - DNA, 3991 bp, Homo sapiens
ccccgtctctactaaaatacaaaaaattagccgggcgtagtggcaggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaggcgtcagctttttatcgcacaaaattgcagatcaaaagtctgaaatcaaggggttcacagaaccacactcctccaaatcctgtaaaaaaaattccgtttcttgcctcttccggctcctgatagtggtgggttttccttacctgaggggggcatcactccaccctttttttttgtcttcaccgggcctcctctctgggtctgggtcttctgccactggatttagggcccactttggtaatccaggaggacctcaagattcttcattatacctgcaaagaccatttttgcaaatgaaatcatattgcacgagttctgggaatttatacctggacatatcttttagggggcactattcaatatactgcatgtagcaagagaatactagcgcatgtatcatctcatccaagtcttcaagagccttgacagttactgttatttctcacataagaaaaccgtagtgataaaagtgaaaagctaacatttaaaactcgatctgtcagccaggtgcagtggctcacgcctgtaatcccagcactttgggaggccaagacaggcagatcacgaggtcaggatatcgagaacatcctggctaacacagtgaaaccccgtctctactaaaaatacaaaaaattacctgggcgtggtggtgggcgcctgtagtcccatctactcgggaggctgaggcaggagaatggcatgaaatggggaggcagagctttcagtgagccaagattgcgccactgcactccagcctgggcgacagagcgagactccgtctcaaaaaaaaaacaaaacaaaacaaaaaaaaaacctcgatctgtcaggatttaagtctattcctttagccgctatggcattttactacctacaaagcagacagggccactttctaaattgcccagcctacaggctgaatgtaccagagtcctaagccaccacaaggtccctctgtgcaccctccttcacctatttgtatagccatatggcccaccaggagtgcagaaatacaggctatttcacaggtcagcaggaaattcccaattgccctcagggctaatcagacactctcagccaacttctttaaaattaagttcccatttctcttagtaagttctgcttgatgcttcataaggttcatggcaagttaaatgcattgcatattcaccactggtaagcaatgtagataagaaattctaaagagaatatttcatcttcatttcaatctagcaaacttataaaagtatggatttttaaacgggatgcaaatgacactagagcataactcatagtgacaaggagaaaggactaataaaggagtttttatgtggtcactttgaattagacctgtcagtgacactctagtgaatattaactgtgtgcatttttccatcccccttcaaactgcttggcttaaaattcaaataaagttggttccttgtgaaaacccccctcctggtggcatgagagaattaatgtactttcaaaggtaaacaatttgctcctttctgcagttggagcagagctgttatagatcatgccaactcaaagggaaaatagagtcaaggaaactgaagagtcaaaagccaaccacctggaaatttatgtcagtttttatgcttaagatccttcactgcaaacaaatatcacactttaatgccacagcacaataaagaaaaacctttgacttgtgggcttgtggaaaaagaaaaatgaaaaagcagcattcatgtgggagtcaaaacctatcctgcaccttagggaggaataaaaaagcccgtatgttattccttttatctctgttggagccaaggcgcagattgactcaatggacaggaaactgacagtgatggagcaactgctgcttacctgattgtttcatcatgcttatatcattcaactctcatgcccacccttgaaagtaggcaaaatgccctcattttagaattgacaaaaaaattcaagcttagaaacctaaatgattaatcaaaggtcactctgttaatttgcagtgatacagagcaagccaaagacattctcagacaccaagcttacctaaaccaacttctttttcctgctcctgccagcatatataaacacatgcttttaaaataatgacaggctaaatctagcaatcaagtcattatagcattccagtaagtctgcaagtgacatgttgttttcaccaaagatggaccaggatatgacattgtctccttctattatgcccagccagcagactgactgtcagatgcccactgcggtgatctgtttagcaaggtcagctgcttgattgctatgaataattggatgccattaataatggtcagctccaggatataggaaagtggtcaagcgtggtaattgtattttgaattccagcagattatttcctgggaagcaggaagacaaccactatataggatacagtttttctaagtagaatagaaataattgcttccctagaggtgaaggggagaagccaagggctcccgtaataacatgtgtgaccatatctagtaagaaacatggaggtcaaggttttgcaagtgatggctaatgctatgaagcctggccattaccatcactaaaagcctttacaagttcacattcttgttattctcttattgagaataacactagagctttacatgttgaggggccaccacctaaattttgaagcaccagtgaggttagaccaatggctaattaggaaatctaatacaattgatatccatctgaaaaggtcaagcataaatcttttgctgttaaatgtgtattaaattctcaccacatattaagggctgtagatactgcaagataattaggcaaaacattattatcttaaaaaaaaagccctgtcaaaaaatgaagggtttttaaaaatctcccaggacataataataaaagtgagaaattaaaaagagattgaaaaaaaaagcacgtgaaaaggaaaaactaaaagtgattttagaggatagactgcagtataggcaacacataaagagcaaaacatttcatagaaaaatataatagctatcagtttcagactttactaaagaaactatttcttaaattgtcaagcaatgtgggcagaacaaattaaagttaaaacttattatagcaaaggaaatatggatgggagcatggaatcatgatacaactgcctgaaatgaaatattcaacacaagcctcaattcttgccagcttttccattatttgaagctaccaggagttggatcattttgaccattttttttttaagtattcagtgtttggatgaactctacagtgaaaagagataaacaatcatagagctaaaattataaaactctcataagaaaacataaggaataagtctttgtaaccttgggttacacaatggtttcctggatctggcaccgaaagataggtgacaaaagaaaacacttaggctgggcgtggtggctcatgcttataatcccagcactttgggaggccgagctgggcggatcatgaggtcaggagaccatcctcgccaacatggtgaaaccccgtctctactaaaaatccaaaaaattggccaggcgtggtggcttacacctgtaatcccagcactttgggaggccgaggtgggcggatcaagaggtcaggagatcaagaccatcctggctacggtgaatccccgtctctactaaacatacaaaaaattagcggggcctggtggcgggcgcctgtagtcccagctactcgggaggctgaggcaggagaatggcgtgaacccgggaggcggagcttgcagtgagctgaga

SEQ ID NO: 7651 - DNA, 177 bp, Homo sapiens
cataaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaatgagtc

SEQ ID NO: 7652 - DNA, 292 bp, Homo sapiens
ctgacgcctgtaatcccagcactttgggaggccgaggtgggcggatcacgaggtcagaagatcgagaccatcctgcctaacacggtgaaacctcgtctctactaaaaatacaaaaaattagctgggcgtggtggcgggcgcctgtagtcccagctactcgggaggctgaggcaggagaatggcgtgaacccgggaggcggagcttacagtgagcggagatcgcgccactgcactccagcctgggtggcagagccagactccatctcaaacaaaacaaaacaaaacaaactct

SEQ ID NO: 7653 - DNA, 307 bp, Homo sapiens
tttaaaaagtctggccgggagcggtggctcacgcctgtaatcccagcactttgggaggccgaggcgggcggatcacgaggtcaggagatcgagaccatcccggctaaaacggtgaaaccccgtctctactaaaaatacaaaaaaaaaattagccgggcgtggtggcgggcgcctgtagtcccagctacttgggaggctgaggcaggagaatggcgtgaacccgggaggtggagcttgcagtgagctgagatcgcgccactgcaccccagcctgggcaacagagcgagactccgtctcaaaacaaaaa

SEQ ID NO: 7654 - DNA, 2925 bp, Homo sapiens
ggccgggcgaggaggctcaagcctgtaatcccagcactttgggaggcggaggcaggtggatcacgaggtcaggagatggagaccatcctggataacacggtgaaaccccgtctctactaaaaatacaaaaaattagccaggcgtggtgtcaggcgcctgaagtcccagctacttgggaggctaaggcaggagaatggcgtgaaccaggcaggcggagcttgcagtgagcggagatcacgccactgcactccagcctgggcgacagagcgacactctgtgtcaaaaaaaaaaaaaaaaaaaaaagccatacacatcggttgcatgcacacacacacagaagctttaaattgcttgtatccgtctcttaattttttttggtggagcatatatcagtgaattgctataaagtaagtgtttatggagctatatcatgattcatagtctgattactgcttgtgagacaaacaaaaatagaatgtatccatgaaaatgaacgcagaagtatttattatccattgatctttgttactgtacatttataactgagttatattgatcacttgtttaaagtacgcaattatataaaatataattttattaacgaaattatatttatcatgtatgacagctaccaggagagtcattgtattggaaactaagagaagtaaatggataacacttacactgtgcaaagtttccactacacgtcattaatttctgtagttcctagataatcttttcaggtagaataaaatgtccacaaaacaaaagtaattaaccaacatagattcctgaattgcttgctctgctacgcactctctactcaccctcatgtctacattctgccactaactcaaatatcctaaactattgcacatgccatcaacccccgcaccccgccgctaaaatgtttcaatcagactcacgcaggcaccatctgaccattccctcaatgctaatccataagaaaagaaaagtgacagtaggaaaacatcaggataaacacacataaagaaattcttagccagttctgacctctgcttatatggacgaagcagagtattacttaagaggagccacacaggccgagcgcggtggctcacgcctgtaatccgagcactttgggaggccaaggcggctggatcatgaggtcaggagatggagaccatcctggctaacacagtgaaaccccatctctcactaaaaatgcaaaaaaaaattagccgggagtggtggcaggcacctgtagtcccagctacttgagagggtgaggcaggagaatggagtgaacccgggaggcggagcttgcagcgagccaagttcgcgccactgcactccagcctgggcgacagagcgagacttcgtctcaaaaaaaaaaaaaaaaaaaaagaggaaccacacagaagaaatttaagggacactctttgtagttggagagatactgatcacaggtgtcactctgttacactcctttatattggcctctgtagcatctgttcaaagaaagtatcatatttaccaaaatttagccatctcatgaaacttaaaaactttaggaattctgccatagaactccaatgactaggaggctgtatcaggaagccttctattgtttgcagtggcaaaactatagtcaacaataatttattgtacatttaaaaataactaaaagagtataattagattctttgtaatacaaaaaaggacaaatgcttgaggtgatgcttaccctgtttaccctgatgtgattattacacatcatatgcctgtatcaaaatatctcatgtaccccataaatatgtgcacttactatatactcacaaaaattaaaaaattaaaattacttttaaaacttgaaaaaccaataataaaatatttgcagcaataaaataattcctatctctactccacacataatgaataaacattgctacctgggagatcacttaaggaaatttacttttactaaatgtcaatggcattattgattaagcttgtcaataaacacaagtgaaaatgattaataaaaaaaacacacaaatgagcaaacaaaaccaccaacagcaacagggaaacaagacttttcctgaccgaatccctatcttctcaccctgttctcagcagctgccttatgccttttgcaggttagaatcttagaattgagaaataataattgcttaattttaataagtttctactaaatcctttacatacgttttctccttttatcctactacaacccaatgtaagagtagcattatcaccattttacagatgagaaaactgagatgctggaggctaaataacttgctgaaggttttaccgctaaaatgtagtaagactaagattagaaggcagtccatctggtcccagaaccgtaagttttaactcctgtggctaggttcttactattagccgcagatttatttcacatctgaactttcacatattatatgtgggcaaattgccaggaacctaagcttgatttgttggtacaacatcttccattccaaaatgcccgtagccagccctcctgaatccctcggcctatggggctaaaaagctggtttttttctatggccattcaactattttacattttgtcaacttgtcaaggtatcatacgctattcgtccatagatctccttaatgtccatatcacaccctgtggacttgcagaggttgcacattgaaatatgacttaccctggtaatccacatcttaatttcttaataatacccatctcagccgggcgcggtggctcacgcctgtaatcccaggactttgggaggccgagacgggcggatcacgaggtcaggagatcaagaccatcctggctaacgcggtgaaaccccgtctctactaaaaatacaaaaaattagccaggcgtggtggcgggcgcctgtagtcccagctactcgggag

SEQ ID NO: 7655 - DNA, 263 bp, Homo sapiens
agcactttgggaggccgaggcaggcagatcacgagatgaggagatcgagaccatcctggctaacacggtgaaaccccgtctctactaaaaatacaaaaaattagccaggcgtggtggcgggtgcctgtagtcccagctactcgggaagctgaggcaggagaatgccgtgaacccaggaggcggagcttgcagtgagccgagactgcaccactgcactccagcctgggcgacagagccagactccatctcaaaaaaaaaaaaaa

SEQ ID NO: 7656 - DNA, 280 bp, Homo sapiens
cccagcactttgggaggccgaggcgggcggatcacgaggtcaggagatcgaggccatcccggctaaaacggtgaaaccccgtctctactaaaaatacaaaaaaattagccgggcgtagtggcgggcgcctgtagtcccagctacttgggaggctgaggcaggagaatggcgtgaacctgggaggcggagcttgcagtgagccgagatcccgccactgcactccagcctgggcgacagagcgagactccgtctcaaaaaaaaaaaaaaaaaaaaaaatagg

SEQ ID NO: 7657 - DNA, 187 bp, Homo sapiens
aaaaatacaaaaaattagccgggcgtcgtggcgggcgcctgtggtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaagggg

SEQ ID NO: 7658 - DNA, 246 bp, Homo sapiens
atcacgaggtcaggagatcgagaccatcccggctaaaacggtgaaaccccgtctctactaaaaatacaaaaaattagccgggcgtagtggcgggcgcctgtagtcccagctactcaggaggctgaggcaggagaatggcgtgaacccgggaggcggagcttgcagtgagccgagatcccgccactgcactccagcctgggcgacagagcgagactccgtctcaaaaaaaaaaaaaaaaaaaatgga

SEQ ID NO: 7659 - DNA, 114 bp, Homo sapiens; identical to SEQ ID NO: 6217

SEQ ID NO: 7660 - DNA, 322 bp, Homo sapiens
aaaaaaaaaaaaaaaaaaggctgggcgtggtgactcacgcctgtaatcccagcactttgggaggccgaggcaggcggatcacgaggtcaggagatcgagaccatcctggctaacacagtgaaaccccgtttctactaaaaatacaaaaaattagccgggcgtagtggcgggcgcctgtagtcccagctactggggaggctgaggcaggagaacggcataaacccgggaggcagagcttgcagtgagccgagatcgcgccactgcactccagcctgggccaacagagtgagactccatctcaaaaaaagaaaagtgaaataga

SEQ ID NO: 7661 - DNA, 173 bp, Homo sapiens
ggcgtggtggcgggcgcctgtagtcccagctactcgggagactgaggcaggagaatggtgggaacccgggaggcggagcttgcagtgagccgagatcacgccactgcactccagccgggtgacagagcgagactctgtctcaaaaaaaaaaaaaaaaaaaaaaagaaaagaaa

SEQ ID NO: 7662 - DNA, 63 bp, Homo sapiens
ccactgcactccagcctgggtggcagagcaagactccatctcaaaaaaaaaaaaaaaaaaaat

SEQ ID NO: 7663 - DNA, 258 bp, Homo sapiens
tgggaggccgagctgggtggatcacgaggtcaggagatcaagaccatcctggctaacacggtgaaaccccatctctactaaaaatacaacaaattagccgggtgtggtggcggctgcctgtagtcccagctactcgggaggctgaggcaggagaatggcatgaacctgggaggtggagcttgcagtgagccgagatcctgccactgcactccagcctgggcgacagagtgagactccgtctcaaaaaaaaaaaaaaaa

SEQ ID NO: 7664 - DNA, 3905 bp, Homo sapiens
ctcacgcctgtaatcccagcactttgggaggccgaggcgggcggatcacgaggtcaggagctcgagaccatcctggctaacacggtgaaaccccgtctctattaaaaacacaaaaaattagccgggcgtggtggcgggcgcctgtagtcccagctactcgggaggctgaggcaggagaatggcgtgaacccgggaggtggagcttgcagtgagccgagatcgcgccactgcactccagcctgggcgacagagtgagactccatctcaaaaacaacaacaacaacaaaaaaacaaaacaaaaaaaaacaaaacatatgaacttctttcaacatcaaaatatagataaacaatatgattttcagtggctatacagtgttttactatgtggatatactataaatttataaacatctctgtgtttgggcatttaggtactttctaatttttcactattataagtatatcactatgggtctgatcaggagagagaaatttgacagggaaagttgaatgtaaattattaattttaacagggattagagtaacgagggattagctaacaagaggtcaaaagaactctcaaaacagaactagcagggataaggtgcaatcaccaagtctcaggctgagacagaatgtccagggaggagcccacgcccctagggctaagagaaggctcagctgagggtccctgaatttcacagaagcccccgtggtgccctgctgtcagaacctcctggagatctgccctctgggatgctgggggaaactcttcatggggaagaacctccctggaggcgctcttgttataaacctgcccgaggagggggtgtgctgggagaagttgctggttctgggtattgctggccactgtgcactgaaggggccaggcactgaaggagttgcagttgctgaaggagcctgccaagattgcaggctggagccaggaagcaaaaactctgacaaaggaaaaagtattcaagcagccttggttcattttcttttttaaaaaattttcaaattattttttatttagagacagagcctctctctatcacccaggctggggtgcagtggcgtgatcatggctcactgcagcctcgaactcctggatgatcaaccaatcctctcacctcagcctcccaagtagctgacactacaggtacatgccatcgtgcctagctaattttttttttttttttgagacggagtctcactctgtcacccaggctggagtgcattggcgcaatctcagctcactgcaatctccgcttcctgggttcacaccattctcctgcctcagcctccccagtagctgggcctacaggtgtctgccaccaggcccagctaatttttttttgtatttttagtagagacggggtttcactttgttagccaggatggtctcgatctcctgacctcgtgatccacccgccttggcctctcaaagtgctgggattacaggcgtgagccaccgcgactggctgcctggctaattttttaaagaaaattttctagaggtgagatcttactttttgatgcaggatggttttgaactcctggcttcaagtgaacctcctgccttggcttcccaaagtggctgggataacaggcatgagccactgtgcccagctggttcatcttcatagagcagccaaaaagagggaatttgttgctgagaggcactaagttgatatctggcacaagaaacaaatgtttcagggaatatccttgtatatccatcattacatgctatctgaatattttcttacatacattcctagacttagaattggcaggtaaaaaggtgggcacagtctacacttgagaaatacggccgtcagtaaaacttattcacctattacatagtacttgggagcttctagatcgtcacaatttaattaaccttaggtattgtcattctttttaatccttatacatctgataagccaaaaaaagtagttttttatttgtatttttaaaaaaattagtagcgatgttaaaactttattttcttttttattgtgaagttcttgcctgtatcctctgctgatttaaaaaattgggatattcagtctttttcttattgatttgtacatgctctttatatattaagtatcagaaagtttaaatgttcatgtttccaaatcttactttgtttttcatatttaaaatcttaattcttttggaaatcgttttagtttaaggtgtcaggtaggtgtttagtttttaaattttgttccaataatgttaactcttttctcttttttttcctgactgatttatatgtcaacttgtgttatatgcctgggtatacttatggactttaagttgttttcttctagtttctagttaattatttttcttttttctttcagaacaggacgcaggccttgatgccctttcctctatcataagtcgccaaaaacaaatggggcaggaaattgggaatgaattggatgaacaaaatggtaagaataagtctgggattgaccagatttgccgttgacataaatactaaaggcttgagcatttgttgaatgagtttaagattatacaacatgtaaagtggtttaatgtcaatgattgttacagtttaacgcattggagtgggggttgtggcagatttagatgatagttgttaaatactatgcaaagaaatttggtgaaaaattttccagttctcagtagctgcttttaacaatactgtgttttatgatccattcatcccaagagcttttcttctatgtggcagtgatatgaaattgctcagcactttgtacactgaggctgtgtgggcctcctgtcatccccacacccggtggagtttgctcttcttcgatcctatgtaccaggcttcagggcaaaaaagggtttgaagatctttgttcagggtttgatgtgacaagtctggttggaaaaagatgaatttgcaaactgcaagcagggtggattggggagtgtttaagacgtgtaggcatctgcaaggctcttggcttgaggagggcctggatgggttgtaggggcagaaagggggaagaaatacgggggcacgggattgccagtgattttacgttaaggatgaagttgggaaacttgagagcagacactggtttttgggtgagatggtaagtccagtttgcatgtgtctaattagagatgccggcgggagatgtccagttgacagtgggagacagggtaccagagctcagggagagggcggagccaaagagaagagatgggagcagctgcagtgtagaggtgacgtgtgacagcgtggagtcgttgagtggcagtgaagctggcatttatggaaagcccccactatgtgctaagccctttcatctatgtcatttcatttcatctccacacaacatcatgaaggcggcaccctcctcgtgtgagaggcaaaactcagagtggctgcagggccccctgagaccacatcgcttatgagtgacagagctaaactccagctcaggtcttctgattctaacgtgactgcttttgctgctaaactggcttcctctctaaagaagacaaagtaggaagagaaaaagaaaatgtaaagtattctatctaaggtttcagcttttagtaataacacgatggaatggctttcaagaaaagttatcaggtgggtgcggtggctcacacctgtaattccaacactttgggaggctgaggcaggcggattacaaggtcaggagaccagcctggccaacatgatgagacctcatctctactaaaaatacaaaaaattagctgggcgtggtggcccacacctgtagtcacagctactcgggaggctgaggcaggagaattgctagaacccaggaggcggaggttgtggtgagccgagattgtaccattgcactccagcctgggcgacagagcaagtctcc

SEQ ID NO: 7665 - DNA, 153 bp, Homo sapiens; identical to SEQ ID NO: 6795

SEQ ID NO: 7666 - DNA, 269 bp, Homo sapiens
tcccagcactttgggaggccgagacgggcggatcacaaggtcaggaaattgagaccatcctggctaacacggtgaaaccctgtctctactaaaaatatttaaaaattagccgggcgtggtggcgggcgcctgtagtcccagctactcgggaggctgaggcaggagaatggcgtgaacccgggaggcggagcttgcagtgagccgagattgcgccactgcactccagcctgggcgacagagcgagaccacgtctcaaaaaaaaaaaaaaa

SEQ ID NO: 7667 - DNA, 202 bp, Homo sapiens
tactaaaaatacaaaaaattagccgggcgtagtggcgggcgcctgtagtcccagctactcgggaggcttaggcaggagaatggcgtgaacccgggaggcggagcttgcagtgagccgagatcccgccactgcactccagcctgggcgacagagcgagactccatctcaaaaaaaaaaaaaaaaaaaaaaaaaaaaaaagaaa

SEQ ID NO: 7668 - DNA, 203 bp, Homo sapiens; identical to SEQ ID NO: 7398

SEQ ID NO: 7669 - DNA, 121 bp, Homo sapiens
ggctgaggcaggaaaatggcatgaacccgggaggcggagcttgcagtgagctgagatcgcagcactgcactccagcctgggcaacagagcgagactccatctcaaaaaaaaaaaaaaaaaa

SEQ ID NO: 7670 - DNA, 166 bp, Homo sapiens
ctgggcgtggtggcgggtgcctgtagtcccagctacttgggaggctgaggcaggagaatggcgtgaacccgggaggcggagcttgcagtgagccgagatcaggccactgcactccagcctgggcaacagagtgagactccgtctcaaaaaaaaaaaaaaaaagata

SEQ ID NO: 7671 - DNA, 295 bp, Homo sapiens
ccgggcgtggtggctcacgcctgtaatcccagcactttgggaggccgaggcgggaggatcacgaggtcaggagatcaagaccatcctggctaccaaggcgaaactccttctctactaaaaatacaaaaaattagccgggcgtggtggcgggcgcctgtagtcccagctactcgggaggctgaggcgggagaatggcgtgaacccaggaggtggagcttgcagtgagccgagatcatgccactgcactccagcctgggcaacagagcaagactccgtctcaaaaaaaaaaagaaaa

SEQ ID NO: 7672 - DNA, 310 bp, Homo sapiens
actgagggccgggcgtggtggctcacgcctgtaatcccagcactttgggaggccgaggcgggcagatcacgaggtcaggagatcgagaccatcctggctaacacggtgaaaccccgtctctactagaaatacaaaaaaattagccgggcatggtggtgggcacctgtagtcccagctactcgggaggctgaggcaggagaatggcatgaacccgggaggtggagcttgcagtaagctgagatcacgccactgcactccagcctgggcaacagagtgagactctgtctcagaaaaaaaaaagaaaagaaaa

SEQ ID NO: 7673 - DNA, 280 bp, Homo sapiens
cggatcacgaggtcaggagatcgagaccatcctggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcttgggcgacagagcgagactccgtctcaaaaaaaaaaaaataaataaaaaaaaaaaaaaaaaaaaaaaaaagaaaagaaaaa

SEQ ID NO: 7674 - DNA, 190 bp, Homo sapiens
atcactgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaagaaa

SEQ ID NO: 7675 - DNA, 278 bp, Homo sapiens
aatcccagcactttgggaggccgaggcgggcggatcaacaggtcaggagatcgagaccatcctggctaacaaggtgaaaccccatctctactaaaaatacaaaaattagcccggcgtggtggtgggcgcctgtagtcccagctactcgggaggttgaggcaggagaatggcgtgaacccaggaggcggagcttgcagtgagccaagattgcgccactgcactccagcttgggtgacagaccgagactccgtttcaaaaaaaaaaaaaaaaaaaagaat

SEQ ID NO: 7676 - DNA, 2364 bp, Homo sapiens; identical to SEQ ID NO: 6735

SEQ ID NO: 7677 - DNA, 304 bp, Homo sapiens
aaaaggccgggtgcggtggctcacacctgtaatcccagcactttgggaggccgaggcaggcggatcatgaggtcaggagatcgagaccatcctggctaacacggtgaaaccccgtctccactaaaaatacaaaaaattagccgggcacggtggcgggcgtctgtagtcccagctactagggaggctgaggcaggagaatggtgtgaacccaggaggcggagcttgcagtgagccaagatcgcgccactgcagtccagcctgggcgaaagagcagactccgtctcaaaaaaaaaaaaaaaaaaaa

SEQ ID NO: 7678 - DNA, 261 bp, Homo sapiens
ggatagtgaggtcaggagatcgagaccatcctggctaacacggtgaaaccccctctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaagaaaaagggataaaa

SEQ ID NO: 7679 - DNA, 297 bp, Homo sapiens
tggctcactcgtgtaatccagcactttgggaggccgaggcgggcagatcacaagatcaggagatcgagaccttcctggctaacacggtgaaaccccgtctctactaaaaatacaaaaaattagccgggcctagtggcgggcgcctgtagtcccagctactcgggaggctgaggcaggagaatggcatgaacccgggaggcggagcttgcagtgagcccagatcgtgccactgcactccagcctgggcgacagagcgagactccgtctcaaaaacaacaacaacaaaacaaaacacca

SEQ ID NO: 7680 - DNA, 108 bp, Homo sapiens
ctgaggcaggagaatggcgtgaacccagaaggcggagcttgcagtgagccaagatcgtgccactgcactccagcctgggcgacagagcgagactccatctcaaaaaaa

SEQ ID NO: 7681 - DNA, 312 bp, Homo sapiens
gtcctgggccgggcgcggtggctcacgcctgtaatcccagcactttgggaggccgaggcgggcggatcacgaggtcaggagatcgagacgatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggggacagagcgagactccgtctcaaaaaaaaaaaaaaaaaagactgtc

SEQ ID NO: 7682 - DNA, 158 bp, Homo sapiens
gcctgtagtcccagctactcgggaggctgaggcaggagaatggcatgaacccaggaggcggagcttgcagtgagcagagatcgcgccactgcactccagcctgggcaacagagcgagactctgtctcagaaaaaaaaagaaaaaagaaaaaagaaaat

SEQ ID NO: 7683 - DNA, 298 bp, Homo sapiens; identical to SEQ ID NO: 6737

SEQ ID NO: 7684 - DNA, 237 bp, Homo sapiens
aggtcaggagatggagaccatcctggctaacatggtgaaaccccgtctctactaaaaatacaaaaaattagccgggcgtggtggcaggcgcctgtagtcccagctactcgggaggctgaggcaggagaatggcgtgaatccaggtggagcttgcagtgagctgagatcgcgccactgcactccagcctgggtgacagagtgagactccatctcaaaaaaaaaaaaaaaaaaaaaaga

SEQ ID NO: 7685 - DNA, 296 bp, Homo sapiens
ggctgggcgcggtggctcacgcctatgatcccacactttgggaggccgaggtgggcggatcatgaggtcaggagatcgagaccatcctggctaatacggtgaaaccccgtctctactaaaatacaaaaaattagccgggcgtggtggcgggtgcctgtagtcccactactcgggaggctgaggcaggagaatggcgtgaacccaggaggcagagcttgcagtgagcggagatcatgccactgcactccagcctgggtgacagagcaagactccatctcaaaaaaaaaaaaaaagaa

SEQ ID NO: 7686 - DNA, 311 bp, Homo sapiens; identical to SEQ ID NO: 6738

SEQ ID NO: 7687 - DNA, 294 bp, Homo sapiens
gcttggaggctcatgcctgtaatcccagcactttgggaggccgaggcgggcggatcacaaggtcaggagatcgagaccatcctggctaacacggtgagaccctgtctctactaaaaatacaaaaaattagccaggcgtggtggcgggcgcctgtagtcccagctactcgggaggctgaggcaggagaatggcgtgaacccgggagcggacttgcagtgagccgagatcgcgccactgcactccagcccgggcaacagagcgagactctgtctcaaaaaaaaaaaaaaaaaagct

SEQ ID NO: 7688 - DNA, 303 bp, Homo sapiens
aaggaggccgggcgcggtggctcacgcctgtaatcccagcactttgggaggccaaggagggcggatcacgaggtcaggagatcgagaccatcctggctaacacagtgaaaccctgtctctactaaaaatacaaaaaactagctgggcatggtggcggatgcctgtagccccagctacttgggaggctgaggcaggagaatggcgtgaacccgggaggcggaggttgcagtgagcggagattgcgccactgcactccagcctgggggacagagccagactccgtctaaaaaaaaaaaaaaaaaa

SEQ ID NO: 7689 - DNA, 191 bp, Homo sapiens
aaaaaacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagtta

SEQ ID NO: 7690 - DNA, 193 bp, Homo sapiens
cgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaattgactcctaatcaaaaa

SEQ ID NO: 7691 - DNA, 195 bp, Homo sapiens
aaatacaaaaattagccgggcgtagtggtgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaagataattctaacaaaca

SEQ ID NO: 7692 - DNA, 281 bp, Homo sapiens
cactttgggaggccgaggcgggcggatcacgaggtcaggagatcgagaccatcctggctaacacggggaaaccccgtctctactaaaaatacaaaaaatgagccgggcgcggtggcgggcgcctgtggtcccagctactcgggaggctggggcaggagaatggcgcgaacccgggaggcggagcttgcagtgagccgagatcgcgccaccgcactccagcctgggcgacagagcgagactccgtctcaaaaaaaaaaaaaagaaaaagaaaaaggacaaca

SEQ ID NO: 7693 - DNA, 301 bp, Homo sapiens
atagccgggcgcggtggctcatgcctgtaatcccagcactttgggaggctgaggtgggcagatcacgaggtcaggaaatcgagaccatcctggctaacacggtgaaaccccatctctactaaaaaatacaaaaaattagccgggcgtggtggtgggtgcctgtagtcccagctactcaggaggctgaggcaggagaatggtgtgaacccgggaggtggagcttgcagtgagccgagatcgcgccactgcactccagcctgggcgacagaacaagactccgtctcaaaaataaataaataaa

SEQ ID NO: 7694 - DNA, 310 bp, Homo sapiens
agccgggcgcggtggctcacgcctgcaatcccagcactttgggaggccaaggcgggcagatcacaaggtcaggagatcgagaccatcctggctaacacggtgaaaccccgtctctactaaaaatacaaaaacaaaactagccgggcttggtggtgggcgcctgtagtcccagctactcaagaggctgaggcaggagaatggcgtgaactcgggaggcggagcttgcaatgagccgagatcgcgccactgcactccagcctgggcgacagagcgagactccgtctcaaaaaaaaaaaaaaaaaaaaaaaaa

SEQ ID NO: 7695 - DNA, 297 bp, Homo sapiens
gtgcggtggctcacgcctgtaatcccagcactttgggaggccaagccgggcggatcatgaggtcaggagatcgagaccatcctggctaacacggtgaaaccctgtctctactaaaaatacaaaaaattagccgggcgtggtggcgggtgcctgtagtcccagctactcgggaggccgaggcaggagaatggtgtgaacccgggaggtggagcttgcagtgagccgagatcgggccactgcactccagcctgggcgacagagcaagactctgtctcaaaaaaaaaaaagaaatggaaa

SEQ ID NO: 7696 - DNA, 182 bp, Homo sapiens
tactaaaaatacaaaaagttagccgggcgaagtggcgggcgcctgtagtcccagctactcgggaggctgaggcaggagaatggcgtgaacccgggaggcggagcttgcagtgagccgaaatcgcgccactgcactccagcctgggtgacagagcgagactccgtctcaaaaaaaaaaaaaaa

SEQ ID NO: 7697 - DNA, 303 bp, Homo sapiens
ataggctgggcgcggtggctcacgcctgtaatcccagcactttgggaggccgaggcaggcggatcatgaggtcaggagatcgagaccatcctggctaacacggtgaaacccagtctctactaaaaatacaaaaaattagctgggtgtgctggcaggcatctgtagtcccaactactcgggaggctgaggcgggagaatggcatgaacctgggaggcggagcttgcagtgagccgagatcacgccactgcactccagcctgggcgacagagtgagactacctctccaaaaaaaaaaaaaaaaaa

SEQ ID NO: 7698 - DNA, 297 bp, Homo sapiens
gggcgcggtggctcacgtctgtaatcccagcactttgggaggccgaggggggcggatcacgatgtcaggagatcgagaccatcctggctaacatggtgaaaccctgtctctgctaaaaatacaaaaaattagcagggcgtggtggcgggcgcgtgtagtcccagctactcaggaggctgaggcaggagaatggagtgaacccaggaggcggacgtgcagtgagccgagatcgcgccactgcactccagcctgggcgacagagcaagactccgtctcaaaaaaaaaaaaaaaaaaaaa

SEQ ID NO: 7699 - DNA, 323 bp, Homo sapiens
aaaaaactatttttcggccggggggggtggatcacgcctgtaatcccagcactttgggaggccgaggcgggcagatcacgaggtcaggagatcgagaccatcctggctaacacggtgaaaccccgtctctactaaaaaaacaaaaaattagccgggcgtggtagcgggagcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaacaaaaa

SEQ ID NO: 7700 - DNA, 277 bp, Homo sapiens
ataagtcactttgggaggccgagacgggcggatcacgaggtcaggagatggagaccatcctggctaacacggtgaaaccccgtctctactaaaaatacaaaaaaattagccgggcgtagtggcgggcacctgtagtcccagctactccggaggctgaggcaaggagaatggcgtgaacctgggaggcggagcttgcagtgagccgagatggcgccactgcactccagcctgggtgatggagcgagacttgtctcaaaaaaaaaaaaaaaaagaataa

SEQ ID NO: 7701 - DNA, 303 bp, Homo sapiens
gccgggcgtggtggctcacgcctgtaatcccagcactttgggaggctgaggcaggcggatcacaaggtcaggagatcgagaccatcctggctaacacggtgaaacccctctctactaaaaatacaaagaattagccgggtgtggtggcgcacgcctgtagtcccagctactcgggaggctgaggcaggagaatggcgggaacccgggaggcagagcttgcagtgagccaagatcgtgccactgcactccagcctgggtgacagagcgagactccacctcaaaaaaaaaaaaaaaaaaaaagaa

SEQ ID NO: 7702 - DNA, 309 bp, Homo sapiens
cctgtaatcccagcactttgggaggccgaggcgggcggatcacaaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggctgagcttgcagtgagccgagatcccgccactgcactccagcctgggcgacagagcgagactccgtctcaaaaaataaaaataaaaataaaaaataataataaaaataaaaaataaaa

SEQ ID NO: 7703 - DNA, 310 bp, Homo sapiens
ggacgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggaggttgcagtgagccgagatcccgccactgcactccagcctgggcgacagagcgagactccgtctcaaaaaaaaaaaaaaaaaaaaaaaaaaaat

SEQ ID NO: 7704 - DNA, 247 bp, Homo sapiens
aggccgaggcgggcggatcacgaggtcaggagatcgagaccaacctggctaacacagtgaaaccccgtctctaccaaaatacaaaaaattagccgggggtagtggcgggcgccttgtagtcccagctacttgggaagctgaggcaggagaatggcatgaaccagggaggcggagcttgcagtgagccgagatcgcaccactgcactccagcctgggcgacacagcaagactccgtctcaaaaaaaaa

SEQ ID NO: 7705 - DNA, 175 bp, Homo sapiens
ccaaaaattagccgggcgtggtggcgggcgcctgtagtcccagctactcgggaggctgaggcaggagaatggcgtgaacccgggaggcggagcttgcagtgagctgagatcgcgccattgcactccagcctgggcgacagagccagactcagtctccaaaaaaaagaagaaaaga

SEQ ID NO: 7706 - DNA, 311 bp, Homo sapiens
actgtcttaggccaggcgtggtggctcacgcctataatcccagcactttgggaggccaaggtgggcggatcacgaggtcaggagatcgagaccatcctggctaacacggtgaaaccccgtctctgctaaaaatacaaaaaattagccgggcatggtggcgggcgcctgtagtcccagctactcgggaggctgaggcaggagaatggcgtgaacccaggaggcgcagctttcagtgagccgagatcgcgccactgcactccagcctgggcgacagagctaaactccgtctcaaaaaacaaaacaaaacaaaa

SEQ ID NO: 7707 - DNA, 183 bp, Homo sapiens
gaaaaatttagccgggcgtggtggcgggcgcatgtagtcccggctactcgggaggctgaggcaggagaatggcgtgaacccgggaggcggagcttgcagtgagccgagatggcgccactgcactccagcctgggcgacagagcgagactccgtctcaaaaaaaaaaaaaaaaataataatgaa

SEQ ID NO: 7708 - DNA, 292 bp, Homo sapiens
tggctcaagcctgtaatcccagcactttgggaggtcgaggcgggcggatcacgaggtcaggagatcgagaccatcctggctaacacggtgaaaccttgtctctactaaaaatacaaaaattagccgggcatagtggcgggcgcctgtagtcctagctactcgggaggctgaggcaggagaatggcgtgaacccgggaggtggagcttgcagtgagctgagattgcgccactgcactccagcctgggtgacagagtgagactccgtctcaaaaaaaaaaaaaaaattaaaaaa

SEQ ID NO: 7709 - DNA, 93 bp, Homo sapiens
gagctggcagtgagccgagatcccgccactgcactccagcctgggcgacagagcgagactccgtctcaaaaaaaaaaaaaaaaaaaaagaaaa

SEQ ID NO: 7710 - DNA, 287 bp, Homo sapiens
ttgtaatcccagcactttgggaggccgaggcgggcggatcacaaggtcaggagatcgaaaccatcctggctgacacggtgaaaccccgtctctactaaaaatacaaaaaaatggccgggtgtggtggcgagcacctgcctgtagtcccagctactcgggaggctgaggcaggagaatggcttgaacccgggaggcggagcttgcagtgagccgagatcgcgccactgcactccagcctaggcgacagagcaagactccctctccaaaaaaaaaaaaaaaaaaaaaaa

SEQ ID NO: 7711 - DNA, 136 bp, Homo sapiens; identical to SEQ ID NO: 6219

SEQ ID NO: 7712 - DNA, 273 bp, Homo sapiens
  misc_feature (18)..(18): n equals a,t,g, or c
tcttttgggaggccgagncgggcggatcacgaggtcaggagatcgagaccatcctggcaaacacggtgaaaccccgtctctactaaaaatacaaaaaaattagccgggcgtggtggcgggcgcctgtagtcccagctactcgggaggctgaggcaggagaatggcgtgagcccgggaggcggagcttgcagtgagcggagatcgcgccaccgcacttcagcctgggcgacagagcaagactcttgtctcaaaaaaaaaaaaaaaaagtggcag

SEQ ID NO: 7713 - DNA, 296 bp, Homo sapiens
cgggcgcggtggctcacgcctgtaatcccagcacttggggaggccgaggcgggcggatcacgatgtcaggagatcgataccatcctggctaacacggtgaagccccatctctactaaaaatacaaaaaattatccgggcgtggtggcggccgcctgtagtcccagctactcgtgaggctgaggcaggagaatggcatgaacccgggaggcggagcttgccgtgagccgagattgcgccactgcactccagcctgggcgacagagccagactccgtctcaaaaacaaacaaacaaaa

SEQ ID NO: 7714 - DNA, 308 bp, Homo sapiens
agggccgggcgcggtggctcatgcctgtaatcccagcactttgggaggccgaggcgggcggatcacgaggtcaggagatcgagaccatcctggctaacgtggtgaaaccccgtctctactaaaagtacaaataaaaaattagccgggcgtggcggtgggcgcctgtagtcccagctactcgggaggctgaggcaggagaatggcgtgaacccgggaggcggagcttgcagtgagccgagattgcgccactgcactccagcctgggcgacacagcaagactccgtctcaaaaaaaaaagttgaaaagct

SEQ ID NO: 7715 - DNA, 138 bp, Homo sapiens
cgggaggctgaagcaggagaatggcgtgaacccaggaagcggagcttgcagtgagccgagattgcgccactgcactccagcctgggtgacagagccagactcggtctcaaaaaaaaaaaaaaaaaaaaaaaaaagaaa

SEQ ID NO: 7716 - DNA, 243 bp, Homo sapiens
tcacgaggtcaggagatcgagaccatcctggctaacacggtgaaaccccgtctctactaaaaatccaaaaaattagccgggcgtggtggtgggcgcctgtagtcccagctactcgggaggctaaggcagaagaatggcaggaacctgggaggcggagcttgcagtgagccgagatcacgccactgcactccagcctgggcgacagagcgagactccgtctcaaaaaaaaaaaaaaaaaaaatt

SEQ ID NO: 7717 - DNA, 296 bp, Homo sapiens
gcgcggtggctcaagcctgtaatcccagcactttgggaaaccgaggcgggtggatcacaaggtcaggagatcgagaccatcctggctaacacggtgaaaccccatctctactaaaaaatacaaaaaaacttagccgggtgtggtggcgggcgcctgtagtcccagctactcaggaggctgaagcaggagaatggcgtgaacccgggaggcggagcttgcagtgagccgagatcgcgccactgcactccagcctgggggacagagcgagactccatctcaaaaaaaaaaaaaaaaaa

SEQ ID NO: 7718 - DNA, 202 bp, Homo sapiens
ctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgagtgacagagcgagactccgtctcaaaaaaaaaaaaaaaaaaaaaggttaatatgtaa

SEQ ID NO: 7719 - DNA, 248 bp, Homo sapiens
gaggtggatggatcatgaggtcaggagatcgagaccatcctggctaacacagtgaaaccccgtctctactaaaaatacaaaaaattagccaggcgtgatggcgggcgcctgtagtcccagctactcgggaggctgaggcaggagaatggcgggaacctgggaggcggagcttgcagtgagccaagatcgcgccactgcaccccagcctgggtgacagagcgagactccgtctcaaaaaaaaaaaagaa

SEQ ID NO: 7720 - DNA, 192 bp, Homo sapiens
aatacaaaaaattagccgggcgtagtggcgggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaagaagtagacaaaa

SEQ ID NO: 7721 - DNA, 320 bp, Homo sapiens; identical to SEQ ID NO: 6742

SEQ ID NO: 7722 - DNA, 274 bp, Homo sapiens
atgcctgtaatcccacactttgggaggccgaggcaggcggatcacgaggtcaggagatcgagaccatcctggctaacacggtgaaaccctttctctactaaaaatacaaaaaattagccgggcgtggtggcggtcgcccgtagtcccagctactcgggaggctgaggcagaagaatggcgtgaacctgggaggcagagcttgcagtgagccgagatcggtccactgcattccagcctgggtgacagagcgagactccgtctcaaacaaaaaaaa

SEQ ID NO: 7723 - DNA, 308 bp, Homo sapiens; identical to SEQ ID NO: 6743

SEQ ID NO: 7724 - DNA, 153 bp, Homo sapiens
gggcgtggtggcgggcgcctgtagtcccagctactcgggaggctgaggcaggagaatggcgtgaacccgggaggcggagcttgcagtgagctgagatcaccccactgcactccagcctgggcgacagagtgagactctgtctcaaaaaaaaaa

SEQ ID NO: 7725 - DNA, 300 bp, Homo sapiens; identical to SEQ ID NO: 6744

SEQ ID NO: 7726 - DNA, 308 bp, Homo sapiens
ggtctgccaggcgcagtggctcacgactgtaatcccagcactttgggaggccgaggcgggcggatcacgaggtcaggagatcgagaccatcctggctaacacggtgaaacccggtctctactaaaaatacaaaaagttagccgggcgtggtggcgggcgcctgtagtcccatctactcgggaggctgaggcaggagaatggcgtgaacccgggaagtggagcttgcagtaagccgagatcgtgccactgcactccagtctgggcgacagagcgagactccgtctcagaaaataaacaaacaaaaaatc

SEQ ID NO: 7727 - DNA, 150 bp, Homo sapiens; identical to SEQ ID NO: 7399

SEQ ID NO: 7728 - DNA, 279 bp, Homo sapiens
aatcccagcactttgggaggccgaggcgggcagatcacgaggtcaggagatcgagaccatcctggctaacacggtgaaaccctgtctctatgaaaaatacaaaaaattagccgggcgtggtggcgggcgcctgtagtcccagctacttgggaggctgaggcaggagaatggtgtgaacccaggaggcagagcttgcagtgagcggagatcgggccactgcagtccagcctgggcaacagagcaagactccgtctcaaataaaaaacaaaacaaaacaaa

SEQ ID NO: 7729 - DNA, 198 bp, Homo sapiens
aaccccgtctctactaaaaatacaaaaaaattagctgggcgtggtggtgggcgcctgtagtcccagctactcgggaggctgaggcaggagaatggcgtgaacccaggaggcggcttgcagtgagccgagatcgcgccactgcactccagcctgggtgacagagcgagactctgtctcaaaaaaaaaaaaaaagcaatt

SEQ ID NO: 7730 - DNA, 287 bp, Homo sapiens
acgcctgtaatcccagcactttgggaggccgaggtgggcggatcacgaggtcaggagatcaagaccatcctggctaacacggtgaaaccccgtctctactaaaaatacaaaaaattagccgggcgtggtagcgggcgcctgtaatcgggggtactccggaggctgaggcaggagaatggcgtgaacccgggaggcggagcttgcagtgagccgagattgcgccactgcactccagcctgggcgacagagcgagacttcatctcaaaaaaaaaaaaaaaaaaaaaaaa

SEQ ID NO: 7731 - DNA, 135 bp, Homo sapiens
ctactcaggaggctgaggcaggagagtggcgtgaacccgggaggcagagcttgcagtgagccgagatcgcgccactgcactccagcctggatgacagagcaagactccgtctcaaaaaaaaaagaaaaaaagaca

SEQ ID NO: 7732 - DNA, 266 bp, Homo sapiens
atttgggaggccgaggcgggcggatcacaaggtcaggagatcgagaccatcctggctaacacggtgaaaccccgtctctactaaaaatacaaaaaaattacccgggcgtggtggtgggcgcctgtggtcccagctactcgggaggctgaggcaggagaatggtgtgaacccgggaggcggagcttgcagtgagccgagatcgcaccactgcactccagcctgggcgacagagcgagactccatctcaaaaaaaaagaaataagaaa

SEQ ID NO: 7733 - DNA, 322 bp, Homo sapiens; identical to SEQ ID NO: 6747

SEQ ID NO: 7734 - DNA, 250 bp, Homo sapiens
gggcggatcacgaggtcaggagatcgagaccatcctggctaacacggtgaaaaccctgtctctactaaaaatacaaaaaattagccaggcttggtggcgggcgcctgtagtcccagctactcgggaggctgaggcaggagaatggcgtgaacccgggaggcggagcttgcagtgagctgagatcgcactactgcactccagcctgggcgacagagcgtgactccgtctcaaaaaaaagcaattagaaact

SEQ ID NO: 7735 - DNA, 142 bp, Homo sapiens; identical to SEQ ID NO: 7400

SEQ ID NO: 7736 - DNA, 40 bp, Homo sapiens
tgagactccgtctcaaaaaaaaaaaaaaaaagtgaaaagg

SEQ ID NO: 7737 - DNA, 181 bp, Homo sapiens
caaaagttagccgggcgtagtggcgggcgcctgtggtcccagctactcgggaggctgaggcaggagaatggcgtgaacccgggaggcggagcttgcagtgagccgagatcgcgccactgcactccagcctgggtgacagagcgagactccgtctcaaaaaaaaaaaaaaaaaaaaaagatt

SEQ ID NO: 7738 - DNA, 281 bp, Homo sapiens; identical to SEQ ID NO: 6748

SEQ ID NO: 7739 - DNA, 122 bp, Homo sapiens
cgggaggctgaggcaggagaatggcgtgaacccaggaggcggagcttgcagtgagccgagatcgcgccactgctctccagcctgggcgacagagcaagactctgtctcaaaaaaaaaaaaga

SEQ ID NO: 7740 - DNA, 123 bp, Homo sapiens; identical to SEQ ID NO: 6220

SEQ ID NO: 7741 - DNA, 176 bp, Homo sapiens
aaaattagccgggcataatggcgggtgcctgtagtcccagctactcaggaggctgaggcaggagaatggcatgaacccaggaggcggagcttgcagtgagtggagatcgcgccactgcactccagcctgggcgacagagcgagactccgtctcaaaaaaaaaaaaaaaaaaaaatc

SEQ ID NO: 7742 - DNA, 270 bp, Homo sapiens; identical to SEQ ID NO: 6749

SEQ ID NO: 7743 - DNA, 301 bp, Homo sapiens
ggccaggcacggtggcttacgcctgtaatcccagcagtttgggaggccgaggcaggcggatcacgaggtcaggagatcgagaccatcctggctaacacggtgaaaccccgtctctactaaaaatacaaaaaaaattagccgggcgtgttggcgggtgcctgtagtcccagctactcgggaggctgaggcaggagaatggcatgaacccaggaggcggagcttgcagtgagccgagattgtgccactgcactccagcctgggcaacagagcaagactctgtctcaaaaaaaaaaaaaaaaga

SEQ ID NO: 7744 - DNA, 237 bp, Homo sapiens
catcctggctaacacggtgaaaccccgtctccactaaaaatacaaaaaattagccgggcgtggtggcgggcgcctgtagtcccagccactcgggaggctgaggcaggagaatggcgtggacccgggaggcggagcttgcagtgagcggagatcgcgccactgcactccagcctgggcgactgagcaggactccgtctcaaaaaaaaaaaaaagaaaagaaaaaaagaaagaaagaaa

SEQ ID NO: 7745 - DNA, 301 bp, Homo sapiens
cccggtggctcacgcctgtaatcccagcactttgggaggccgaggcgggcggatcacaaggtcaggagatcgagaccatcctggctaacacggtgaaaccccgtctctactaaaaatacaaaaaattagctgggcgtcgtggcgggcgcctgtggtcccagttactctggaggctgaggcacgagaatggcgtgaacccaggaggcggagcttgcagcgagctgagatcgcaccactccactccagcctgggcaacagagcgagactctgtctcaaaaaaaaaaaaaaaaaaaaaaaaatc

SEQ ID NO: 7746 - DNA, 88 bp, Homo sapiens
gcggaggttgcagtgagctgagatcgcgccactgcactccagcctgggcgacagagcaagaatccatctcaaaaaaaaaaaaaaaaag

SEQ ID NO: 7747 - DNA, 278 bp, Homo sapiens; identical to SEQ ID NO: 6751

SEQ ID NO: 7748 - DNA, 214 bp, Homo sapiens
ccccgcctctactaaaaatacaaaaaattagccgggcgtggtggcgggcgcctgtggtcccggctactcgggaggctgaggcaggagaatggcgtgaacccgggaggcggagcttgcagtgagccgaggtcgcgccactgcactccagcctgggcgacagagcgagactccgtctcaaaaaaaaaaaaaaaaaaaaaaaaaagattacacaata

SEQ ID NO: 7749 - DNA, 299 bp, Homo sapiens; identical to SEQ ID NO: 6752

SEQ ID NO: 7750 - DNA, 297 bp, Homo sapiens
  misc_feature (22)..(22): n equals a,t,g, or c
  misc_feature (29)..(29): n equals a,t,g, or c
  misc_feature (94)..(94): n equals a,t,g, or c
  misc_feature (261)..(261): n equals a,t,g, or c
aaagttggctgggcgcgatgcntcacgcntgtaatcccagcactttgggaggccgaggcgggtggatcacgaggtcaggagatcgagaccatcntggctagcacggtgaaaccccgtctctactaaaaatacaaaagattagccgggcgtggtggcgggcgcctgtagccccagctactcgggaggctgaggcaggagaatggcgtgaacccgggaggcggagcttgcagtgagccgagatcgcgccactgcactccagcntgggcgacagagcgagactccgtctcaaaaaagaaa

SEQ ID NO: 7751 - DNA, 177 bp, Homo sapiens
ccgggcacggtggcgggcgcctgtagtcccagctactcaggaggctgaggcaggagaatggcatgaacccgggaggcggagcttgcagtgagccgagatcgcgccactgcactccaccctgggcgacagagcgagactccgcctcaaaaaaaaaaaaaaaaaaaaaaaaagaaggtc

SEQ ID NO: 7752 - DNA, 296 bp, Homo sapiens
aagccaggcacagtggctcacgcctgtaatcccagcactttgggaggctgaggcgggtggatcatgacgtcaggagatcaagaccatcctggctaacatggtgaaaccccgtctctactaaaaatacaaaaaaattagccaggtgtggtggcgggcacctgtagtcccagctacttgggaggctgaggcaggagaatggcgtgaacccgggaggcggagcttgcagtgagccgagatcgcgccactgcactctagcctgggcaacagagcgagactccatctcaaaaaaaaaaaaa

SEQ ID NO: 7753 - DNA, 318 bp, Homo sapiens
tgactttggccgggcgcggtggctcacgcctgtaatcccagcactttgggaggccgagacgggcggatcacgaggtcaggagatcgagaccatactggctaacacggcgaaaccccgtctctactaaaaataccaaaaattagctgggcgtggtggcgggcgcctgtagtcctagctacttaggaggctgaggcaggagaatggagtgaacccgggaggcggagcttgcagtgagccaagatcgcgccactgcactccagcctgggcgacagagcgagactccgtctcaaaaaaaaaaaaaaaaaaaaaaaaagaaca

SEQ ID NO: 7754 - DNA, 275 bp, Homo sapiens
accactttgggatggcgaggcgggcggatcacgaggtcaggagatcgagaccatcctggctaacacagtgaaaccctctctctactgaaaatacaaaaaaaattatctgggcatggtggcgggcgcctgtagtcccagctactcgggaggctgaggcaggagaatggcgtgaacccgggaggcggagcttgcagtgagccgagatcgcgccactgcactccagcctgggtgacagagtgagactccgtctcaaaaaaaaaaaaaaaagaaaaaaa

SEQ ID NO: 7755 - DNA, 154 bp, Homo sapiens
tgtagtcccagctactcggtaggctgaggcaggagaatggcgtgaacccaggaggccgaggttgcagtgagctgagatagcaccactgcactccagcctgggcgacagagcgagactccgtctcaaaaaaaaaaaaaaaaaaaaaaagggccgc

SEQ ID NO: 7756 - DNA, 177 bp, Homo sapiens
caccaaccactcgggcatggtggcgcgcgcctgtagtcccagctacacggcaggctgaggcaggagaatggcgtgaacccgggaggcggagcttgcagtgagttgagatcgcgccactgcactccagcctgggcgacagagcgaaactccgtctcaaaaaaaaaaaaaaaagacaaa

SEQ ID NO: 7757 - DNA, 187 bp, Homo sapiens
aaaatacaaaaaatagccgggcgtagtggcgggcgcctgtagtcccagctactcaggaggctgaggcaggagaatggcgtgaacccgggaggcggagcttgcagtgagccgagatcgcgccactgcactccagcctgggcgacagagccagactccgtcccccagccaccaaaaaaaaaaaacaatt

SEQ ID NO: 7758 - DNA, 307 bp, Homo sapiens
gccgggcgcggtggctcacgcctgtaatcccagcactttgggaggccgaggcgggcggatcatgaggtcaggagatcgagaccatcctggctaacacggtgaaaccccatctctactaaaaatacaaaaaattagccaggcgtggtggcgggcgcctgtagtcccagctactcgggaggctgaggcaggagaatggcgtgaacctgggaggcggagcttgcagtgagccgagatcgcgccactgaactccagcctgggcgacagagcgagactccgtctcaaaaagaaaataaaaaagaaaaatttc

SEQ ID NO: 7759 - DNA, 166 bp, Homo sapiens
ggcgtgcgcctgtagtcccagctactcgggaggctgaggcaggagaatggcgtgaacccgggaggcggagcttgcagtgagccgagatcgtgccactgcactccagcctgggtgacagagcaagactccgtctcaaaaaaaaaaaacaaaaaaaacatgtaggcag

SEQ ID NO: 7760 - DNA, 1209 bp, Homo sapiens
attcacacctgtaatcccagcactttgggaggccgaggcaggcagatcacaaggtcaggaaattgagaccatcctggctaacacggtgaaaccccatctctactaaaaatacaaaaaattagccgggcatagtggtgggcgcctgtagtcccagctactcgggaggctgaggcaggagaatggcgtgaacccaggaggcagagcttgcagtgagcagagatggcaccactgcactccaacctgggagacagagcgatactccgtctcaaaaaaaaaaaaattagctgggtgtggtggcacacacctatagtcccagctacttgggaggctgaggtgggaggatcatctgagcccaggagatggaggctgcagtgagtttatgattgtgccactctgcgctccaacctgggcaacagagcgagaccttgtctaaaaaaaaaaaagtgggccaggcgtggtggctcatgcctgtaatcccagcactttgggaggccaaggtgggcagatcatctgaggtcaggagttcgagaccagcctgaccaaaatggcaaaaccccatctctaataaaaatacaaaaaaattagccaggcgtggtggtatgtgcctgtaatcacagctactagggaggctgaggcaggagaatcgctggaaccaggaagcgggattgtagtgagccaagatcgtgccattgcactgcagcctgggtgacagagcaagactctgtatcaaagaaaaaaaaaaaaaaaggtcaggattgcccagggcctatgggaagggagagatgaattggcagatttttagcacaacgaatatgatactgtgcactgtgaatatgatactgtgcactgtgaatatgatactgtatgatactataatgccagatacaagacatatgcaccttggccaggcacagtggctcatgcctgtaaccccagcactttgggaggcagaggcaggcagattacctgaggtcaggaattcgagaccagtctggccaacatggcaaaaccccgtctctgctaaaaatacaaattagctgggcgtggtggcacatgcctctagtcccagctactcgggaggctgaggcaggagaacagcttgaacccgggacatagaggttgcagtgatccgagatcgcgccaccacactccagcttgggtgacagagcaagacaccctctcaaaaaaaaaaaaaaaaaaaaaaaaaaa

SEQ ID NO: 7761 - DNA, 142 bp, Homo sapiens; identical to SEQ ID NO: 7402

SEQ ID NO: 7762 - DNA, 306 bp, Homo sapiens; identical to SEQ ID NO: 6754

SEQ ID NO: 7763 - DNA, 3098 bp, Homo sapiens
ctcatatttttcccagacgcggaggttggggtcatggcgccccgaagcctcctcctgctgctctcaggggccctggccctgaccgatacttgggcgggtgagtgcggggtccagagagaaacggcctctgtggggaggagtgaggggcccgcccggtgggggcgcaggactcagggagccgcctccggaggagggtctggcgggtctcagcccctcctcgcccccaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctggtgagtgaacccggccgggggcgcaggtcacgaccaccccccatccgccacggaccgcccgggtccctcagagtctccggatccgaaatctaccccgaggcagcgggacccgcccagaccctccacccgggagagtcccaggcgcctttacccaggttcattttcagtttaggccaaaatccccgcgggttgggcggggagggggcggggctagctgggcggggctgactgcggggaccggctagggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcaggtaccaggggccatgggcgccttccctatctcctgtagatctcttgggatggcctcgcacaaggttgggaggaaagtggacccaatgctaggatatcgccctccctctagtcctgagtaggaagaatcttcctggctttcgagatccggtaccagagagtgactgtgagagtccgccctgctctctgggacaattaagggatgaaatttctgagggaatggagggaagacagtccctggaataccgatccgcggtcccctttgagccctccaacagccttgggccccgtgacttttctctcaagttttgttctctgcctcacactcaatgtgtttgaggctctgattccagtccctcggcctccacttaggtcagggccagaagtccctgctcccccctcagagactctaactttccaaggaataggagattttcccaggtgtctgtgtccaggctggtgtctgggttctgtgctcccttccccaccccaggtgtcctgtccattctcaggttggtcacatgggtgctgctggggtttcccatgaggagtgcaaagtgcctgaattttctgactcttctcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatggggtaaggagggagatgggtaaagaggggaacgaggggtcatgtcttttctcagggaaagcaggagcccttctggagctcttcagcagggtcagggctgaggcctggagatcagggcccctcaccttcccttcctttcccagagcagtctccccagcccaccatccccatcgtgggcatcgttgctggccttgttgtccttggagctgtggtcactggagctgtggtcgctgctgtgatgtggaggaagaagagctcaggtaggaaggggtgaggagtggagtctgagttttcttgtcccactgggggttgcaagccccaagtagaagtgtgccctgcctcattactgggaagcaccatccacactcatgggtctacccagcctgggccctgtgtgccagcacctactcatttgtaaagctcctgtgaaaatgaaggacagattcttcacttcgatgattatggtggtgatgggacctgatcccagcagtcacaaatcacaggggaaggtccctgctgatgacagacctcaggagggcagttggtccaggacccacatctgctttcttcatatttcttgatcctgccctggatctacagttacacttttctggaaacttctctgggatcaaagactaggggtttgctctaggaccttatggccctgcctcctttctggcctctcacaggacattttcttcccatagatagaaacagagggagctactctcaggctgcaggtaagatgaaggaggctgatccctgagattgttgggatattgtggtcaggagcctatgagggagctcacccaccccacagttcctctagccacatctgtgggctctgaccaggtcctgtttttgttctaccccaatcactgacagtgcccagggctctggggtgtctctcacagctaataaaggtgacactccagggcaggggccctgatgtgagtggggtgttgggggggaacagaggggactcagctgtgctattgggtttctttgacttggatgtcttgagcatgaaatgggctatttagagtgttacctctcactgtgactgatacgaatttgttcatgaatattttctctatagtgtgagacagcttccttgtgtgggactgagaagcaagatatcaatgtagcagaattgcacttgtgcctcacgaacatacataaattttaaaaataaagaataaaaatatatctttttatagataca

SEQ ID NO: 7764 - DNA, 131 bp, Homo sapiens
ttttttttttgagacagagtctcgctctgtcgcccaggctggagtgtagtggcgcgatcttggctcactgcaagctccgcctcccgggttcacaccattctcctgcctcagcctcccaagtagctgggact

SEQ ID NO: 7765 - DNA, 214 bp, Homo sapiens
ttctgtttgttagttttccttctaacagtcaggcccctcttctgcaggtctgctggagtttgctgggggtccactccagaccctgtttgcctgggtatcaccagcagaggctgcagaacagcaaagattgctgcctgctccttcctctggaagcttcgtcccagaggggcacccagcagatgccagccagagctctcctgtatgaggtgtctgt

SEQ ID NO: 7766 - DNA, 1096 bp, Homo sapiens
ggcagctttcttacaaacccatccttctgaaatgttgcttcaaattcatcctctgctccccagtcccactattccacacatactgttactgtttctttatcctactttctcaattttggaacatagttgcagttactgcattgaatacctgtgggtttgcctgttgttctgtctgtctctgtggttcttgtaatagtggatcccagagataaaatggacagttgtaatgcacagttaattcagaaactagaccttacttgctgtgtgaaataccaactaaattctcagtgaactcagctgagctttatctccttttgtttccccaatttataatttcagttcaggcccagaaagatggaatcccagctaagaaatacaagttacaccctgtactagcagcccatgtgtgcatgttctttaagtgctcttgcagctatgtcatttatattgattttccctgtattattataagcaaagcaaatttgaggaaaaaaacccataataccacacctcatttttttcaagtaatagggtcataagtctcattcttcatataatatgttgagtatgcaatatattatgtgttaggctctggaaaggcagaggttagatcatgttacagatcatatctgattaggcagataaacagtattttaaccttttccttattatatgtaacttgctttcaggttttttaatgttactattatgtctttaatatattatctttatttgtacttttgtatacagaagtgattttccttttttaaaaaaaattgtgtctttaggatggactccaaagatgtggaatcagtaggtttaaggaatatggatattttggctggcaaggtggctcacacctgtaatcccagcactttgggaggctgaggtgggtggatcacctgaagtcaggagttcgagaccagcctgaccaacttggcgaaaccctgtttctactaaagacacacaaaaaattagccagtggtggtggcatgtgcttgtagtcccacttagctactcgagaggctgaggcaggagaatcgcttgaacccgggaggcagaggttgcagtgaggcaagatggcacctctacactc

SEQ ID NO: 7767 - DNA, 268 bp, Homo sapiens
cggccgaattctgccctccgctaacgagctatagctttgtggaaatgggcgagtggcgtgcccttgtgagcctcagggccgcatctgtaaaatgggcataactgtcatgcctgtctttaagaacagccttgggggtaaatgagtggaactcatggaaagatctcagcccacaaccttccacagaacaggcgcttctcacacagtaagtagcaggagtgcagaggctgcaggcatgaatccagccagactgcctgggttcaagtcccag

SEQ ID NO: 7768 - DNA, 293 bp, Homo sapiens
catgaacgctaatgcactttacatcttccatcagtgctttcttatttatttctataaaggcggtattaatatctgaatttaagagtccaagagaatgtaccgcttttattaatggtctaagatcttttattttgttaagaaatggaagatgtgaaaagcaaagacatttattatcatgttgtcatttttattctctttccctgcctagaacatagccattaaaatatacatactatcatttatttttaaagttgttaatatattttatatactttttccaataaaatgtatga

SEQ ID NO: 7769 - DNA, 4802 bp, Homo sapiens
tttaatttcaaacgttaatatattttctattttatattggacatatgcatctgtaacccctcatttgcagcaactatcacatcctcataaaaggggcaaaatttgtaagatgcctcttaaaataaatattcttttttataaaataataaaacttcaaataaatattctttacactaaacaatatgttgaaaaaattagaaaataaaggttgaattttactgtaactgtacaatatacatgaagtccaaagggaaatcagagtcttacaataaaggctttctgtaaggcaaaatacaatctaaaaacatactgattgattcacattcttccgaatgtacaacatattagtataatattttgtgtctgtgccatgtagtatggcacaacttgtttttcacagttgcaaatattattgtatatacaaaaatatagcacattctctctggagaaaacaatggaaaaaagtcatctgctaatttacaagttttgcaagtactattcacaaacaaaaactttgcctaggagtgtctgtgttgctttagcttatgcaatacatgggtcaccaagttctgtatctcatactttgagctccattagctgagttctaacaagcatatcagttaaaacggcacatggacaaaaagcatttcaccgcaaacagcaaagactatcccaactttctattaacagtgccaagattataactgtttagttggttgcatatgtgtattaaaaaaagacagaaaaaatcctcattactgtaatattcctgattaatgatgctatgttggtttttcaaagttcctaggggggacagtgggaactttgcagcaaactgtgtttgagtttttacagcggcaaccaggcctgttaacccggtcataacacccctggcacaatttaaggcaacccttggctggaaggtaacaccataaacaaggcaaaaagagggacatgacacccatggctgaccatcgtgtacaacagtgagactggctgcaagaacatgggttgtcagcacagttgtcctcatcatcattagaacagtgatagaagagacctttcacacagcatacacaagtcccatagtcaatcacgttctgggccgagcaaaggcactgcttgtcgcagatccagtctgatggcagaggccttgggtaggtgcactccttacatttgcacttgccacagtcctcacacctgtaggcgtgcaggcccaaatcttccttgctcagtggcttaagctcacctggcttgagctcagatttgggttgcacccggattatgccatcagcaacaggcccggaggagaaggatgatcctagcagtctctgttcagaggagctgctgctggtacttgtcctcgtactgctccgcgaccctgagctgaccgtgcttatggatctggacagagaggctcgtgcagaagaatggacctgcgagtgctggagcctaggaggctggcggtgctcaggcagaccgtggagtctctcgtgtttgtgctgagtggaggggcgaggagcaggcttgagcccaggtcttgggacgacagtaggcccctctgtgtactcattggtgtttcggatggctctgatctgatccagagacaagacatgtacctgctgggtgagggcgtctctggggtcgggctccccacgctgtctgccaccgtcacggggcgtctgcagcaagggctgcgacccgttgccactctgagctctggcctccatcaggtcttggaagtgtggtcactccagcaggcttagaacacatctgaactcctgaggaagccaagaggaaagaacggttgatactctaagatacttcccactctccacccacctgaattgactcctcacttcccactttccctagagaaacaggatttgaaatggaatggcagtagggaggtattagccatatgatcaacaacgcatgtacccaaaagtaaaaattacggcgggctactgacaattctgtaatcctgtgacgtacaacaatacaaaactgatctttgagtcacttaagtaagaattccttattcaaagaaacatacaatttgtaaggttcaggttcaacgtaaaaatcgcaaggaagtattgctggaatataacactgctaccaatgttttcaaaagttgaaaatcctttcaaaatttgaaataggtttccatttgtcatagtcatttttgccttaagcgttaataatgcaacctagaagattctttcttggttcttaatttttacttttacatcaaacactttaactgtgacgtatacggcattctgtaactttttcaaaccaggtagaatgaatatggcatgcaaaaaagtaaatacccaaattctacaacaatcatgccattttttattaattgtatagtagcacaaagttatagaactaaaagcaaatcaaatcctattaggtgccagaaacacattaaagcaaacttaacaagaagaagacatgaatttattttcaacttctcaacaacttaagaattaactattttacagtctgatagcctagaacaccaccttagattctgcagctaaaaggttgttctccctgctaattgagaacacaaacgaagtgataataaccagaaaagcgttttaaaaattcaaatgtcacatttcgtatctagcattctgtcaaggaattccttaaactgcagtccttcttcaatttcaaaacgatcaccccctttcccaagcctatatgacaataaaaagtataaaacaggcaaaagtggacctttatccgatctccgctctttagaatagaggccacagcgaacaaggcaggtgacaaacgtctcccaattcggagcaaggcagtgctggaaaccggatctcctcacctccaaaagaatggcagaagacaacgctgctctttgctttcacttagtttatcgcctctctgtgccccaacaccgtccccagcaggtgggacacagccgatccccaggggagtttctccaggcggactgacgctgtccatgggccaggctgcccccctgcttacgatccccagactcagacaggcgggggccgcgggcgcctccgaagggtacgtgtcacgaaatgcaggagcacacttcccccgcctccctctccccagctaagatctcccccaactcaagagaactgccttccagccccaaggagccactccgcccccaggcagaggtcacgccgcccactgccaggctttctgcaaagcccctcggacatccggcacaggtttcccaccccgacactgcgagcacgaaagccctgcctgagacacgcagccaggacgcacaagtccaacccacgcacacacagcgactccacgctgcactgaccgaagggggcattgcctgtaatctgcacacgcctatctccttttgggtcgagagaaaaaaaaaagatatcatatttcttaaagtgaaagaaaaatggctttttaaaaaaagggcattttccagggtcccactgctcactccgggcgcgcaggacccagctcccggagctgtaaactttcggtgcagatttgcttgcagtcaaagtagcatctttgaaataaaagggggcttttttgtttttattttttaagtgatttctgccgatccgatccctggcctccttcttcaaagctggactccctacctccgcccctcttctctttcccagtcccccctcccctttgaaagtgctttgaaacccccattaagaacagtgtgtgatcagactgaggattaggggaaaagaacttcagctctagggtggggcaaacggacacagaaactgctttgtaaaaaacacacaagaatccaaattaaaacacagcaacaacaacaacaaaaggaaataaaaaattgcctattttgccacctactttcaggtaatggaaaatgatcgcgaccgcttgatgactttcttcctgcgctgggtcagcccgagcttccaaaaataaaataagtgtgacccaggctgaccacgaagaacggaagagagagagctgcacttccgaaccgcagagacccggcgccaggcagggcgacgctcccacccgctccgggctagactgtccacacggagcagaggcgggcactccctccacccggcaccctgcctttttctcaccctggaagtctcctgcccccgaggcgggcaacctgtgtcccccagccccaccagcgccccgcctagggacagcctctccctggactttgccttccaccaagaggaagaacaggttagaaatgcgggcgcctgcaaaggcaacctggaaaatacaaagtgtttttctctccctctcccgctctcagcgccgaattcgcggccagtgcacggctgggagcagacttcaggctagctgtcctccgtcccaaccccctagagcgcgggcgcgcggggtcgcctgtcggggacactgcacggggtgcatacagaagtccccgcagaggcaggccgagcccaagccccgggcgaggcaggtccgcggggagcgccccggatcctcgcgaagaccctgcgggatttgagaaagggaggctcggggagagacggacccaactcctggtccggctgcacctactccatgttgcccacaacgcgccggccgcggcgccaggaggggaagagccaaacgtgcctcaccgtgatcgcggctttgcaccaacccctctcccttggattctcttctttctgcgatgtgcaaataaatccagtctcgatgcaaacttttttcctttctttccaacctctgctttagaccaacttccgagcaatcggcgggagaaaaaaagagaattc

SEQ ID NO: 7770 - DNA, 160 bp, Homo sapiens
gcctgcctgcctctgtagactccacctctgggggcagggcatagccaaacaaaaggcagcagaaacctctgcagacttaaatgtccctgtctgacagctttgaagagagtagtggttctcccagcatgcagctggagatttgagaacggacagactgcct

SEQ ID NO: 7771 - DNA, 906 bp, Homo sapiens
ccccagagtgtgatgttcctcttcctgtgtccatgtgttctcattgttcaattcccacctatgagtgagaatatacagtgtttggttttttgttcttgcgatagtttactgagaatgatgatttccaacttcatccatgtccctacaaaggacatgaactcatcattttttatggctgcatagtattctatggtgtatatgtgccacattttcttaatccagtctattattgttggacatttaggttggttccaagtctttgcaatagtgaatagtgccgcaataaacatacgtgtgcatgtgtccttatagcagcatgatttatagtcctttgggtatatagcaaaggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgattgccattctaactggtgtgagttggtatctcattgtgcttttgatttgcatttctctgatagccagtgatggtgagcattttttcatgtgttttttggctgcataaatgtcttcttttgagaaatgtctgttcatgtcctttgcccactttttgatggggttgtttggttttttcttgtaaatttgtttgagttcattgtagattctgcatgttagccctttgtcagatgagtaggttgcgaaaattttctcccattttgtaggttgcctattcactctgatggtagtttcttttgctgtgcagaagctctttagtttaattagatcccatttgtcaattttggcttttgttgccattgcttttgatgttttagacgtgaagtccttgcccatgcc

SEQ ID NO: 7772 - DNA, 2705 bp, Homo sapiens
ttttcctccaaacagatttattgaatacagcaaaattctatatacaaagtgacctggacctgctgcttcaaaacatgatcctttcttactaatatcttgatagtcggtccatagagcattagaaagcaattgactcttaaataaacagaaaagtgcctaatgcacattaaatgaatggcctaactactggaactttagtagttctataaggtaattaacataggtaggatccagttcctatgacaggctgctgaagaacagatatgagcatcaagaggccattttgtgcactgccaccgtgatgccatcgtgtttctggatcataatgttcctgaaatgcaggaagaaaatattcagtaaaacgtaatcagtgggacttcactgcaagattaaagatgttgtttgctttaggatacaatatttaaaataatgtaattgtttctacgtataaaagcaatatttaaacataacaaaacatttgggaaatacataaacatatagcatgtgaacacgaaatgaatccttaatcctactacacacagacaaccactgttaatatttccctggttctttgtttcggttttttaggcactgtcttgctatgttgcccaagctggcctcaaactcctgggctcaagcaatcctgcttcagccacctcagtagctggaactacaaaaaaaaggctttactggtctttgttttctttgcatgtatatgatacagtcatgtgctgcataacaatgcttcagtcaacagtggaccctacatatgatggtggtcccgtaagattataatggaactgaaaaattcctattgcctagtgaccttttaaccgtcccagcatcacatagcacaacacactactcacatgtttgtggtaatgctggtgtaaacaaattgtgctgccagtcataaaaagtatagcacatacaattatgtacagtacgtaacgcttgataataataaatgactatgctatggtttatgtatttactatactttttttcttttttttgagacggagtcttgctctgttgcccaggctggagggcagtggcgtgatctcagctcactgcaacctctgcctcccgggttcaagcaattctcctgcctcagcctcctgagtagctaggattacaggtgcctgccaccatgcctaatttttgtatttttagtagagacagggtttcaccatgttggttaggctgtctcacactccttacctcaagtgatctgcccgccttggcctcccaaagtgctgggattacaagtgtgagccaccatgccgggcctactttttatcattattttagagtatactactcctacttattaagacaaggttaactataaaacagcctcagacaggtcctttaggaggtattccagaaggtatcatcattacaggagatgacaactccatgcatgttactgccctggatgaccttccagtgggagaagatgtggagatagaagccagtgatattgatgatcctgaccctgtgcaggcctaggctaatgtgtgtttcttctttgcttttaacaaaaaagtctaaaaagtaaaaaagtttaaaaaaagaatttttgtacagctgtacaactgttttaagtgttattataaagtcaaaaagttttattgactcactcagagcaacttccagtgttgtaagctccattatggtaagtgccctattcagatataccttttaaaaaatttccctataccatacttttactgtatcttctctacgtttagatacataaataccactgttataactgcctacattatttaggctacaaatctttgtagtctaagagcaatacagcctaggtgtgtaatagggtgtaccacctaggtttaagtacactctatgatgttcatacaacaaaactgcctgacacatttctcagaacatatccccattgttaagcaatgcatgactgtatgttttttctttttacaaggctgtgatagtagcagttgtatatatatactttttttcacatattattctgaggaccatcacttggaatatctttagtaattttattgctttagaagtaatttttggctgggtgcagtgactcattcctgtaatcccagcactttgggaggctgaggcgggcaaattactggagcccaggagttcgagaccagcctgggaaacatggtgaaacctcatctctacaaaaaaatacaaaaattagctgggtgtggtagtgtacacctgtagtctcagctacaactcgggaggctgagttgggtgaatcgcttgagcccggtggggttgaagtcacagtgacccatgatcacaccactgtactccagcctggtgccagagcaacaccctgcctcaaaaagaaaaaaaaaaaaagtaatttttattctctgattagttttcctttgtgctatttgttactttctttttgttggtaaactgatagcttctgccaattcttattcttcatttaaatagcattgtggcctgagagcacattagctttagggatcaacttgtctgttcctgtgattcaaaagattaagaacttttcccaaagtagtctgaataaggaatcactgatgaacacagggccggcccccgccaattttaccaggaatttttctgaacaaaaaggaaaggatctgctgaaatctactcacccattatctgattctagacacaccacaggaatatcagtg

SEQ ID NO: 7773 - DNA, 368 bp, Homo sapiens; identical to SEQ ID NO: 6222

SEQ ID NO: 7774 - DNA, 823 bp, Homo sapiens
tgttttcttactcaaaacactgtttaacatgacacttggctcctttctttgcatctctgagctcttgtaagatttgagaaacaattacattcaagggcagtatgcttaacctactgacatttgaactacaaagcaaagatgttcagattttcctgaaggatcaagtctttcaggccacagaattttctgtcctagttttttaatacagtagtccccccatatctgcaattttcctttccacattcaattacgcatggtcagctgtagtctaaaaatattaaatggaaaattccagaaataaacaattcataagttttaaattacacactattctgagtagcatccatgatgtgaattcttgctttgtgcggcatattcatgcttaaattctccccacccattagtcacttagtagccatctcagttgtcacggactgtcactgtatctcagtgcttgttttcaagtaacctttatcttactaatggccccaaagcacaagtgtaatgatgctagcaattcagatatgccagagaagctgtaaagtgctttcttaaagcgaaaaggtaaaagttattaatttaagcaagggaataaaaatcatatgctaaggttgctaagatcgagggtgagaatgactcttcctgctgtacaagatgatcatccccagagcacatagccgtcagactttccaaggtcaatacaaaagaaagaatcttaaagacagctagagaaagggtcatataactcatcatgctaacagcagacttctcagcagaaactttacaagtcagaagagattgggggactgtttttagcattctt

SEQ ID NO: 7775 - DNA, 140 bp, Homo sapiens
ttttcccctctttttttttttttttttttttttttttgagacggagtttcgctctgtcgcccaggctggagtgcagtggcgcgatctcgactcactgcaagctccgcctcccgggttcacgccattctcctgcctcagcc

SEQ ID NO: 7776 - DNA, 4706 bp, Homo sapiens
tattattatactttaagtttcagggtacatgtgcacaatgtgcaggtttgttacacatgtatacatgtgccatgttggtgtgctgcacccatcaactcgtcatttagcattagatatatctcctaatgctatccctccccactccccctaccccacaacagtccccggtgtgtgatgttccccttcctgtgtccatgtgttctcattgttcaattctcatctatgagtgagaacatgtgctgtttggttttttgtccttgcaatagtttgctgagaatgatggtttccagcttcatccatgtccctacaaaggacatgaactcatccttttttatggctgcatagtattccatggtgtatatgtgccacattttcttaatccagtctatcattgttggacatttcggttggttccaagtctctgctattgtgaatagtgccgcaataaacatacatgtgcatgtgtctttatagcagcatgatttacaatcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctcagcacctgttgtttcctgactttttaatgatctccattctaactgttgtgagatggtatctcattgtggttttgatttgcatttctctgatggccagtgatgatgagcactttttcatgtgttttttggctgcataaatgtcttcttctgagaagtatctgttcatatcctttgcccactttttgatggggttgtttgtttttttcttgtaaatttgtttgagttcattgtagattctggatattagccctttgtcagatgagtaggttgcaaaaactttctcccattctgtaggttgcctgttcactctgatggtggtttcttttgctgtgcagaagctcttcagtttaattagatcccatttgtcaattttgtcttttgttgccattgcttttggtgttttagacatgaagttcttacccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtgacattatttctgagggctctgttctgttccattggtctatatctctgttttggtaccagtaccatgctgttttggttaccatagccttgtagtatagtttgaagtcaggtagtgttatgcctccagctttgttcttttggcttaggattgacttggcaatgtgggctcttttttggttccatatgaactttaaagtagttttttccaattctgtgaagaaagtcattggtagcttgatgggaatggcactgaatctttaaatgaccttgggcagtatggccattttcacgatattgattcttcctacccatgagcatggaatgttcttccatttgtttgtatccccttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagatgatggggttttctagatatacaatcatgtcatctgcaaacagggacaatttgacttcttcttttcgtaattgaatgccctttatttccttctcctgcttgattgccctggccagaacttccacactatgttgaataggagtggtgagagagggcatccctgtcttgtgccagttttcaaagggaatgcttccagtttttgcccattcagtatgatattggctgtgggtttgtcatagctagctcttattattttgagatacatcacatcaatacctaatttattgagagtttttagcatgaagcattgttgaattttgtcaaaggctttttctgcatccattgagataatcatgtggtttttgtctttggttctgtttatatgctggattacgtttattgattttcgtatgttgaaccagccttgcatcccagggaggaagcccactagatcatggtggataaactttttgatgtgctgctgtatttggtttgccagtattttattgaggatttttgcatcaatgttcatcaaggatattggtctaaaattctcttttttggttgtgtctctgccaggctttggtatcaggatgattctggccacataaaatgagttagggaggattccctctttttctattgattggaatagtttcagaaggaatggtaccagctcctccttgtacctctggtagaattcggctgtgaatccatctgttcctggactttttttggttggtaagctattgattatttcctcaatttcagtgcctgttattggtatattcagagattcaacttcttcctggtttagtcttgggaggatgtatgtgtcaaggaatttatccatttcttctagattttgtagtttatttgcatagaggtgtttatagtattctctgatggtagtttgtatttctgtgggatcggtggtgatatcccctttatcattttttattgcgtctatttgattcttctctcttttcttctttattagtcttgctgtctatcaattttgttgatcttttcaaaaaaccagctcctgaattcattaattttttgaagggttttttgtgtctctatttccttcagttcttctctgatcttagttatttcttgccttctgctagcttttgaatgtgtttgctcttgcttctctagttcttttaattgtgatgttagggtgtcaattttagatctttcctgctttctcttttgggcatttagtgctataaatttccctctacacactgctttgaatgtgtcccagagattctggtatgttgtctttgttctcattggtttcaaagaacacctttatttctgccttcatttcgttatgtacccagcagtcattcaggagcaggttgttcagtttccatgtagttgagtggttttgagtgagtttcttaatcctgagttctagtttgattgcactgtggtctgagagacagtttgttataatttctgttctttgacatttgctgaggagtgctttacttccaactatgtggtcaattttggaataggtgtggtgtggtgctgaaaagaatgtatattctgttgatttggggtggagagttctgtagatgtctattagttccgcttggtttagagctgagttcaattcctgggtatccttgttaactttctgtcttgttgatctgtctaatgttgacagtggggtgttaaagtctctgattattattgtgtaggagtctaagtctctttgtagttcactaaggacttgctttatgaatctgggtgctcctgtattgggtgcatatatatttaggacagtttgcttttcttgttgaattgatccctttaccattatgtaatggccttctttgtctcttttgatctttgttggtttaaagtctgttttatcagagactaggattgcaatccctgcctttttctgttttccatttgcttggtagatcttcctccatccctttattttgagcctatgtgtgtgtctgcacgtgagatgggtttcctgaatacagcacactgatgggtcttgactctttatccaatttgccagtctgtgtcttttaattggagcatttagcctatttacattcaaagttagtattgttatatgtgaatttgatcctgtcattattatgtcagttggttattttgctcattagttgatgcagtttcttcctagcctcgatggtctttacaatttggcatgtttttgcagtggctggtactggttgttcctttccatgtttagtgcttcttccttcaggagctcttttaggacaggcctggtggtgacaaaatctctcagcatttgcttgtctgtaaagtattttatttctccttcacttatgaagcttagtttggctggatatgaaattctgggttgaaaattcttttctttaagaatgttgaatattgccccccactctcttctggcttgtagagtttctgccaagagatcagctgttagtctgaggtgcttccctttgtgggtaacccgacctttctctctggctgcccttaacattttttccttcatttcaactttggtgaatctggcaattatgtgtcttggagttgctcttctcgaggattatctctgtggtgttctctgtatttcctgaatttgaatgttggcctgccttgctagattggggaagttctcctggataatatcctgcagagtgttttccaacttggttccattctccccgtcactttcaggtacaccaaacagacgtaggtttggtcttttcacatagtcccatatttcttggaggctttgtttctttttattcttttttctct

SEQ ID NO: 7777 - DNA, 129 bp, Homo sapiens
ttttttttgagatggagtctcgctctgtcgcccaggctggagtgcagtggcgctatctcggctcactgcaagctccgcctcctgggttcacgccattctcctgcctcagcctcccgagtagctgggact

SEQ ID NO: 7778 - DNA, 661 bp, Homo sapiens
tactcagcaaagctattttaagattagccttgttattgcatttgtcaataattcattcctttttattgccaagtagtattcaattgtatagacatcacatttttaaaaatccattcactgttgatggacattttgggatattacaaataaagctgctgtggatattcatgaacaagtctttgtgtagacatacgcttttattttccttggataagtaggagtgatagttgaatcctgtgttaggtgtatgttgacctttttaagaacctgcctgttttccaaagtggttgtaccattttacattccccaccagtagtgtatgagagctgtcctcttcaaattgactggagaagctttgcttccatctcttcttcttggctaatagaaggtgcctcttggctgggcgtggtagctcacgcctgtaatcccaacactttgggaggcctaggcgggtggatcacctgaggtcaagagttcgaaaccagcctggccaacatgacaaaaccctgtctctactaaaaatacaaaaattagccgggcgcagtggtgggcgcctgtaatcccagctactagggaggctgaggcaggagaatcacttgaacctgggaggtggaggttgcagtgagccgagatcgcaccattgcattccagcctgggtgac

SEQ ID NO: 7779 - DNA, 1548 bp, Homo sapiens
agcagctcttgcagtgggtgggcgacttcgtgctgtacctgctggccagcctacccaaccaggtgcgccatgctctcccctaaggccccgccccccacctgggcccccatctcatcaggaccccgcttccctgcccctgcccctcaaaaccacctcagccccgcccctagttggagtcccgcccctacttggagtcccgcccctacttggagtcccgcccctgcttggagtcccacctcagccccgcccctggttggagtcccacccctacttggagtcccacttcctgagtctgtctcttcttaaacccccacttcctagccctgccccacttcctagccctgccccacttcctagccctgccccacctcggagccctgccccatctcggagccctgccccacctcggagccctcccccacctcggagccctcccccacctcggagccctgccccacctcggagccctgccccacctcggagccctgccccacctcggagccctcccccacctcggagccctcccccacctcggagccctgccccacctcggagccctcccccacctcggagccctcctctccatgaagcctctgctgtaagaagcctttccttggccacacccttcctgcccattctcaaagccccgcctcccaggccctgctccttctcagccccacccctacacgaaggccggttcgccttgctcctgctgctgctgcccccaccccttaccctccccagctccctgcgcctggggtgggcggccttgaaatcaagtctccatccacacctccaccttcagttttgcggcttgtgcgcccctgaccagggctccaacctcgcccccacccccccgccggtacactctgtcctgccccagctgtgatttcttctgccccacccacccggcttcatcctgccctggggcccgcccttctccaccgcgcccatcacggacggtttgaagtccctctcttctttttgtggggctttaggctgccaggggccacccctggggcctccccttccctggtcctctcagctcccagtacagtcaccaggggcccgggcccgcagctgtaggagggggcggctgctcctccacgtgcaggtggggatattggcctcagccagagcctcgtcttagtcttgtggactctcagggatgggacgactctgcaaatggggctgtcctgggccctgcagggctctgagcagcgtccccggcatccacccactcggtgccagaagcaccccagtcctgaccaccacaaatgtcccagaccctgcccattgccccccggtcggggttccaccgaccccaagacacttcatcccatcgccatctgccccccgccgccccagccacaccgatgcctctttcgggcagggttccctgctgaggccgggccacagctttctgcgggacggcacctcgctgggcatgcttcgggaattgatggtggtcatccgcatctggggccttctgaagcccagctgcctgcccgtgtatacggccacctaggatacccaggacagcatgtc

SEQ ID NO: 7780 - DNA, 4704 bp, Homo sapiens; identical to SEQ ID NO: 7404

SEQ ID NO: 7781 - DNA, 131 bp, Homo sapiens
ttttttttttgagatggagtctcgctctgttgcccaggctggagtgcagtggcgcgatctcggctcactgcaagctccgcctcccgggttcacgccattctcctgcctcagcctcccgagtagctgggact

SEQ ID NO: 7782 - DNA, 1090 bp, Homo sapiens
gaatgtaatttattttttttaattatactttaagttttagagtacatgtgcacaacgtgcaggtttgttacatatgtatacatgtgccatgttggtgtgctgcacccattaactcgtcatttagcattaggtatatctcctaatgctatctgtgccccctcccccaaccgcacaacaggccccggtgtgtgatgttccccttcctgtgtccatgtgttctcattgttcaattcccacctatgagtgagaacatgtggtgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttctaagtctttgctattgtgaatagtgccacaataaacatacgtgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcccatttctccatatcctctccagcacctgttgtttcctgactttttagtgattgccattctaactggtgtgagatggtatctcattgtggttttgatttgcatttctctgatggccagtgatgatgagcattttttcacgtgtcttttggctgcataaatgtcttcttttgagaagtgtctgttcatatcctttgcccactttttgatggggttgtttgtttttttcttgtaaatttgtttgagttcattttagattgtggatattagccttttgtcagatgagtagattgcaaaaattttctcccattctgtaggttgcctgttcactctgatggtagtttcttttgctgtgcagaagctctttagattaattagatcccatttgtcaattttggcttctgttgcccttgcttttggtgttttagacatgaagtccttgcccgtgcc

SEQ ID NO: 7783 - DNA, 125 bp, Homo sapiens
gctacttgggaggctgaggcagaagaatcgcttgaacccaggaggcagaggttgcagcgagctgagatcgcaccattgcactccagcctgggcaacaagagtgaaactccatctcaaaaaaaaaa

SEQ ID NO: 7784 - DNA, 522 bp, Homo sapiens
gtactcaataagcttgttaaaatatttgttgagtgaataaaataatctaaatcatttcctaagtttctttaatgatcaaagaaattaaaccactatgaatctggtttcaggtattaaacacagattaaatattcatttttaggatacatttgttttaaatttaacacatggattcatgaataatgctatagagaatccattatttaaaatattaatataaatatctatgcatgagggggaaataattgggaaattttatctcctctgacaaaggggaaaaaggccatttaaaaatattactttttccccttcagacagagagcagaggtgagccacacgaaatctaagttcgcatgaaagagcgatgataaaaaatgcaggtgctgtgaaacatttatatggaccaagtgtaagacagtatgtaggcctgaatttgaaatgacattttggtataaaacagatctcccaaaggcaaatttgaaacttccagaaaagtcttaaaatgacatctttcaaaatgaa

SEQ ID NO: 7785 - DNA, 184 bp, Homo sapiens
ttttttttttgaggtggagtctcgctctgtcgcccagactggagtgcagtggcgcaatctcggctcactgcaagctccgcctcctggattcacgccattctcctgcctcagcttcccgagtagctgggactacaggcgcccgcaccacgcccagctaatttttttgtatttttagtagagacgg

SEQ ID NO: 7786 - DNA, 126 bp, Homo sapiens; identical to SEQ ID NO: 6762

SEQ ID NO: 7787 - DNA, 319 bp, Homo sapiens
ttgtgctcttttttttttttttcttttttttttttgagacggagtctcgctctgtcgcccaggctggagtgcagtggcgcgatctcggctcactgcaagctccgcctcccgggttcacgccattctcccgcctcagcctcccgagtagctgggactacaggcgcccgccaccacgcccggctaattttttgtatttttagtagaggcggggtttcactgtgttagccaggatggtctcgatctcctgacctcatgatccgcccgcctctgcctcccaaagtgctgggattacaggcgtgagccaccgcgcccggccaaa

SEQ ID NO: 7788 - DNA, 316 bp, Homo sapiens
gaattctttttttttttttttttttttgagacggagtctcgctctgtcacccaggctggagtgcagtggcgcgatctcggctcactgcaagctccgcctgccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgtgcccggccaagaattc

SEQ ID NO: 7789 - DNA, 316 bp, Homo sapiens
caaatttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgaattgaacaaatt

SEQ ID NO: 7790 - DNA, 203 bp, Homo sapiens
ctcctgcctcagcctcccgagtagctgggactacaggcgcccgccaccacgcccggctaattttttgtatttttagtagagacggggtttcaccgtgttagccaggatggtctcgatctcctgacctcttgatccgcccgcctcagcctcccaaagtgctgggattacaggcgtgagccaccgtgcccggcacaaggtaaaat

SEQ ID NO: 7791 - DNA, 294 bp, Homo sapiens
acttcttttttttttttttttgagacggagtctcgctgtcacccaggctggagtgcaatggcgcaatctcggctcactgcaagctccgcttcccgggttcacgccattctcctgcctcagcctcccgagtagctgggactacaggcacccgccacctcgcccggctaattttttgtatttttagtagagatggggtttcaccgtgttagccaggatggtctcgatctcctgacctcgtgatccgcccgcctcagcctcccaaagtgctgggattacaggcgtgagccaccgcgc

SEQ ID NO: 7792 - DNA, 1057 bp, Homo sapiens
tttatttatttatttatttatttattttgagacggagtctcgctctgtcgcccaggccagagagcagtggcgcaatctcgactcactgcaagctccgcctccggggttcacgccattctcctgcctcagcttccagagtagctgggactacaggcgcccgccaccacacccggctaattttttgtatttttagtagagactgggtttcaccgtgttagccaggatggtcacgatctcctgatctcatgatccgcccgcctcagcctcccaaagtgctgggattacaggcttgagccaccgcgcccggcctgtcagatgcttttttgcatctgttgtgatgatcatatggtttttgcccttcactttgcttgtatggtttatcacatttatagatttgtttatgttgaaccacccttgtattcctgggataaatctcacttgatcatggtgaatgcttcttttaatgggctgttgaatttggtttgttagtattttgttgaggatttttgcatatttgttcatcagggatattgacctgtaattttcttgtagtgtccttgtctcgctttggtatcagggtaatgccgacgtcgtaaaatgagtttggaagtgtatctggaagtattcgtcgtctttgatttttgggaagagtttgagaagaattggtactagttttaccttaagtgtttggcagaattcttctggtctcttgatgttttcattgccttgctgagcatagatccaggtacttatgagcaaaattctactcagtctgacaactctgcttagaattatgaatgtgattaaatgcagtggtcactctacctttctaaggtagttcagctcaagttacagcgatccagtcctgatagagctttgaaacctcaagtctattatataacgtaatgaaaaattggcttggtgaggtggttcacacctataatcccagcactttgggaggctgaggtgggtggatcacttgagttcggagttcaagaccaggctgggcaacatggcaaaaccccacttctaccaaaaaaaaaaaaaaaaaaaaaaa

SEQ ID NO: 7793 - DNA, 3471 bp, Homo sapiens
ctttttttttttttttttttttttgagacggagtctccctctgtcgcccaggctggagtgcagtggcgcaatctcggttcactgcaagccccacctcctgggttcacgccattctcctgcctcagcctcctgagtagctgggactacaggcgcccgccaccacgcccagctaattttttgtatttttagtagagacggggtttcaccgtgttagccaggatggtctcgatctcctgacctcatgatccacccgcctcggcctcccaaagtgctgggattataggcgtgagccaccatgcccggccaagagctaagctattctaagctataacgtgtattatcaaaacaattaaggccaggcacagttgctcacacctgtaatcacaacactttgggaggctgaggcgggtggatcatttgaggtcaggagtttgagaccagcctggccaacatggtaaaaccctgtctctactaaaaatacaaaaaaattatccaggtgtggtggtgcatgcctgcagtcccggctactcgggaggctgaggcacaagaataagaattgcttgagtggggaggtggaggttgcagtgagccaagatcatgccactgcactacaggctaggagacagagtgagaccctgtcttaaaaaaaaagcaattaggccaagtgcagtggctcatgcctgtaatcccagcactttgggaggccaaggagggcagatcacgaggtcaagaaatcgagaccagcctggccaacatggtgaaaccctgtctctactaaaaatacgaaaattagctgggtgtggtggcgcgtgcctgtagtcccagctactcgggaggctgaggcaggagaatgccttgaacccgggaggtggaggttgcagtgagccgagatcacgccactgcactccagcctgacgacagagtgggaatccatctaaaaaaagaaagaaagaaattggctggagaatcgcttggacccaggggtggaggttgccatgagctgagattgtgccactgcactccagcctaggcaacaagagcaaaactccgtctcaaaaaaaaaaaaaaaaatcccagcactttgggaggccaaggagggcagatcacgaggtcaagaaatcgagaccagcctggccaacatggtgaaaccctgtctctactaaaaatacaaaaaattagctgggtgatggtgacgggtgcctgtagtcccagctacttgggaggctgaggcaggagaatggcatgaacctgggaggcggagcttgcagtgagccgagatcacaccactgcactccagcctgggcaacagagcaagactctgtctcaaaaaaaaaaaaaaaaagaaaagaaaagaaattaaacagtgtgatgtgacaaaaagtgatagggggttggagacagcttttctgttggatggttaggaatggcttcttagaaaagatgactgacacatgggaggctgatgtggcagatcacgaggtcaggagatcaagaccatcctggctaacacggtgaaaccccgtctctactaaaaaatagaaaaaattagccgggtgtggtggcgggcgcctgcagtcccagctactaaggaggctgaggcaggagaatggcgtgaacccgggaggcagagcttgcagtgagctgagatcacgccactgcactccagcctggacgacagagcgagactgccatctcaaaaaaaaaaaaagaaagaaaagatggctgacacagagggcagagctgagagccaagagggcagaaaagagccatagaaaaccatttccaggcctggaagcctaaaggaatttcccagctggatttgcagttgctttggattggtgactcctttttacctttcattgttaggggacctgcaggttcctttgcctgctgtgcagctacagctccattacaccaagacaatagggatgcagcagagagagttactggtgcagggcacctagtgcagagatgggaagaggccctcaaatctatctccccgagcaattctgggagagggtttctaaggggactgtggagggtaggggattgtggagggtaaggttttgggcaactgggtcattgattgattgggggaaggatgtagaagctgcgtttttgggggaattagctccttgtggggtccttcaggtcagctgagtcagtagttccatgaggacctgaaggaatctcttttcttttcttcttcttcttcttttttttttttttttttgagatggagtctctctctgtcgccaggctagaggtgcagggggtcgcaggctagaggtgcagtggcatgatcttggctcactgcaacctccacctcccgggttcaagcaattctcctgcctcagcctcccaagtagctgggactagaggtgcgtgccaccacacccagctaatttttgtatttttagtagagacagggtttcaccatgttggccagggtggtctcgatctcttgacttcgtgatcggcccccgccccaccctcggcctcccaaagtgctgggatcacaggagtgagccacggtgcccagccttaatttttgtattttcagtggagacggggtttcaccatgttgatcaggctggagtgcaatggtgcaatcttggctcactgcaacattcgcctcctggatttgaatgattctcctgcctcagcctcccaagtaactgggattacaggaatgcgtcaccacgcccggctaattttgtatttttttagtagagacggggtttcaccatgttggtcaggctgtcttgaacttctgacctcaagtgatccacctgctttggcctcccagagtctgaaggaatatctcaaagggaacacttaatgttgtgtaatgtccaggttgtgatccatagagcagttaaaggtaaaggtaactataattttttttttttttttttagacagagtctccctctctgtcacccaggctggagtgcagtttcacgatctcggcgcactgcaacctccgcctccctggttcaaccaattctcctgcctcagcctctcaagtgtgtgctgccatgccaggctaatttttttttttagacggagtcttgctctgtcacccaggctggagtgcagtggcacaatctcggctcactgcaacctccggctcctgggctcaaacaatgtgttttttcccctagtactttggtgtttgattatcttttttttttttttttttttttttttgagatagagtctcgctctgtcacccaggctggagtgcagtggtgcaatcttagctcactgcaagctctgcctcctggggttcatcccattctcctgcctcagcctcccaagtagctgggactacaggcacccaccaccacgcccggctaattttttgtatttttagtagagacggggtttcaccatgttagccaggatggtctcgatctcctgacctcatgatctgcccgcctcagcctcccaaagtgctgggattaca

SEQ ID NO: 7794 - DNA, 308 bp, Homo sapiens
gtttattcaacttttttttttttttgagacggagtctcactctttcgcccaagctggactgcagtggcgctatcccggctcactgcaagctccgcctcttgggttcatgccattctcctgcctcagcctcccgagtagctgggattacaggcgcccaccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctg

SEQ ID NO: 7795 - DNA, 322 bp, Homo sapiens
gaatttttttttttttttttttttttttttttttttttttgagacggagtctcgctctgtcgcccaggctggagtgcagtggcgcgatctcggctcactgaaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtcagccaccgcgcccggccg

SEQ ID NO: 7796 - DNA, 307 bp, Homo sapiens
gaaatttttcttttttattttctttttgagacggagtctcgctctgtcgcccaggctggagttcagtggcgcgatctcggctcactgcaagctccgcctcccaggttcacgccattctcctgcctcagcctcccgagtagctgggactacaggcgcccgccaccacgcctggctaattttttgtatttttagtagagatggggtttcaccgtgttagccaggatggtctcgatctcctgacctcatgatccgcccgcctcggcctcccaaagtgctgggattacaggcgtgagccaccgcgcccggc

SEQ ID NO: 7797 - DNA, 214 bp, Homo sapiens
acagacacctcatacaggagagctctggctggcatctgctgggtgcccctctgggacgaagcttccagaggaaggagcaggcagcaatctttgctgttctgcagcctctgctggtgatacccaggcaaacagggtctggagtggacccccagcaaactccagcagacctgcagaagaggggcctgactgttagaaggaaaactaacaaacagaa

SEQ ID NO: 7798 - DNA, 1698 bp, Homo sapiens
ggaagaaaacaatgctggtcccttcatctaaattctgagtattattgaacacttagtacccaactctcaagttgttttgaagattaaatcacataatgtgatgttcccagcacagtgctctgtaacacactcctgagcacatagtacctgcttaataagcattgcataagtatatgtgtacatgttgtttttcagtgcagacttactcagacattgttgccttctcctgtctctgtaaactttaaagagctagcaaagaatgtgttttttcaggatagagattgattgtttatttgatcagaagtatttgtgttgtgatgaatgatgagtgtgagagtctgttctatgcctgctttttctagctaaatgctactaatgatgggtctgtggaagctacatcagcattgacaggagatgtgtttaaaatgcactttcatggatgcttttaaaacctgcagaatcacattacatagtgtggggccagggttaccaaatgatttatatgcacattgaagtttgagaggcaatgcttagctaagtggttcttggcccaggcttctaattaagattccatggccaggttgcagaaatcttttcacttgtgcccttcccgcaggctctgtatattgttctgggtggaagcatccttgttgatataattaagtgcctcatgtgactccaggttgaggccagggtcaaacacgaggaattcaaaatacattcatgagagttgagttcaaactttattccaaagggaggtcacagggtctactatggttggatttggtaggtacaagttaatgtggtccatatccccattgctgtagcagaaattgtggcgtctgtggcaggaaaagagaaagataaattttgatctttgtggagcagctcactgtccttgaatctcacctgttataaagaacataaatgggtggacatgttctgcatgcctggatctttctacctgtgtttgtggtggtagcaggtgaagagattgtgctgattcctttaaaggcatattccaaagatgcaggtgtgacttgtccagagaatatcacctgagaagaaatgctagagaaggatgatgaagagaaaaatggctttttctcaggtgactgtgtctcagattaggagcagtgttcactctgcctcctggaatgccatatgtttagaacttacaaacctgtacttcttgactttatgctgtttctccctataagtttgtttaaacattttttcttctcatgatagtcaagcaactctgaaatatattattttctatatactagagtcttctcgacattctcttcatcttggcttcttctctgccatgcggaattctcatcattaattatgactcgtaatattaaaaatattccctttggctgggcgcggtggctcatgcctattatcccagcactttgagaggccgatgtgggtggatgacctgaggtcaggagttcaagaccagcctggccaacatggtgaaaccctgtcactactaaaaatacaaaaaatagctgggcatggtggcgggtgcctgtaatcccagctacttgggaggctgaggcaagagaatcacttgaacccaggaggtggaggttctggaggttgcagtgagcctacatcgtgccactgcactccagcctgggcaacagagggagactccatctccaaagaaaaaaaaaaaaagaaaaa

SEQ ID NO: 7799 - DNA, 1697 bp, Homo sapiens
ggaagaaaacaatgctggccccttcatctaaattctgagaattattgaactcttaggacccaactctcaagttgttatgaagattaaatcacataatgtgatgttcccagcacagtgctctgtaacacactcctgagcacatagtacctgcttaataagcattgcataagtatatgtgtacatgttgtttttcagtgcagacttactcagacgttgttgccttctcctgtctctgaagttaaagagctagcaaagaatgtggtttttcaggatagagattgattgtttacttgatcagaagtatttgtgttgtgatgattgatgagagtaagagtctgttccatgcctgctttctctagctaaatgctactaatgatgggtctggggaagctacatcagcattgacaggagatgtgtttaaaatgcactttcatagatgcttttaaaacctgcagaatcacattacatagtgtggggccagggttaccaaatgatttatatgcacattgaagtttgagaggcaatgtttagctaagtggttcttggcccaggcttctaattaagattccatggccaggttgcagaaatcttttcacttgtgcccttcccacaggctctgtatattgttctgggtggaagcatccttgttgatataattaagtgcctcatgtgactccaggttgaggccagggtcaaacatgaggatttcaaaatacattcatgagagttgagttcaaactttattccaaagggaggtcacagggcctgctatggttggatttggtagggacaagttagtgtggcccgtatccccattgctgtagcagaaattgtggcatctgtggcaggaaaagagaaagataaattttgatctttgtggaggagctcactgtccttgaatctcacctgttataaagaacataaatgggtggacattttctgcctgcctggatctttctacctgtgtttgtggtggtagcaggtgaagagattgtgctgatttctttaaaggcatattcccaagatgcaggtgtgacttgtccagagaatatcacctgagaagaaatcctagagaaggatgatgaagagaaaaatggctttttctcaggtgactgtgtctcagatcaggagcagtgttcactctgcctcctggaatgccatatgtttagaacttacaaacctgtacttcttgactttatgctatttctccctataagtttgtttaaacactttttcttctcatgatagtcaagaaactctgaaaaaatattattttctatacactagagccttcttgacattctcttcatcttggcttcttctctgccatgcagaattctcaccattaatttatgactcataatattaaaattattccctttggctgggcgcagtggctcatgcctattatcccagcactttgagaggccgatatgtgtggatggcctgaggtcaggagttcgagaccagcctggccaacatggtgaaaccctgtcactactaaaaatacaaaaaatagctgggcatggtggcgggtgcctgtaatcccagctacttgggaggctgaggcaagagaatcacttgaacccaggaggtggaggttctggaggctgcagtgagcctacattgtgccactgcactccagcctgggcaacagagagagactccatctccaaagaaaaaaaaaaaaaagaaaa

SEQ ID NO: 7800 - DNA, 1718 bp, Homo sapiens
gaagaaaacaatgctggccccttcatctaaattctgagaattattgaacacttagtacccaactctcaagttgttacgaagattaaatcacataatgtgatgttcccagcagagtgctctgtaacagactcctgagcacatagtacctgtttaataagcattgcataagtatatgtgtgcatgttgtttttcaatgcagacacgcagacattgctgccttctcctgtctctgtaaactttaaagagctagcaaagaatgtggtctttcaggatagagattgattgtttatttgatgagaagtatttgtgttgtgataagtgatgagtgtaagagtctgttccatgcctgctttttctagctaaatgctactaatgatgggtctggggaagcttcatcggcattgacaggagatgtgtttaaaatgcactttcatggaccctcttaaaacctgcagaatcacattacatagtgtggggccagggttaccaaatgatttatatgcacattgaagcttgagaggcaatacttagctaagtggttcttggcccaggcttctaattaagattccatggccaggttgcagaaatattttcacttgtgcccttaccgcaggctctgtatattgttctgggtggaagcatccttgttgatataattaagtgcctcacgtgactccaggttgaggccagggccaaatatgaggaattcaaaatacattcatgagagttgagttcaaactttattccaaagggaggtcacagggcctgctatggttggatttggtagggacaagttagtgtggcccatattcccattgctgtagcagaaattgcagtgtctgtggcaggggagggcacctgagggcaggaaaagagaaagataaattttgatcttcgtggaggagttcactgtccttgaatctcacctgttataaacaacataaatgggtggacattttctgcatgcctggatctttctgcctgtgtttgtggtggtagcaggtgaagggattgtgctgattcctttaaaggcatattcccaagatgcaggtgtgacttgtccagagaatatcacctgagaagaaatcctagaggaggatgatgaagagaaaaatggctctttctcaggtgactgtgtctcagatcaggcgctgtgttcactttgcctcctggaatgccgtatgtttagaacttacaaacctgtacttcttgactttatgctgtttctccctatatgtttatttaaacattttttcttctcatgatagtcaaggaactctgaaaaaatattttttttctatatactagagccttctcgacattctcttcatcttggcttcttctccgccatgaagaattctcatcattaatttacgactcgtaatattaaaaatattcccttttgctgggcacggtggttcatgcctattatcccagcactttgggagaccgatgtgggtggatgacctgaggtcaggagttcgagaccagcctggccaacatggtgaaaccctgtcactactaaaaatacaaaaaacagctgggtgtagtggcaggtgcctgtaatcccagctactcgggaggctggggcaagagaatcacttgaacccaggaggtggaggttgcagaggttgcagtgagccgacatcgtgccactgcactccagcctgggcaacagagagagactccatctccaaaggaaaaaaaaaaaaaaagaa

SEQ ID NO: 7801 - DNA, 1698 bp, Homo sapiens
ggaagaaaacaatgctggtcccttcatctaaattctgagtattattgaacacttagtacccaactctcaagttgttttgaagattaaatcacataatgtgatgttcccagcacagtgctctgtaacacactcctgagcacatagtacctgcttaataagcattgcataagtatatgtgtacatgttgtttttcagtgcagacttactcagacattgttgccttctcctgtctctgtaaactttaaagagctagcaaagaatgtgttttttcaggatagagattgattgtttatttgatcagaagtatttgtgttgtgatgaatgatgagtgtgagagtctgttctatgcctgctttttctagctaaatgctactaatgatgggtctgtggaagctacatcagcattgacaggagatgtgtttaaaatgcactttcatggatgcttttaaaacctgcagaatcacattacatagtgtggggccagggttaccaaatgatttatatgcacattgaagtttgagaggcaatgcttagctaagtggttcttggcccaggcttctaattaagattccatggccaggttgcagaaatcttttcacttgtgcccttcccgcaggctctgtatattgttctgggtggaagcatccttgttgatataattaagtgcctcatgtgactccaggttgaggccagggtcaaacacgaggaattcaaaatacattcatgagagttgagttcaaactttattccaaagggaggtcacagggtctactatggttggatttggtaggtacaagttaatgtggcccatatccccattgctgtagcagaaattgtggcgtctgtggcaggaaaagagaaagataaattttgatctttgtggagcagctcactgtccttgaatctcacctgttataaagaacataaatgggtggacatgttctgcatgcctggatctttctacctgtgtttgtggtggtagcaggtgaagagattgtgctgattcctttaaaggcatattccaaagatgcaggtgtgacttgtccagagaatatcacctgagaagaaatgctagagaaggatgatgaagagaaaaatggctttttctcaggtgactgtgtctcagattaggagcagtgttcactctgcctcctggaatgccatatgtttagaacttacaaacctgtacttcttgactttatgctgtttctccctataagtttgtttaaacattttttcttctcatgatagtcaagcaactctgaaatatattattttctatatactagagtcttctcgacattctcttcatcttggcttcttctctgccatgcggaattctcatcattaattatgactcgtaatattaaaaatattccctttggctgggcgcggtggctcatgcctattatcccagcactttgagaggccgatgtgggtggatgacctgaggtcaggagttcaagaccagcctggccaacatggtgaaaccctgtcactactaaaaatacaaaaaatagctgggcatggtggcgggtgcctgtaatcccagctacttgggaggctgaggcaagagaatcacttgaacccaggaggtggaggttctggaggttgcagtgagcctacatcgtgccactgcactccagcctgggcaacagagggagactccatctccaaagaaaaaaaaaaaaagaaaaa

SEQ ID NO: 7802 - DNA, 499 bp, Homo sapiens
ttttctgagactcattcaggtctggtcccaccctggagtctctcctcacagaactcattagaggagaccagagatttgggaggtggctcctgctgcctctccagagcttatgctcacaatattctgaaacccaaaagcagataaattagagcaataaactatatattttgaggtcttaacttctttctttctaattaaaaccagtgcttgtagagacattccatcccagtagttactccacaagtcacaagaaagtaaatagaaacacactaaaaaatccctctaaactacacttaaccctttcctttctgtatccctcccatctgtctatatttatctcttatgccatacatttttttaaaaaaatcagtgagaggccgggctctgtggctcatgcctgtaatactagcaatttgggaggtcgaggtgcgtggatcacttgagatcgggagttcaagaccagcctgaccaatatggagaaaccccatctctactaaaa

SEQ ID NO: 7803 - DNA, 399 bp, Homo sapiens
gtctttgcatatgtctttctttaaaaagtgaagtctctcatctttgtttactggtcataaaaacccaggctctgtcacttaatgaatgtttgacaaaatatttatcttgggccagaaagattggtgtcacttgtgagcttgttagaaattcagaaactcaggttttacctcaggtttcttgaaacaaaatctgcataaaaagatctccagtttattgttgtacacattaaaatttgagaggtactttataactaagcctgactttttaatctgagaaatatgcagaacttatactgtatgattaaatggagcactcaaaaatgtacatgtctatgttcctgttgttaattttgtactttatcattcaaaaaatatcatcaatacactacactggtattg

SEQ ID NO: 7804 - DNA, 399 bp, Homo sapiens
gtctttgcatatgtctttcttttaaaagtgaagtctctcatctttgtttactggtcataaaaacccaggctctgtcacttaatgaatgtttggcaaaatgtttatcttgggccagaaagattggtgccacttgtgagcttgttagaaattcagaaactcaggttttacctcaggtttcttgaaacaaaatctgcataaaatgatctccagtttatggttgtacacattaaaatttgagaggtactttataactaagcctgactttttaatctgagaaatatgtagaacttatactgtatgattaaatggagcactcaaaaatgtacatgtctatgttcctgttgttaattttgtactttatcattcaaaaaatatcatcaatacactacactggtattg

SEQ ID NO: 7805 - DNA, 498 bp, Homo sapiens
cttttctgaggctcattcacgtctggccccaccctggagtttctcctcacagaactcattggaggagaccagagatttgggaggtggctcctgctgcctctccagagcttatgctcacaatattctgaaacccaaaagcagataaattagagcaataaactatatattttgaggtcttaacttctttctttttaattaaaaccagtgcttgtagagacattccatcccagtagttactccacagtcacaaaaaagtaaatagaaacacaataaaaaatccctttaaactacccttaaccctttcctttctgtatccctcccaactctttatatttatctcttatgctatacattttaaaaaaaaatcagtgagaggccgggctctgtggctcatgcttgtaatactagcactttgggaggccaaggtgcgcggatcactttagcttgggagttcgagaccagcctgaccaacatggagaaaccctgtctctactaaaa

SEQ ID NO: 7806 - DNA, 1774 bp, Homo sapiens
atcttattttattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccctaccccgcaacagtccccagagtgtgatgttccccttcttgtgtccatgtgttctcattgttcaattcccacctatgagtgagaacatatggtgtttggttttttgtccttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtgtttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagttccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgtttatgtccttcgcccactttttgatggtgttgtttgtttttttcttgtaaatttgtttgagttcattgtaaattctggatattagccctttgtcagatgagtaggttgcgaaaattttctcccattttgtaggttgcctgttcactctgatggtattttcttttgatgtgcagaagctcttgagtttaattagatcccatttgtcaattttggcttttgttgccattgcttttggtgttttagacaggaagtccttgcccatgcctatgtcctgaatgataatgcctaggttttcttctagggtttttatggttttatgtctaacatttaagtctttaatccatcttgaattaatttttgtagaagatgtaagggagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttccgttccattgatctatatctctgttttggtaccaataccatgctgttttggttactgtagccttgtagtgtaatttgaagtcaggtagcgtgatgcctccagctttgttcttttggcttatgattgacttggtgatgcaggctgttttttggttccatatgaactttaaagtagtttttttccaattctgtgaagaaagtctttggtagcttgatggagatggcattgaatctataaattaccttgggcagtatgaccattttcacgatactgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaa

SEQ ID NO: 7807 - DNA, 100 bp, Homo sapiens
aggctgaggcaggagaatcgcttgaacccgggaggtggaggttgtggtgagctgagatcgtgccattgcacttccagcctgggcaacaagagcgaaactc

SEQ ID NO: 7808 - DNA, 399 bp, Homo sapiens; identical to SEQ ID NO: 7803

SEQ ID NO: 7809 - DNA, 499 bp, Homo sapiens; identical to SEQ ID NO: 7802

SEQ ID NO: 7810 - DNA, 1134 bp, Homo sapiens
aaggcaataggtcggggaaggtgatgaatgttctgtggggcatgtcaaattgggtggaacctctggggccttctgtgggagatgcccagggagcacagatttaggagatgggagcaactagtgtgatggtggtgagggctggttgaaaccctggggagtatgtggagctcatctgtgtttccacagagcttatctcccaggagatagccatcgggagtgccttgcctggcatgttcccctgctgaggtctgttacccaggagcctgcagacacaaagagcaggctggtaatgctgagaagcgaacattcagtacctgtcaccagaacccagcatgggtgttcaacactatctggtgactctgtgagaagaccctatgctcaggggatgaagtgtgttgcttgtgcaagagggatggagagagagtgttttccaagtatatgtgtgtgtgcatgtgtgtgtacccaggtggaaccctcctgcatgctcacatatgcctttatgaatactggaatctctaaacctaccatcatgcatctcgtcttagcttcctacctctctctttctacccctgcaacagccatgttattgccagtaacacatgagaagagtgagggagacctgtctgtagacaagctcagtgtgctgctaaggaggcaggcagcagttctgtcctcatgcgttcccattgtgccctgtcctgggatggcaaatgcaaggccagacaggctctgggctctctggtctgaccactaatagcatcttctcctcccgctaggctgaccagcctccaaggcaggactctgacaccagggttataaatgcatctgtctgggcacattatctaaattgttatgtatcaccctgggtaatggcaaaagtaaaaaccgctgttagctcagtgaataaatccttggtgctgatcaatcattgcacgacatagactcttttaataggcacaatttacacagaggcttggcagactgcttcgtcttctaattgccgatggaaaatggatgccgatctctgctgtgccgtaaaaatgtaaactataaatgacttaaaaacttgtgtgctcccttctccacccagcactcattttaaccttttatttagaaacaaaacaaagaaaaaaa

SEQ ID NO: 7811 - DNA, 2008 bp, Homo sapiens
tcaatgcgcccgccgtgtccatggagagaggctgaggcggccgacctccggcccgaggcaccggggcatcgggacggcgaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgaagaagaagttattcaagatggagtcagagtgctcatcgaaaagaaagcacagctaacactttgaggaacagaaatgtgctatgttgaagacaaattatccagtgagtttgtgttcagtaacccaaacatcaaagggacttgtggctgtggagaaagctttaatatttgaaatctcaggactcttctggccgtaggttccaggaaagctggtggaagctttggggttcaatgcagaaatcatgtgactgtcacgtgctggaaaataaagtgatacatcttgaaaatgaagccagtgtaacggattctagaagaaatgatatttatattctctataggggacagaaaatgagaagccatcactctctttggatcatttaggtctcttgcatcctttattttagaaccagtttcattaaagttgccttcctgggcacttgtttatccatttcctcaactgtgtgcactccttagatcgctattgaatggcttgaacatccctcagcatttctcccaaccagatcggcgacgcctaaaatccaagacaggacatcctgactgctggtagtaatgtggcggtgcattgtttttccacccaaacttaacatagcctttttatacatttttatgaaaaatttcattttcagctgcctcactgcataccctttaataataccaggcaaagattttcttcaactatagtacagattagttctgagtgatggtatcaaaaggtgagaaagacgtcatccaccttttttttaatccatttcttttgccaccctatatgtctgttcagagatgggatctcaagctgactttgattcttttagttgaggagtctcttaaagccatctagcccacctccctcaattccctatgtgaggaagcaaaaccccagggaagccaaagggctcctctctaccctgactccacaggccgggggagagtagggactctacccccctctccccttccttgtaggtgacacatgttctgccctctgaggcagtcagtgaaggcaaatggtctgacttctttatgtggtcaacattttgatagaatttctttataatttgatagagattatattatttttattttattttgagtgggaagaattttaaaaccttttatatgtgaattaccatcttgtttctttcacctttgaaacaatggtttgtagcagagacgacattgtagcaacccagatatgcttttggaatgtggtcctcactgtacaggagaatgtggggatcttttgttaaaattcccagtgtgcatacactttctggttccttggtccagttgctaaagttcttagtattttagcctaacatatttatcaccaacttttccttaaaagtgttccttttgtcacttagttactgattttcctgggtttgacataataagtattctatgagatgatatatatgctttttctgaaagctaattctcatgaattcaagtagctgagttcctttatgtttcgtttattcactaaagtagctggcacaaaacacaccaaaacctagagtggtagttttatgtaaatgctcatgagtttgtatcaataatataattgttgatccacttataattcgtgcagtactgtatgtatgtagagattgagttgtcaattaaaaaaaatgtggcctctttgtgatcacacacaaaaaaaagcccctatctccaaatacagtca

SEQ ID NO: 7812 - DNA, 295 bp, Homo sapiens
ccgggcgcggtggctcacgcctgtaatcccagcactttgggaggcggaggcgggcggatcacgaggtcaagagattgagaccatcctggccaacatggtgaaaccccgtctctactaaaaatacaaaaattagccaggtgtggtggcaggcacctgtagtcccagctacctgggaggcagaggcaggagaattgcttgaacccgggaggcggaggttgcagtgagccaagatcgcgccactgcactccagcctgggcaacaagagtgaaactccatctcaaagaaaaaaaaaaaa

SEQ ID NO: 7813 - DNA, 1579 bp, Homo sapiens
atataaattcctttttcttattttcaaatttgacattatcatccttgcctcttaaaaagatagattttaattgttttcatacttcatagaaatcaaagtctgtgtttgctacaaattgaatgctcacgttacctgaaatattactttggactgcaggacaggacagtatttattcctaagtagattgactataatctcatgataagtatgtatatgtgcatgggaaaaacacattcaataatagtctttgtgtttaaaactatcatggtatacattttcttatgtggtgcttgaggagtttcattctacagattacaaggtgtaggtttgcaccccaaattctcagggtatgctatttcacccaaatacttgaaagaaaaaggtgccctgtattttatcagtactgttgagggggaaattttttgtgtaagtttgtttgataaaactgcttataaaaatcaaattcacaaaatatgttaggctttcacataatttctaaggagatatatgtagaaataagatatatattatcaagagactgcttatatattcttaactagcttctgggtcctaagtagacctcacaggtgcataaaatcattaataaagcatgtagcacttgctaattggtgccttaagcttgaatctaatcagaattgcagactcgggtcctctgggaaaaaaacatgtccgtctgtggcacgtgtgagtactaggcccaggggaagagtctgaaaattgaattcttttgtgtgtcctgtgtctcagaagagaactgaatgttcagagcagcgtttgtaagctattaacattcagtatttcgtgttgcaactagaacacattattagatttattcctgtttaattcataatggtgcagaataaaacacacacatctgatttgatttctttttctttttttaagtttcataattgctttttatggctagtgttaatggcaaaaagtcctttccagggctccctgaataatctaccatacctgtatccatagcaggtgatgcttttttttatccccactttgaagacgtgtgtttctgtatttacacataaatcatactattgtatattaaagacagcagtggttgaaaagaatgtgaacactgtagaagttatgttggaaaaaaggagagtaaattgtgtgattaatggggaaggatattggataatgttataccccggactatgaaaaaagctggtggtaaatgggaagaatgtgaaattttaaactgctctcaacgtaggaatcttggtggaaaagttcctacctgaggtctgatatgattcaattatagaatgcaatgagcttggccaaggggactttgaatccagccaaggaaactttgaatctcgacagctctgagaatcacattttcagtgcattgaatatggagtaaactatttagacaaggattctgtgagactaggctacttacctttaattgccagcatttgtaaatgattgtgcaatcttgtgtaatggtcttttattttgactgttttggaaaaaaaatgttttattgtttttttttcccagtaaaaattacttcaaagaaaacgta

SEQ ID NO: 7814 - DNA, 17777 bp, Homo sapiens
atgagagtgtgatattttaaagtcagacgcagcaaaaactgtttcagggtgaagaaagacccctttcagccctgttttgcagccctgggtgggggcatgagatagacagcaagcttctgatcttgaagcttgtctagaagacacatcttctaggtctcgtggtcatttggtaggctgacctttgagtgagcgaggccactattgagtggatagcaagaacattggaaccaaagcctcggcacaggcctggcactggctgtacatcagctcttacaactaaacaactcaactaagcaactgaaacgaaacaaaggagcattcgttctctgttgttaggaatcattctgctctgttagggaagggctgcaggaagggcagtttcctgaataaaaatctggctgcgaccagtcccatgtgtctggtaagtaagtaagtaagtaagtgccctttgaagggatcattaagacacagggagcatgaacctgagatcagaagcatttctttactaatttagattctgcgaaatagacggacctctccacccccaaacctaaaacaggccaggacttgtctctgtgctgaaagcaaatagcaagactaactcaagccccagcctctttccacactccctgatacctaaggactgctttctcagctagaccagggtgggcatcagcgacgccttctcagctagaccagggtaggcatcagcgtcctctctccatctctatacccctctctctcacatcaggaagatgaaatgtgtagctctagcggcaacctctagccaggagcccagtggcctctcagattgctttttggccaggtctcagcactgctggcatctttacatcttactccttaaaaccgcctctcgctgaggagccactgcattttgaagaatttctcagtgtctgtcaggaaagtgctcctgctcatttggaacgccacacaccacccgcactcacctgtccaggcgaatgagcaggtcctgtagctttacaaatatgccgctgatgccgcttctccccagggtctctcagttttccaggacaaaaagatttagggcctataccctatgggcaaaacacctaaaatgtcaacagtcaaaatgccattctttttggccatcataagagggagtaggtatcactgctgcatgccagttgtttttgactagaatatgccaaccagagcttgttggggcaggagacgtttttccttacaagcagactgcctgtgccctgtgccctgtttgctacttcactgccatggaatgatccgagtactgtatttcagagctgccccttccccagcagcaaacactcgctgagtccatgtctggcttcaggtgggaggaaatgtttcagatgaaacttactcaattcataccaccctgaaatggaggacagaggtgacaaacttcagtttaataggtttctcaccaagttgtatgttccattggcccaggattcttgcactaatgggtttctatcacatcatgtctataaatgggtgcactttactgtttgaatttgtaactgaagtactggatatttaagtgtgagtaatgtcttcattagaaaatagcagaaccgctcttgtcttttagtgtatttttcaagaaaaaaggaaaggaaagacatcaagcagtggatcacaacatttatagcacaagaaataacttgtatataagcatcaaaaagattaagaattttttaatatgaaaaatatttgcagtgattttaaagtgcttttccagcaatgttcttagggactcctgagacacggttactttatctactggatcagtaaggcacacaattaacaattaacaattaatgtttatttacaaagtaaagggaaaacctgtgtaacatgagaatttggcatgacaaaatggagaccattttgtatctgctgttgtatcttgtccgggttgcagacgtgcactattaaagtcccaagttaatagagcacaaacccttctcgctcctcccccatgtgcccctctttttagatgtgtataacttaaactcgatggctcaggaaaattccactaattagaatcatgtacagtaccccaggtcgttgtccagatatacaagtttgctaatgtagttaagcctggattattaaacacttttcctaaattattgtaaacagaacagcttagagaaaggtattctcagtccttaatattgtatagtagtttatgagcccctctctaaatattggtatttttatattccagagatgtacccaatagaaaaaattaaaaattaatcagtatctaatttaatatccataagtatttttccttagattttagtcacgtacagtgggctatgtggatgtcacttgtgcttcaccatagtttaccactaggtgtcactgtggctctgcactgcgcttgttttgtagcaaagaacagcggcatcccctcgggagagaggagctgcttccagggcaacaggcaagcgggctcagaggttcaggagaaggcaacagaggcctggaaggggtcttcgtgcatctgtgccagttgtgcaagacgaactctttgaacactacatgctttggacttcagccaggcagaggctggaagaaggttgaccagagctcccttgctctggtagagggatgggtacatggagaagccccttcttccccatgagcctccctcctgtcagttcctctcagcctccagcttttataactccagaagcgtcacagttgggtggtttgattcagagagagttatttttctactgcagaaatgccttggacaaaaccagtgctcactgaatctttgccacaaaatggaataggctatcccagggggcaagaggtgcccgcccctgtgcccagcctcctcttgatgctcccagtgcccagcagcctcgcacaccctgcctgtctgttcctgggctgcccatttctcaagaaaccgacctgcaaaggcagccggctgctgcctccacaccgagggctgtgcggtcctgctgctcgctcactgggaggtgcagctctttctcctcttcctctaggaattccagaccgaccatctaccatgactaacaacaatgaacaaagggcttaggggcaagagctacctgcaaagacgtgtcatggaacccttcaccatgcaatgccttgaactcagctctggctgctcccaagaaaaggtggctggctgggggcctggacacaagcacaatggggctggtggagccactgtgcagagctacttgaataatcactgggttttcatcaactccttttgtcatacagaccactcaagggctgaagtgttggtaaccttcatttcggtgtccaaagcctcacagcaggtgagccaccctgagatgcttgtggccacatggtggccacagtcagagctttgaaagtcagtaccaaatgaacgcataattggacaccaaaaatcaagtgttactttcatgtttcctcaccccatcatctcattgcctcctgctgactctgataccgacgctgagctgacttgccaggctgccgctggacgcgtagagatcaggccagcgccgcgctcatttttccaggtagacctactctgtggaacggaagtgccctagctgctttgtttttgtagcacttgctggctgaatttttcttttgctaatcgctaaccagaaagtctggttagagggggctcaactcaatccctttggtccccagcgccagacaagagttaattctggaaaattcagtacttgaatgtacctgccttattgcataccaatttactggggggaaaaaaaaagttaagagatgccggctccagatctccacttcattcacaggtgattttggaaatcctgtaagttacacttcctgttctggttttgttttgttttttgtttcctttggctgattcctgctgagtgaggccagttcctcatcaggctcagggcaggtgccttttcaggcgtggcctcctttccatctagcacagcatctttgtctctgttctgtctcctccaaatccaagatgattttaattagtacagacatgtacagtctacaattaaagagtgatttgtactaatatgattttgattcttcctcctctttgctgtcctttcaagacacttgctggaaaaagctttaatgcacttagttttcctttaggttttctatgactcagatgtaaaggactttctctgtacagtatattatccaatgcatgtttgttctctctcctgatatattgaacaccacacagttgtgaagccgtgcagtggggatgccccacaccccacagaggcatctacccctgtgtataaggaaagacattttcctttgctgtacttgcttgagcagttttattgtctgtacatgtgagctgtgtgagatagatgtgaaaagttcaaatgaatgcattttcctgccccatgtatacagattgtcatctgtacaaggaactgtatgtatgaaagcaaatgtacttatttataaatggctaacacttggaaaaccatggtgttgtgatgcttttctccttccattacagcctcttcagggagctggcttttaagcttaccctcctgaggatgcagtgatgggggcaccctccctcaggaggaattgggcaggttagggctaaggccaaattcccgatgatttgcttggtctcttgtgggacattcagagccacccctttgtgcatttatttgctcggtcacgttattgagcacctcctctcctcagagttggacactgtggtaggccctcaagagagctgtggacaagagacgccgttctaaggagctgtcagcacaggcctgtgacatttgttgagaaaggggggctttttcttcattggaagaggtttctctctagctatacccagggagcactgagctcttgtttcattttgtagctgaagctgcacccaatccagccaccctaccaaagccaaggctgaggtgggctgccagcttgagtggctgtgtttagaggctgcatgctgagagggtagcgagcagagggcacagctcccactgcagacctaagggcttcgtcacaactggaggcccactgcttccaggggctttgtcttttcatcagaaatctggtcgaactccagtcctcaccatatagagagctaggcagctgcattgtgaatggaaaagtggcaggtttcctgcaactggctggagactcaataccatctaaaagggagtggggaagcgggggagcagcactgagcctgcagcctttcctgtttaactgctacctctgtgtttacttcagggacaagcgaggagggagaccacttcctcttgacatcagatttgtgctaaacaaacattcctgctgtgcatacctgcatttcccaaagcctagggaagcagacaaactgcaggcaacacacagcccagcctagatgccacagttgccttcaaagagaagaggggactctggcagcagccacctgctcaatctcaaaaccattcctgggctgctccagttatttcattaaaaaatgggtaagtcggggccgggcacggtggctcacgcctgtaatcccagcactttgggaggctgaggcgggcggatcacgaggtcaggagatcgagaccatcctggctaacacggtgaaaccccgtctgtactaaacaaaatacaaaaaattagccaggcgtggtggcagtcacctgtagtcccagctactcgggaggctgaggcaagagaatggcatgaacccaggaggcagagcttgcagtgagccgagatcgtgccactgtactccagcctgggtgacacagcgagggtccatctcaaaaaaaaaaaaaaagtcattggcaaaaccccagctttttaatttatattttttctttcttttttttttttttttttttttttttttgagacagagtctgtcacccaggctagagtgcaatggcgtgagcccggctcactgcaacctcctcctcccaggttcaaacaattttcctgcctcagcctccctagtagctggaattacaggcacccgccaccatgcccagctaatttttgtatttttagtagagacagggtttcgccatgttgccaaggctggtctcaaactcctgacctcaagtgatccacctacctcagcctcccaaagtgctggaattacaggcataagccactgtgcccgacctagatgttttgttttgtttttagatggagtctcactctgtcacccaggctggagtgcagtggtgtgatcatagctcactgcagcctcaacctcctgagctcaagtgacccacccacctcagcctcccaagtacctgggaccacagtgcatgccaccacgccctgctaacttttgttttgttttgcagagatggagtcttgttatgttgcccaggctggtcttgaactcctggcctcaagctgtcctcccgccttggcctctcaaagtgctgggattacaggcatgagccaccacacctggccaaacccccagctttttaagaagtcctgggacattggaggaaaggaaaaggagtgattcatttaaaatattaatacttcttaaaaagaatttaccctcaaccttaataaaaagctactcagagtagaagcaaacagcaaactcagcagaagtctgtgtagatcctccgaagcactaagtaagtcagactttcttcccctggatatctgctcatgggtaccttttggtaactgcaggcagacacagtacgcacgtgcacatggtggccaaactcccctgcggtcggctgggaatgggtaggcgaaccagcggggaatggagtcaccctctttcagctttaaaaacaagttggaggagcttggagtcttggcagctgagttattccattctcaggaataagatggggcactgataacaggtatcatgtctggaaggccctgtgatgaagagagggcccacatagaagagaaggtgctcagagtccattctaacaggccatcctcttgggaggtccattgtgtcccagacactgtgatagggacttcacatgtgttccctaatgtattcctcacacctcgacagacgacactgctgtctccaaaacaaatgcagaagcagatcctgagagctgaagttgctcagggtcacagaggcacaggtaggcctctgaatcagccacactgacagctcttccctccaccacgctgcctcctctctcagaagggatggtctgaaaagagcaagcaacccgaatggcgccccacggagtgcaggcgctgggtccaggaggatggcttgggaaatgccgcgtgcttgtttggagaaataactctatgccacagtcaagaggagtcgctttgggaccccagtaagaaaatgaggtccctgctattatccagccagagattcgtagaggaagaggtgaagtggctggctggagagggaggcatcatcccttggtgactgggatcacttcaatattcacagagacccataagattcagaggctggtgcaaaaaaaaaaaaaaaaaaaaaaaaaacagaaatgagatgctgactgaggaaccagtttgtgacatgtatcaagccttgtgctttgaatgcttttcagtaaataaaggtccacactcagctgggcgtggtggctcacacctgtaatcccagcactttgggaggccaaggcgggtggatcacctgaggtagggagttcaagaccagcctgaccaacatggagaaaccccatcatctctactaaaaatacaaaattagctgagtgtggtggcgcatgcctgtaatcccagctactcaggaggctgaggcaggagaatcgcttgaacccaggaggcggaggttgcagtgagctgagattgcgccattgcactccagcctgggcaacaagagcgaaactccgtctcaaaaaaataaaataaaaataaaggtccacatggaagccttgattcaggagggactctacaggtgccctaaggaaagacctctccgttctggctcctacacgttagagaccagctacaatgcagaagacaaagttgagaccaacgcggggaagcagggactcctgttaccttattagaggatttgctgttgggtccctttaaatagtgagctctggtgagtttttaaattgctttaagtaagtcagaggtccccagccccagggccacagaccagtatgggtctgtggctgttagaacctggctgcacagtaggaggtgagcagcagcgggtgagcatgaccacctgagctccgcctcctgtcagatcagctgcagcattagattctcataggagtgcagaccctattaattatgaactacgcatgcgagggatctaggttgcatgctccttaggagaatcgaatgatctgtcactgtctcccatcacccccagatgagactgtctagtttcaggaaaacaagctcagggctcccattgattctacattatggtaagttgtataattatttcattatatgttacaatgtaataatataaaaatgcataataaatgtaacgtgcttgaatcatcccaaaactatcccccacccccagccctggtctgtggaaaaattgtcttccacaaaacctgttcctgctgccaaaaaggttggcggccactgctttaagtgacaaggcacaaagcgcacagtacgatcccacccaaatttgccaaaaactcaccttctgcctgagccacgtacgtggatctaaagtggaatctcagctcgttccaaaagctttgctcctcttcttaaggatcaaaaagactgatttcaaagggaaaggggtccattaaacactgggggaccttccttgccaaggctcttatcaggctcttgcagctccaccatccaggccaccctctcaggctgagaggaaagggcttatctaaccatgtggaaacaacactgcctctgctgggtcgagactggacaaccgctgggccttttcagcccctaggccatgatcaatatcactaatcgctttaccttctgtgcccagcctgcggatattcaatttctctcaggcctagagctaacgtcatgtgtctggctgctaaaagctccggctccttttattaccacagtaaaggaagataacaggcgagaggtctgctgtagacatttattgaatcatctgttgcaccaacagcacattgtatttcacagaagattggccacaggcaaaataaaataacccaccacaaatccgcttctgggggccttcttcagctccttagtcatccagtgttcactttggcaaacagaccagtttacagacttttgttgcaaatctaaggttccatttctctctgtagcattccggctagagagagacacgattgtactttggtagtttgtctaaggcggagttttcccacatgtaaacatttcactatacaagtgtgtgccagctgattgaagaactgacggcacccctacccctgaagagtgtacagtctaaacaggaggcgaacactgtcatccggacaggctgagaggaggcggggaaaggggctcgaaggagcctgggcagaccctgctggggaggggcctggactacaaccacctgctcccagaaatgacactgcctgaggcaggagacacagcaaaagccaactatgggaaatctgagcattagaggagactggcccctttctctaagacggcctcaggtaggaaaagggcagccattacaagaagaagagtcgtcaggtttggaaactgtatattaagcccttcactgaagtacacagtgtctgtgtgtgtctcaagctaagccatgctcctcaaacacccaaaaagaaaggaaaacagggagagaacagtcaccagatccaagaagcacatgatcggtgttcttttttttttcttttttgagcctgtcgcccaggctggagtgcaatctcagctcactgcaagcgccatctcccgggttcacaccattctcctgcctcagcctcccaagtagctgggactacaggcgcccaccaccacgcctggctaatttttttgtatttttagtagagacggggtttcactgtgtttgttagtcaggatggtcttgatctcctggcctcgcacacgatcagtgttctaatcacactatttccaggccgaagccaaatggtgactcagctaacatgacactctttatggggctggagtgatgtgcagacaccacgggggatgactgtagttgttctgactccatcctgacttcctggaaagatgggcagcagataaggagaaggctcgtcctccagaacagaggcagcagctccagcagccccagggggctctagccacagccagcagcagcggtttttcatttaaaaaattataaggtttgtgccctctgcctcccagcctgagcagagcctgggtgagcctgggagaggaaaccagagctgagccgcaaggggggtgctacaaggagggagccccagcaggaaggggctgcaaggtgccccccatccccaacccccatgtctggagcagcctgggaggaggcccgcctgcatctgccaagagaaagtctgtctgaagtcatgggcttctatcccctctcccaccaaagccatcctagggctaaagggttaaagaagaggaaggtcaggactacagctgggccacagcctcatctcagagcttcccaggggccagtccctcccctctcctggggaaccttgctttcaccaccaacatactttacacatcatatcacttgctcctctgccaaaggccgggcccatttgtgccacgtgttattcaggctggagggactccttgtttgaattcagcagccatcgtggcctttccaggcctgtccctgaggcccccccagtttcccctggccttgccccaggcatctgctgccaggagggtggggcctcctctctcgcttctttaaagatctgtgctctgcgaccaggaccgaacacccgaagtcctacccaaagccttctgcactgaagggggcaacagagacacgggagccacacacaatgaactggtctatagcagcggagaaaggagaagcagaggaggcggagacctgaccccagaaagcagcactcaaacagatgcagctgcacccacgcgcccgcctgctgccagagccactctccggagcctgcagtcctgaagacgcctcagcaggggcaggcaagaagacaccccgcgaacccccagggccggccgggcgcatcactgggagccggggctatctccctccgtcagcgtcttgaagtccatggagagggcctgctcttccgcctgggaaggccgcttccagtcggcccgggtcaagatgtagagcaccgccccaccgaagcaggccagcagcaggcccagcacgttggccaggacaccctcgggctcaaatgcgctatacttgcccctgcaggggtgagaggaagggagaagctgcccaaggggtcacaattaggccaaatgccctttgtatcctgggccttaaagatgccatggggattccagcaccagcccctgcctccctgccctgcctgaagagaacaaccatccccccgcccccaaccagcaatctccagctatggctcacagacaaaaagagatgggcaatgtaaaaacctagatcaatattctagctctaagcagttgtcctgcagatcctgctgcgtggtgggaataaatagggtgcccatagcccagaagtttctttgaaagggtaaaatcaagaaagctaaccaaagccaagccccaagcacccaaatcttagcaagcataactacagccaccagttgtgacgccacgagaggcggctcaggaagccacagctggggaagctgaaggcagggtgaggtctgtgcaagggtggcccaggccctgccctctcccacccaggacactcacccgaggttgaacagcagtgcctccttcaggcccagcagggcggtgcccacggaaaggaggaagatggtagcaccaaagaagatgtgctgtgggcggtagcggctccgcagggagaatgaagctccggggaacaggaagaagctgaagcccaccagccactaggatttgaaaggagacggttccgggacagggcggccggacaccccagcagccgaggtcggccaggcccacacccacgtgcccacgtggcgactgtgagcccctcagccctgcctggtttccttcctcctcagcacagtggtgggaggagcactaagcgcttagggacaagggaccggtcccccaacgcttgaggccttggcacactcagaaagctgggcttgtggccaaaagtgctgagtcagccatggggcgcctgggagctgggcacccttggccgccaatcctagctttgcacccgcacaggcctgggaaggcagctctctcacctgcacacaccccagaaatcaggcccttccatgaggtacatttcagcccagctcccctcctcctcccacctccctggtaggtggccccaggcccggggtgttggaaggactcacctgcacaaagtacaggacaaagacaaggatcccgcaccagctgtgtaggctgtacaggtcagcgtagcccttcttcctgtggtagtcgaacaccgccaccaagcctgggccagagacaggtcatatgaggacagggttggatgtggaaaaggaaggtgtaagatgacccaggggaaccagctagcgggacttctgggctttagtcccagctcgagggctgccagcacctagtggccctgcaggggatgtttggggtgggggcgggcccatcacagctctggggagggaacagagcaggtgaagcggctgtttgccatacctgaagaggcaggcaggtggcggggaaggccgcgcccgggaactcaccaaccagggcgatgacgagcgcaaagatgtgcagcagcccgtgcaggaccttggtggtgcgtttagcttcgttcctgaagacacggtaaaccagcagggctgtgggaggtgagagagggaacgtgagtgcatccgcctgtgcgtgaggcctcctgccccagcagcaaggaggcaccttggtggagaggtgatgtgagctgacggcttgtaacaggagcctagctgcaggaaccggaggagaaagccaggttccctggggaccctgggcagctcctggccttctctgagggcacctagggctgtgtgcaccttaacacccctcccccaccctccaacctcccccagctgtgcacaaagagggcagggccggaggctgcaccacagtccccaccaccaggacaggcagtgaaggcagcgcctctgccctcgtccccacctaaaggagctgcccggcccagcagacgcccccctccacccaccttcttgtcaggtgtcctgcaaattccaggctgtgtttgaggtccactgttggtcacactgaggcaacaagcagcctctgagttcacctgttagccacgtggctcctcacacaggcccccacctaagcctgggcagatggtcctactcctagcaagcaggcgcctggctcccaagcagaaccttgtgatcccagcctgatctcccgcgtccagaagaggtgggcaaggccaggtcacgtgaggaatgcctcttagctttctgctgctcaggaatggctgtcaccaggaccacctctaggaagagcgggtcaaccggatgcagatcccgcttcctggatccctggcctggaggcaggtggaggccaagcactgccttgctcctgccccagggggaggcgctctagctctgccaagtccaagaccaacaacacacatgcgcgcgcacgcacgcacgcatacaaactctcacatatgattactttttttccctcaattcaaaccacccctgcagcagggcctggctcggagcctcattcctttccctctgctgcaagaagtgcccgccttggatgctgtgtgtggaaacgaggtgaaaatgctggaccaggctggagaggagctgccactcaccaacctcagagcctgggtttggattccatctccccaggctctgaaccagcttctgtctctgtcttttctagaatcttagatttgtccaaccagaagagaccgcaggggtgacaagacccctgcaaactgcctctcagggacccccacaagcccgggaaaagaggagcggcccatgggactcaccatttccctgcaggaagatcaggcctatgaccatgcagagggggtgcgcgttgaactgcaggtcgctctcccaggcaatgccgcctcggtacagcccgagccacgcgccggtcatggccaccaaggtcaggcccagcagctgggagaaggccacgtagtaaggcagtgctgtgggggtggctgccgcggccccgccctccatgctgaggcaaacgctgcaagaaagagcagagctcagaggagcagcgcacagcaccccgagatgcgcacagcccccgcggatgcacacagccccccaagatgcgcacaggccccccgagatgtacacacccctcaagatgcgcacagccgcccccggagataagcacggtccccccagatatgcacagccccccccgaaatgcgcacagccgcccctgctagatgcgcgcaacaccccccccgggttgcgcacagccccctccagatgcgcacagccaccccgctagatgggcacagcccccccgagatgcacacagcacccccagatgcgagcagcccccctgagatgcgcatgtcccccccacggatgcgcacagcccctagagactgcgcctgagatgcggcgcggctcctcccacggcggccccgccaccctcccccgaggctcccgctggaagcagcgctcgctctcctacccgcaagccccttcccacccatcgtcctgaggcagaggtctcaagtctcgggagtggctggggggaggggcccagcctccccacggggacaggcgtgacctgggacacgacgccaggagttccatatgcggtgagggtgcaaggaaagataccccaaattctagtgagctcaagggcccagtgcccggctttgttttctgtttcatgaggccctggccttccctgggtgggctttacaggtgagttacacaggcaagcgcgctccttgacgggaaggaaggggctggtcacaccttttctccagacgcgtcatgaagtacatctcgggagaaatgggaagtctccctcccccatcctggtttttaactccatgctggcgatgaggaggcctccccaccccacacccaggagagccagccccgctccccccacgcccccgcccgccccccaccccgctccccgcccggccgcgcctgcagagtagaagtgccccgaccatgctgcacacagggacctgtcagcacacagggacagggcacttcccctccacaccaggggcggggcggacccgcactctagaggggccctcagggaggtttccaaaactgaaggcccccagaaacgaggcctgcgaaggggccgggtagagctcagcacggctgtcccaggtgctcggccccacgtggccctccaggaggaaaggagagcgggtggttcctagcgaagcagcaatgagaaggccccgctaagagcccaagggagtgcccagtgcctgcacagcttcatgccggccggagagcacccagcagctggggatgggaggagaggcggcaggaggagaacaagcggggctctcccctcacccggcagcggcctgtgcgccacggaaaagtgctgccatggcccacagttgccactgcaactgccaccaccatggccaccacaagcagaccccagagcactgctgctgccccccatcccgccccggttccccactggccccttgccacggtccagcctctcctggcagcaactgtatcagaactagggggacagtggccagcacaggggcactgacccccttcacacccggcacacgctctgccctgcagtgcccaggagctggttttcagtccctcccagtgatgggctccttctctgctccccagttctctctgccacatcggacaactgttggcaactccaccattaaagggggggtgtgtgtgtgggccgggtgcgatggctcacacctataatcccagcacctggggaggccaaggcgagtggatcacctgaggccaggagttcaagaccagccacaacatggtgaaaccctatctctactaaaaatataaaaattagccgggcatggtggctcacacctgtaatcccagctacttgggaggctgaggcactagaatcccttgagctcaggaggcagagtttgcagtgggccaagatcgcaccactgcattccagcctgggtgacagaatgagactctgtctcaaaaaaaattttttttaattaaaaaaaaaagggtgtgtgtgtgtgctaataatccacacgcactgcagtagaatatggatcagcaaaaaaggtaaaatgacaggccatcagaatttgatctatatcctcacacaccttcttcctaaaacacatatgcatccttttatagaagcaggatcatttattccattttctaacctgctttttaactgagggcgtagcacacatggatgtttgtgtcaatggatacgcgcccacatcatcattttcgtaacctcacactcttgcattgcacggccattttttagccaactagttcccattgttcagcatttagctagctttcgatttcagttttccaccaaataaacaacaggatgtggtcatctgcaaacttctctgcagggaatcctgaaacaagggctaggttctgttttagacttctgacacattccatcaaatcatctcccagaaacatagctccaatccacattcccagggtggacgggaatacgggattccagaagccccagccaacaataaatcctatttttggaactcctgcctctgtccttatctgtcacctacacgggtatcagttctgtccccgccaccccaaattcaagccccatttctgacggttcactactcatctctacctggacatcccacagacgcttcaaacccagctcgtcccaagtcaccttctctcccatcgtcgccaagttctctcatgccctccccactagctagcagggctgcccttcttccgggcccaggtgacacctcagctcctccacagaaggctgcccaggccgccgcatgctggcacccctcccctcacttccctcctgagcatcctcactgccccacccaagtcagggcctgcagcttctccctcttcaacgtgacagacatgccagggacaaagccagctcccaacatcatgctgtcccctgcgtaagtgcccccgagtgccagtgaaatgccaactgcatggcatgatcctgcccgtttccatctgcagcccccactgttcctgctaggccctctagaggagacgcctgggctcacagaatccaaggacatggcccagcctggctccctgctgtgggcccacacccctgcctccactcctcaggcaccgcggtgcgcagatcactctgtccccaggctctcccggagcctccttaccctcgcggtgccctgtctgctcctcgaaggcagggacgctctcactcctccttgggtatctttgggtctctaataccccgagtctaacaggaaaatgtactgaaagaagtgctgtcccccctggtcacttgttgtctgtcctcctctccaggtcgccgcctcctttattagattcatccccagagagcctggctgcaggcagaatctgattagctacaaattaggaagaacagagggg

SEQ ID NO: 7815 - DNA, 20813 bp, Homo sapiens
  misc_feature (1056)..(1056): n equals a,t,g, or c
  misc_feature (1060)..(1060): n equals a,t,g, or c
  misc_feature (1068)..(1068): n equals a,t,g, or c
  misc_feature (1244)..(1244): n equals a,t,g, or c
  misc_feature (1944)..(1944): n equals a,t,g, or c
  misc_feature (1949)..(1949): n equals a,t,g, or c
  misc_feature (3956)..(3956): n equals a,t,g, or c
  misc_feature (4155)..(4155): n equals a,t,g, or c
  misc_feature (5594)..(5594): n equals a,t,g, or c
  misc_feature (5597)..(5597): n equals a,t,g, or c
  misc_feature (5684)..(5684): n equals a,t,g, or c
  misc_feature (5870)..(5870): n equals a,t,g, or c
  misc_feature (6644)..(6644): n equals a,t,g, or c
  misc_feature (6647)..(6647): n equals a,t,g, or c
  misc_feature (6657)..(6657): n equals a,t,g, or c
  misc_feature (6692)..(6692): n equals a,t,g, or c
  misc_feature (6698)..(6698): n equals a,t,g, or c
  misc_feature (6727)..(6727): n equals a,t,g, or c
  misc_feature (6733)..(6733): n equals a,t,g, or c
  misc_feature (6890)..(6890): n equals a,t,g, or c
  misc_feature (6900)..(6900): n equals a,t,g, or c
  misc_feature (7018)..(7018): n equals a,t,g, or c
  misc_feature (8611)..(8611): n equals a,t,g, or c
  misc_feature (10148)..(10148): n equals a,t,g, or c
  misc_feature (10379)..(10379): n equals a,t,g, or c
  misc_feature (10677)..(10677): n equals a,t,g, or c
  misc_feature (10838)..(10838): n equals a,t,g, or c
  misc_feature (10890)..(10890): n equals a,t,g, or c
  misc_feature (10955)..(10955): n equals a,t,g, or c
  misc_feature (10958)..(10958): n equals a,t,g, or c
  misc_feature (11101)..(11101): n equals a,t,g, or c
  misc_feature (11178)..(11178): n equals a,t,g, or c
  misc_feature (11273)..(11273): n equals a,t,g, or c
  misc_feature (11491)..(11491): n equals a,t,g, or c
  misc_feature (12008)..(12008): n equals a,t,g, or c
  misc_feature (12329)..(12329): n equals a,t,g, or c
  misc_feature (12338)..(12338): n equals a,t,g, or c
  misc_feature (12375)..(12375): n equals a,t,g, or c
  misc_feature (12544)..(12544): n equals a,t,g, or c
  misc_feature (12712)..(12712): n equals a,t,g, or c
  misc_feature (15467)..(15467): n equals a,t,g, or c
  misc_feature (17110)..(17110): n equals a,t,g, or c
  misc_feature (17157)..(17157): n equals a,t,g, or c
  misc_feature (17159)..(17160): n equals a,t,g, or c
  misc_feature (17244)..(17244): n equals a,t,g, or c
  misc_feature (17248)..(17248): n equals a,t,g, or c
atgagagtgtgatattttaaagtcagacgcagcaaaaactgtttcagggtgaagaaagacccctttcagccctgttttgcagccctgggtgggggcatgagatagacagcaagcttctgatcttgaagcttgtctagaagacacatcttctaggtctcgtggtcatttggtaggctgacctttgagtgagcgaggccactattgagtggatagcaagaacattggaaccaaagcctcggcacaggcctggcactggctgtacatcagctcttacaactaaacaactcaactaagcaactgaaacgaaacaaaggagcattcgttctctgttgttaggaatcattctgctctgttagggaagggctgcaggaagggcagtttcctgaataaaaatctggctgcgaccagtcccatgtgtctggtaagtaagtaagtaagtaagtgccctttgaagggatcattaagacacagggagcatgaacctgagatcagaagcatttctttactaatttagattctgcgaaatagacggacctctccacccccaaacctaaaacagggcaggacttgtctctggtggctggaaagcaaatagcaagactaactcaagccccagtctctttccacactccctgatagctaaggactgctttctcagctagaccggggtgggcatcagcgacgccttctcagctagaccagggtaggcatcagcgtcctctctccatctctatacccctctctctcacatcaggaagatgaaatgtgtagctctagcggggacctctagccaggagcccagtggcctctcagattgctttttggccaggtctcagcactgctggcatctttacatcttactccttaaaaccgcctctcgctgaggagccactgcattttgaagaatttctcagtgtctgtcaggaaagtgctcctgctcatttggaacgccacacaccacccgcactcacctgtccaggcgaatgagcaggtcctgtagctttacaaatatgccgctgatgccgcttctccccagggtctctcagttttccaggncaanaagatttngggcctataccctatgggcaaaacacctaaaatgtcaacagtcaaaatgccattctttttggccatcataagagggagtaggtatcactgctgcatgccagttgtttttgactagaatacagtgagcgcaacgcaattaatgtgagttagctcactcattaggcaccccaggctcnacactttatgcttccggttcgtatgtggtgtggaattgtgagcggataacaatttcacacaggaaacagctatgaccacgattacgaattcgagctcggtaccatcccaacactttgggaagctgaggcaggcgtatcacaaggtcaggagttcgagaccaacctgaccaacacggtgaaaccccgtctttactaacaatacaaaaatcagtcgggtgttgtggcacatgcctgtaatctcagctactcaggaggctgaggcaggagaatagcttgaaccgggaggtggaggttgcagtgagccgagatcgcgccattgcactccagcctgggtgacagagcgagaccccgtctcaaaaaaagaaaaaagaaatgcaaaaaaaaagatttgtcttagatcttagtctggctaaaagaaatttttttttttttaataaaaatgactgattgattgagacagggtcttgctatgttgccaaggctggtcttgaactcctggcctcaagtgatcctcccacctcagccacccccatgcctcagctgggatcacagaccactgtgcccggccacaagtatttatgtagatgtctcctctggtagactgcaaccaacttgagggccatgtcccctggcatagaggaggtgctccactgaattaacaagtgaatgactaaataggatataaaaggtgatgagtagnactgnccggctcgggctggggcactgccactgtctatggaacatgaccaaagtgacaaaatgggaagaactgaattcgtcacaaaaagaaattcagtcaatctatacatgttcaagttttattacaaagtatgatgggcagaaaatacggtacttcttatacaggaggctgaaacagaatgaaagggtgaaaattaggtttaatttacttaggaaacaagaaatagaaagtcatagctataacactccactttcaggtgcccatgaagtagccttcaatggagattccccatagttgtttcacagcacagtgttaaaattttattacaagccctgtgtacaatcagtcctgtgaaaatatttataaaagaaaaatattacagtacagttctgcaaggggcagcttcctctacacctgaccgtggatgccacaaaacctataatatagagggaaagtttaaatatataacaagaatggaagttcagacatactaggctaaaggacacagaaatggatcagttagagcttaacatttcagagcaagaaatctccattttctacatagaggtttatacaatcatgctacaaattcactctgggtggggtggggaaggaaggtcactgacaagaggggtagtaaaatacacaggaaccaaagcaagtgagtcagactcaactaaatcgattcaaagcttcagctcaacaattttcataacacatggtataccacaatcaacccaaggtgagaacatttcttttaaatagtagatatcacatgttcataatcactgggttgtcccaaaggtgggtgcctataaactttccagctgttacatagactgtcaacatctttcttcttgagtttaaactttctttagcttatttgtttctcgttggatataccagtccaagcctctttgggaaggcacctgcatgtttccatattttaaaaatgacatccagaaagtagcctgagaggacctggcccatcccatgtggccacacatttgactttgaccattagcagcagtgacactgtgagagggggagaaggtgcaggtgggtgaagtgggcaagggtctgcaacacgagacgctctcaggagctggcccagccagggcctggcccagggttcacagtgactttgctctgctccgccctcttccctgggaaaaccaatctaagtatcaagcatgatcttccttcttcgtcctggagtacacacagtaaagggaaaagtctgctttgaggcttctacttcaatggtctcccctaccccaagccaggaatgaaaggggctgccatattctcaaagtggggaaggcagagggacagtactgggctgccctcccacgtgtggtaaaccctgcagctgctacatgtcttcacagcccaggaattcaaggcccaggtggcagcaggaagaaacagtggaaaagcaaggggaagagaaaagagaaaaaggagggggaaagtctgcataactgtcataacctctgcttctcctgctctgtaacaaacccacaaccaggaagagtcatggtctggaacaatcatgggaccccaaacgcctgtaggttttttaccaccaaacatcacccatggctgctctaagctgtcattttgttcccacagttacctagcatcacggatgcccaatttgtggcgcaggaaggctggcccaggctaagggcagtctcactccacagccatgcaatggacagtctgaatgtttccctaccccagaccttcactgacctctactatttcctcctctgatataaagaaaacactttaattttctcctgcatcctacatctcctcctaaaattttggccctaattgtcatcaaaaccttgtaggattctgaattttttgtttcttcctgaatcttagccagttctctcagagccaatcctggatttataaggaattttcacctatttttttttttttttttattttttgagacggagcttgctcctgtcgcccaggctggagtgcagtggccngatcttggctcactgcaagctccacctcccaggttcacgccattctcctgcctcagcctcccgagtagctaggactacaggtacccgccaccacccccggctaatttttttttgtatttttagtagagatggggtttcaccatgttagccaggatggtctcgatcttctgaccttgggatctggccacctcagcctccncaaaatgctgggattacaggtgtgagccaccacacccatcctcgcccagttattaaataccttccctcttcaagtcctaaccttgcaggctaattcctccctggaagaagaggattccaatgctcctgagcataaaaaattcaggtccttgaatgacgtggacccattctccagctctctggtggtagaggcctgaggcctaatttattcagcacctccatccttcagtcagaacagatgaggacaatacaggcagctgtgcctcaggctgccaggagcaaaagggccatcaccagctgggccacagcctgcggagcctccatgtgggcttcctgctaaagtcctagtggctgctcctcccgcagtcagggagaacagatccagggcctcccacccagtctcgctggctgtcagtttgagaacctcaacaaattacagagttgtttttgcaactacaacagatcggtgctttctggagcatggatggcttacagactttctaaatcctgagactgtagaaatcccctcctcagtcatgggtcgtcgggctggtggagtaaagggagggtaagagagctgggactcaaagaccagcaactcatcaactgtgagtatgtgtgtgcttgcttaggggggtggagtccccctgggtccccggtggcattcaggggaagactgtactgcaggacctaaggaaggatgacaggagctgggcgtccacagggcaagggaaatctcaaaagttgttggtttccagagtaaatagctatcttatgcaaatatgttctaattattatttttttttcaagttgttgtttctgagttccagctgacaaattccaccatacagaccaggcgtaggtgcagatcaggaaaggaatcttagaactcagtggatgtaagccctgcccagcagaccagccccttctaccactgacttccatttcagacccttctccacaggaaggaactgatggcctcctaaacaagcagccatcagcttggccttgctacccttgagagaaggacccagtaaccattatcaaacacaatgaaaagcagaggagggttctgaccaagaactgctcgctttgtatctccaaacgatgcagtgcaaatccagtggcaaatgcaggagaggcaaccacaagcacatggccagccagagtcctaaaatcagaacaacaaagtaaaagggtagaaggggaaatatgctggctaaaaaaagagcctttttctttgggacaggtccctgtatggtaaagcaaagagctagacttttggcatataatgacatctacttctgaaaaggaagacttaaccaaaaaagcttaagggcccagaagaacaaagttactgttttacttctcaagcaggtgagaaccaaagaggacaaaaccatcatccttcaggcctgctactctactaatctcagatgnagncaattcagagggacttaaaaaccttcgggtaggagcagagcgcaaggaaacagccaactttcccccaagagcacatcccaaactgcnctgccccaagggctcatctaacggtggaatcacacatatgcccctccatggaactcattcacataacagaaagacacctgcggcctgcaagtcaaaagacaactgcaggctacaagtccaatactgctcagaacctaaactgggggagagaggggttgacaggtgtgggtagagctcttaactggnctgaccctgggggtctataattccttttccttctttttttttcctctcccttttcattacccacagtataatgctttttaactatctatccacttgacagcccaggattgccgcagtccatcagtccatctctcatgtaaggtcttgttcagggttggaagcacagacaggatgcctcgggaagactctctcacctcagaacactcaatccaaagaatgcccaatataccaccaggcacagtaaactcaaacaacagaagcaccgaagttcaactcagatatcattcttgcctatcattgaaaagacactaagtggaatggcctggggcttatatttggatggaaaaacagactctgaaagaatgtactggaaatatgcttgaagttcagcttcatgaaacgattcccctcaagtcaggtaccctgagagcctgtttctctcagctctaccatgctgccagtgggaaccaatgggctggacagtggtgcttcagggtaaacagaggcttcctatgtctgtttacaagcccagaatgcccttgagaggagccaggctaagaaaggtgtgatgagtcagtggacttcagagcaccaaggtggtttggactcccggtcaggtatgtactacacaggcagtgactcaagaaggcaaactgctcatggggccagggccgttaccagctccgggactgggggagagaagaggtgcaagaggggggctttagacaagaatgagcgggggtaattctttcatttctttttgctttctggcgnttnattcgtcgtngatctgagagtcagagatattttctcccattccangttgtntcctttttgctctgttacagtgttttttnatatgnaaaagtttaaaattttgatgaggttcaatttgcttattttttcttttgttgcctgtgcttttgatgtcatatccaagcaatcattgccaaatccaatgtcatgaaacttccctctgtgttctaagaattttgtagactttgctcttttgttcccccnttcttctccnacacaaagatctcatgactgtcacgttgtccaagataaggtgttaaatgtactattttattatttttattttatttatttattttttgagacagagtttcattctgtcacccaggctngagtgtagtggtgtgatctggctcactgcactctgcctcccaggtgaagcgattctccagcctcagcctcccgagtagctgggattagaggcatgtgccaccatgcctggctaatttttgtatttttagtagagacaggatttcaccatgttggtcaggctggtcttgaactcctgacctcaagtgatccacctgcctcagcctcccaaagtgctgggattacagacatgagccattgtgcccagccttaaatgtactcttttaaattgaaaaaagaaaataagctgtgatccatttttgagctaatttttatacatggcataaagacctgcattttaagtcccttttggattgctctgctacttgtccttcctccattgcagtctgcttcattcattgtgtctgcagtttagcacaagctctggaaccaaccatatgaatttgagtcccacttccaccatctgctggctgtgtgactatgagcaaattcctcaaccgttctgtacctctctttcctcatctgtaaaatgggagcgttgatcacagtacttacctcatgggtttcttgtgaggattcatatgttgaaagcccccagatggtccctggcacctggaaccaacccacagtgagggttggtaattattattgtccctcctaaaactggattttctcttatacttggtaaactgtacctatcagccatcttcagttgggttggaatggcctgcacaatcccatgcatgcacctgacgcttgcaggggctcccagcttggcagagacgccatttccatcgggatcagctatccccccacaccaatgctgcagctctctggatggatgcaccctgacctcccctgtgttagaggagaggtgggcgtgttgaatcatggaggcagacttctcctttgccgttctcgtgatagtgactgagttctcaggatctggttgtttaaaagtgtgtagcgcctcccccttctctctctctcctgccaccatgtgaagatgtgcctgcttccctttcgccttccaccatgattgtaagtttcctgaggcttccccagccgtgcttcctgtacagcctgtggaactgtagagccaactaaacctcttttctttataaattacccagtctcaggtagttctctatagcaatgtgagaatggactgtctacatgcttgaagcaggaagggagactttcctgtgagctcagtcgatcagcttaaccagaagtgtcactatttttttctttctttcctcatgttataaatatattttacccataatggatcatattggggggttatttggtcagtttctctagtcgtggtatcagcccatgtgtagaggtagggcctttttgaagatgtgagccattgtgggctgagagtgatggaaggcaacccagggtacagggattctgagtgtggagggaagtgagtctgaggagaaatccaaggtgagacagatggagctggcctccacagacctcagtgcaagagtactgggggtgaccacaggcctacagagagctggtgtcttgccagctggttttcagatcaggctcaggtactcatgggcatgcaccctggnatggagggtgcccgcctcacctctccacaccccacccagtccctaccttgtgtgccctctcctaattgcaaactcataacatcagggtctccctggagaaataggtatgatggggagggccctgcacagccctggggttgattgcacagcccataagagagaaaaagcccaaacatgtgaacataagaggtcaagttagaagaacctagagagataacctggcttccagagacccagatatatcacatccatccatccatccatccatccatccatccatccatccatcatcccatccacctgctcagaagtggtcccagcctatggagggagggcctcatcaatccctggccataacccaagggtggctcaagccccagggaaaagtggccgaggagagcagaacaagttctggcctaaaagtcaagacccctggttcctctttttggctcgccattagctaactacatgaaccagatcatttggcttgactttctggacctcagtctccccacctgtaaaatggggacagttggaccaggaggtggatggggatttccagttctaacattctgtagctgagcctctggcctctgacgtcacaatatggagctggcctcacccagctctgctgctctgttggtcatgggagcaaggtggacttgccctggaccttccctacttgtgctcctctgttatgggcagctcttgccttggctcaggatcaagggtgaacacagtttaggtgtggctgggaccccaagaagcatgggaccagacaaagggactgggtgcggacaggaccttctcagcacatgatgcccatatccttccctgcagatgacttctacaatgagaccgagaccaagatcttcctgcagttttatgaccaaacaggtgaagttgtgttgaacaagttcatggaggccacttggaactatgtcaccaatatcaccaggaaaaatcaggaggagatgatgtgataccacctccaccccagcctctcctctctttgctctttttagggatttgggaccatggggcaccacacctcctgcccccatcccaagcaagaggaacaagggaagccccagtgtacatgtcaaagagggctgcaagctctgggcctcctggaagccctaatcttcctccaggcaagaatctcttgcttcttgtcctttgtaaatctcacctccttgcttttagagatccaggtttctgccctctccctctcagcaaatcttgctccctaagccaatgggattagggagtcagttagggtgccatggccctggaggtcaagtgggacccttcccctgtcccccaaccttggtggctctctttgcagctgcacaaggacatggagaggtcccagttcatgatttactttggcacccaggcccacctgtttaaagtcacccagttcaaggacccggatgtgaatggcatgctgagtaagctgcagaacatagacaaggcggctctgtccaaggacgagctgcgggaggtgatggatggaacccccaggcctttaggncacatgctccctggtcctaggggtctggtaggggagacagagtgcctggggcaggagggaggcagggagtggaggaagggcaggatcagaacttcctctggagaaggagaggagtagaggtgggggtaccgatctctcctggctggtggggcgagcactggggggggacctggggcaccagcctaccctgggtaacacctgtccccccagtataacgagcttctggcctancctggagatgacatacagtatggcccaggtgtgcctgaatgaggggccctgcctgtccctggagtctggtgaacacccaagccctgtcccacccaaccacagaatctccagcactcagtcccttccaggggcccctcccagcccccaaccaccctcccttattgccaggagggtgagggaagaggcaagtgggagtgggtcccccatggctccttttctgggcatagaactcgaagtcatggccacctccagggacaaagaggagctgctgtgggcctggcagggctggcaggatgcngtgggccgccagatctgcaccaccttcgagcactatgtggagctcagcaacaaggctgcacagctcaacggtgagcagatgggatgccacagagcttggagtgatggcaaggaaggggcaaagctgagctttcccagagtgaaggtggccgtagggccctnggagacaggacctatgagccctgcagctgggctctccaaatattcatagagncacctaggtgctaggtgctggggaggttctgacgacacataggtgaaaagacaggcacctgcccntcnatgcacctacggtcctgcagggagacagaccatattcagtaaacacctgtctctcactaccatctggggtgatgcggaataggaagaggctgctgagaaagagaatgagaagaggctgctgcagacaagtggacagggaaggnactctgacatttatccaagacctgaaagatgggcaaaagacgggaagcaagatgtgaaagaagagcagcctaggcangaggctccgcggcaggaggagccggtgctctggaagacctgaaagaagcccaggtggccacagggctaaggatgaggtgggataagaggggactncagggccttgcaggcatggtggggagctcggatcatggactttgctcagtgcctttctgaaatgggcaggtattctccccgttttgccaaagaagacccagacggtcagcgaggttgagtggcttccctagaaggcgtctgggtatcctgtcagctaggccatggctaaagggtgagatggtgagctcctggtgagtcctctctcctgtcctaggttnacaaagacatgggggccttgtggcactccaagtatgagtcggataccctggagcaagacctggagcggctattccaggagctgcggccactctacctgaacccgcacacctacgtgcgcagggccctccaccgccactatgggcccgagctcatcgacctgagggggcccatccctgcccacctcctgggtaaaggccctgctggtggccgaggtgagtgccagataagggcagagactgtctccagcctcctcttagcccctctcctcctcttccagagaacacgttggctcagtcctgggtcaacatcttagacccggtcctgcccttcctgaagaagatcccagaggatgtcacaaagatcatgaaagtccaggttagtgcttggcctgtctgtccctgcccctccccattggcatccttggacaaacagggcagcgccccccacaccccctcttctcccatagcactggaagccagagaaaatgttggaagaggctgagacattcttcacctnccttggcgctgccacctgccccacccagtttctggaaaaagttgatgctaatgaggccaaccgatgggcgagaggtggagtgtcacatctctgcctggaacttctaccaggacgacgatttcaggtgctcacagcggcaccacacacccggtcctctcctctgccctgtctggctgtcttaggtatgggcaggggaaagccagggcagaggagggagaaggcaagtgagaaacacagaaggaaaggtgacgtgagaggaaagggcttggttgctgggtggatatggggcctggagtaagaaagaacaattgccggccgggncatgggtgntcacgcctgtaatcctagcactttgggaggccaaggncagtggatcacgtgaggtcaggagttcgagaccagcctggccaacatggtgaaaccctgtctctactaaaaatacaaaaattagccaggcatggtgacatgtgcctgtaatcccagctaggaggctgaggcaggagaatcactggaacctgggagccggaggctgcagntgagccaagatcgcaccattgcactccagctgggagacacagcaagactccgtctcaaaagaaaaacaaaaaaaagaacaactgccaaggcctgtctgggctccaacccgaccacccaatccctcaaggagtctgaatggggaaactccctttctccatgctccttgnacccatgccctttgcttgtagaataaagaagtgcgcggaagtgaccacagaagacccgctctccatcttccacgaaatgggccattccagtacttcctgcagtacaagaacctctccatcatcttccgcacaggtgccaacccagcctttgaagaggctgtggggtctgtgatcaccctctcggcctcctcccacaagcacctgctcaacataggcctgctcagcctctagcaccaggactcaggtgatgaggatcaagggcccagcaggagggcagcacaagcctgggaccgcagctagggcttggtggggtcagggctctcgggcaaagctacgggaaggagatcccaggggttgcctcttgactgccctcaccctcttcccagaggatgaggtcaatttcctgatgcatattgccctggagaagatcgccttcatcccctttggctacctgatggacctgtttcgctggaaggtctttgacggcaccatctggaaggacatctacaatcaggagtggtggaacctcaggtgggttgggcaccatcttccaccagatgggccatttccaggactttctgcagcacaagaacctctctaatcttccacacaggcactgagcaggtcttttagcctttctaggcttcagtctcctcatctgtgaaaaatggaccctggtgatggccccacctgctccctgggtagctgggaagctcacacaatgattgcaactgagcttctctaatcacagaacactgaccaccaggcaggccctcccaaacctccctcccttcctggtgccaggcaatggagtgtgcgggggcctgagcactttcctttctggggaaagactccccatgggagagaggcaggcccctaaaatgcacgcatgcctgcctcgggcttaacatccccaagctgccatgggaacccaccagcagttgggaggcatcactctcgagtgagggacccccgtgttacacctcatcactgacccctggccatttgatgggataataaatgcctgtgaccagggctcctccatatgtggcaggccgcggactgaccagcttcagtctgctggtcatagtgtgattcggggttgccagggggtgctcctggctctgcaacaggctcttactttttttgtttgttttttgagacagggcctcgctctgtcactcaggctggagtatagtggcatgatcacggctcactgcagccctgacctcccagcctcaaccaatcctccttcctcagcctcctgagtagctgggactataggtgtgcgccactatactggctagttttgtgtaatttttttttaagagatggggttcgccatgttgcccaggtttaaactcctgggctcaagggatctgcctgcctaggcctcccaaaatgcggggattacaggcatgagccactgtgcccggcctcttatgtttaatttgaacatttacaaccaccttgcgttgtgatcacttcaaagcgctcagctcacagaagcaacagctgaagctcacagaggtcacaaaccagcccgaggtcacacagcaaacgagcaggtgacagagctgggagctcctccccttgtcctctcactcccacccttgacttcaggagcaggtctccctggtgggcttggcagagtcttgacctcgtgcctctctaaggtcaccctcataggccatctgaggcacctgcaggaggcctctgtcagccctgcccatcaccccagctgatggaaccctggggctaagcaggaggggtggcaactccctgggccttgaataaggccctgtcaactgggagggaagctcctgacactctgttgaccttggagatggttcagaggctccagtgagccaatgatgaagccttgtttttgagacagggtctcactctgttgcccaggctggagtgcagtggtgcaatcatggctcactgcagccctgacctcctgggctcaagcgatcctcctgcctcagcacctgagtagctgggactacagatgcgcaccagaacacctggctcatttttgtattttttgtggggacagggtctcactttgttgcccaggccggtctcgaactcctgggctcaagcaatcctcccacatcagcctctcaaagtgctgggattacaggtgtgagccaccacacctggcctacttccttccattttatagacattttacaacaagactcggagacaatcagcaactttcccacagtcgcacatctcagaggggcaaaaacagaccttcaggttatcagggtgtgactgtgactggctctgtgtcctgaggccaattccctgatctccaaaccttggtttcctcatctgcaaaatgggaataatagtagtactgccccacagtgatgttactcttttttcttctcaagacttcttactagatgaaatgaccttgtttattggtctataatctgtcccccactgttaggatgcaagcaggggccttgcctcccccgctcccccactggtccctcccccagagaccaggacggtgttgagtgcatgatgcgtgagtctatgtggagagccagacatggttctgagcatagaggaagtgttcagtcagtgttaactgctattgttttactctgattcccaatcccatgtgttttcatttatttaatcaataaaaatgcattaggtatcctcagcctgccaagtccagttttgatagacacgtaggtgctttgaaaagaaaaaggcaggccaggtgcgngtggctcacgcctataatcccagctacttgggaagctgagacaagagacgcacttgaacccaggatggggaggttacagtgagctgagatcacgccactgaacttcagcctgggcaacagggcaagactctgaaaaaaaaaaaaaaagaaagaagaaaagaaggaaaggaagaaaggagggagggagggagggagggagggagggagggaaggaaggaaggaaggaaggaaggaaggaaggaaggaaggaaggaaaagaaagaggctctgagaacctgccagacaccaccaccaagccctctgccttttccctgccaggttgaaataccagggcttgtgccccgctattcctcactcagaggaagactttgatccaggtgccaagttccacttttctgctggtgtgccctacatacggtaaaggtctgggccctgttagcagtgccagtcctaggagttgaggggcatgggaactggggtgaggatttgcaggaaggccctaggtccaaatgtcaccctgtacccgtgcccatctcttcctgttgggctgcgcagccttctgaggcctctgacctagaatcctttgagcttttgcatcaggtccagtgtagagggcagagctgatgagaatattctacaccatccctgctgtcccttggaggagagcaggtcagaggggggcaagggttggggtgactgctggttcagaaagctagagaaggagagccccccagcactctagggtcagcccaagcactggccctgcccaaggagcctccgctcaggcagtgactgctgacatggggccctcgtggccactgcatgtcagagctgcctggtcccaagtggctctgagtttgccactcctggtctccactccccagcctgccctcacgtttctcaaccaggtacttcctcagtctggtgctccagttccagttccacgaaacactgtgcaaagcctcgggccacatgggtccactgcaccagtgtgacatctacaactccaagattgccgggaagctcctggggtgagtgccctctccttcatttgttctgggctcccccatctccctttaaggaagtcctgctccaggctccctctccacacctgactacactagacaccttgagcagagcttcattaagcttatattctagcggaatttcttcctcatgtcagactgcagtctttcctacattaatcagagcccatttcctcttgtgcagccttctgtgttcagagacactgcttaggctgggcgcagtggctcatgcatgtaatcccagcactttgggaagtcgaggcaggcggatcacctgagggcaggagttcgaaaccagcctggccaacatagtgaaaccccgtctctaccaaaaatacaaaaattagccgggcgtgatggcaggcacttgtaatcccagctacttgagaggctgaggcaggagaatcacttgaatgtgggaggtggatgttgcagtgagccgagactgcaccattgcactccagcctgggcaacaaggtgaaactccatctcaaaaaaaaaaaaaagaaagaaagaaaagacaatgtttagcccctcccactaacacacacacacacacacatgcacacacatatgccagtaagccaaactgtcccnagataggaagccagcactggggttctacctcaggcttcagccttccngnntccgaatcccccttatcctttccttacaaggtgctgacctaccctctcagcagcacttggcacacccttcagtgcagtctgttntctncccacctcttcttggaggtgcccaaatccagttcccaggctgatccaggttactttcacagtagcctcttggcatgcttctggtcagcctgtggtccactttgacccttgagtctttttctctgcacttggtgtttagcttattctttccatgcttacctatgtggcagtggtttttagtcccaaagcaaaccctgagggagtaggggactgaactgaaaatgtgaagcatttactactacaggaggtgctctctgatgagtactcttacagtgtttcatattataataatagctcttaactttgcaaagtggatattattatctgccttttacaaattatgaaactgaaggcaagagaggtggtgtcgttgtgcatcattcatctagcaagaagcaaagtcatgctttgaaaccagaactgactccagaacacattatctttcaccctgggaggacagaggtgacaaacttcagtttaataggtttctcaccaagttgtatgttccattggcccaggattcttgcactaatgggtttctatcacatcatgtctataaatgggtgcactttactgtttgaatttgtaactgaagtactggatatttaagtgtgagtaatgtcttcattagaaaatagcagaaccgctcttgtcttttagtgtatttttcaagaaaaaaggaaaggaaagacatcaagcagtggatcacaacatttatagcacaagaaataacttgtatataagcatcaaaaagattaagaattttttaatatgaaaaatatttgcagtgattttaaagtgcttttccagcaatgttcttagggactcctgagacacggttactttatctactggatcagtaaggcacacaattaacaattaacaattaatgtttatttacaaagtaaagggaaaacctgtgtaacatgagaatttggcatgacaaaatggagaccattttgtatctgctgttgtatcttgtccgggttgcagacgtgcactattaaagtcccaagttaatagagcacaaacccttctcgctcctcccccatgtgccccctctttttagatgtgtataacttaaactcgatggctcaggaaaattccactaattagaatcatgtacagtaccccaggtcgttgtccagatatacaagtttgctaatgtagttaagcctggattattaaacacttttcctaaattattgtaaacagaacagcttagagaaaggtattctcagtccttaatattgtatagtagtttatgagcccctctctaaatattggtatttttatattccagagatgtacccaatagaaaaaattaaaaattaatcagtatctaatttaatatccataagtatttttccttagattttagtcacgtacagtgggctatgtggatgtcacttgtgcttcaccatagtttaccactaggtgtcactgtggctctgcactgcgcttgttttgtagcaaagaacagcggcatcccctcgggagagaggagctgcttccagggcaacaggcaagcgggctcagaggttcaggagaaggcaacagaggcctggaaggggtcttcgtgcatctgtgccagttgtgcaagacgaactctttgaacactacatgctttggacttcagccaggcagaggctggaagaaggttgaccagagctcccttgctctggtagagggatgggtacatggagaagccccttcttccccatgagcctccctcctgtcagttcctctcagcctccagcttttataactccagaagcgtcacagttgggtggtttgattcagagagagttatttttctactgcagaaatgccttggacaaaaccagtgctcactgaatctttgccacaaaatggaataggctatcccagggggcaagaggtgcccgcccctgtgcccagcctcctcttgatgctcccagtgcccagcagcctcgcacaccctgcctgtctgttcctgggctgcccatttctcaagaaaccgacctgcaaaggcagccggctgctgcttccacaccgagggctgtgcggtcctgctgctcgctcactgggaggtgcagctctttctcctcttcctctaggaattccagaccgaccatctaccatgactaacaacaatgaacaaagggcttaggggcaagagctacctgcaaagacgtgtcatggaacccttcaccatgcaatgccttgaactcagctctggctgctcccaagaaaaggtggctggctgggggctggacacaagcacaatggggctggtggagccactgtgcagagctacttgaataatcactgggttttcatcaactccttttgtcatacagaccactcaagggctgaagtgttggtaaccttcatttcggtgtccaaagcctcacagcaggtgagccaccctgagatgcttgtggccacatggtggccacagtcagagctttgaaagtcagtaccaaatgaacgcataattggacaccaaaaatcaagtgttactttcatgtttcctcaccccatcatctcattgcctcctgctgactctgataccgacgctgagctgacttgccaggctgccgctggacgcgtagagatcaggccagcgccgcgctcatttttccaggtagacctactctgtggaacggaagtgccctagctgctttgtttttgtagcacttgctggctgaatttttcttttgctaatcgctaaccagaaagtctggttagagggggctcaactcaatccctttggtccccagcgccagacaagagttaattctggaaaattcagtacttgaatgtacctgccttattgcataccaatttactggggggaaaaaaaaagttaagagatgccggctccagatctccacttcattcacaggtgattttggaaatcctgtaagttacacttcctgttctggttttgttttgttttttgtttcctttggctgattcctgctgagtgaggccagttcctcatcaggctcagggcaggtgccttttcaggcgtggcctcctttccatctagcacagcatctttgtctctgttctgtctcctccaaatccaagatgattttaattagtacagacatgtacagtctacaattaaagagtgatttgtactaatatgattttgattcttcctcctctttgctgtcctttcaagacacttgctggaaaaagctttaatgcacttagttttcctttaggttttctatgactcagatgtaaaggactttctctgtacagtatattatccaatgcatgtttgttctctctcctgatatattgaacaccacacagttgtgaagccgtgcagtgggatgccccacaccccacagaggcatctacccctgtgtataaggaaagacattttcctttgctgtacttgcttgagcagttttattgtctgtacatgtgagctgtgtgagatagatgtgaaaagttcaaatgaatgcattttcctgccccatgtatacagattgtcatctgtacaaggaactgtatgtatgaaagcaaatgtacttatttataaatggctaacacttggaaaacca

SEQ ID NO: 7816 - DNA, 521 bp, Homo sapiens
aaggtagctcggactctacctgtggctcaggcataccaggacaacctgtacaggcagctgtcccgagactctcggcaagggcagacatcccctatcaaaccaaagagaccgttcgtggagtctaatgtttaaaagacgttttgttggagtgagacccatatgttttcactgcacattttcaggcttggtttccacattcgaggtagttctctggcttaatttctcatgtagtttctgtgtggtgttcagaggtggcagcccacatgctgaaatcctttgcatgcagccgactgggaagcggcctcccgggagccaggacttcagtttctcttgtctgtgcccagccacatgctctctccctctcttcagatgccaacgaggagattttcgtgctgtgtgctttaacccagggagatcagacacactggtcagctttttccaggagacaatcgctttcactgatgttcttgttgtgtaattgtctttttccttttttaaaaaataaggtgttcttgttcgtt

SEQ ID NO: 7817 - DNA, 4269 bp, Homo sapiens
  misc_feature (727)..(727): n equals a,t,g, or c
  misc_feature (1178)..(1178): n equals a,t,g, or c
  misc_feature (1216)..(1216): n equals a,t,g, or c
gccaagtcccttatcactggcacttgatttcctactgggctagaaccttaagctgtttggtgaaagaagggcacagaagtcacacaaagagagcaacagatgcttgcacagcagctcacactgccctgggacagctccagtaaagagcagtcctgtgttcaggtcctaccttctagagcaggatctaacacaggacaccagttgaatagcttatgctctagataagtacagttcttggtatatagctagtgttccagaaatattagttgcatgaatgaatgacaggtttaggctgtaagaccagcatcagaccatggagtgcctggatacaactacatttctatggccaattaaaaaaataatcctgggattggagtagtagagctaagcctagggacttgaaagttagtccagaggatcccaacagctggacacaaactcaggaagactcaagagccatacaacagcaatgcagcaaccaataatcaccgttattattaagagcagtttctagtacagagcgcctcagggcacttacaatccccacagaggccagctacccaacatcagagtctgaccagctgggtggtcctgccctgcatccgagagggtgtcgggacactcatccagatggctctgagacagcagcagagctgacaaggaggccccacaagtgagattcctttggcttcaaggtcgcaagtcctgtccttgggcctcctggctngctgagcctcccaccggctttaccctcagagattgctgcagaagcctgtgtgctggaatgggctgccacatttctaggaaggaacccgggggcacatgtagcctggttattcaatgttatcatagacgtgaatcacatcctcgtggttgctgagagcctgaatgagatgtgcggcctgttccaggtcgggctcagccagctgcacctttgagttggggatgaactctagtgcacaggacacagaacacaggcccagggagtccagcttcttcctcacttggtgcagtgaagaggcatcacaaataaactagggataaaggaaagtcaggaggtgaggagccaggaggtaatgagacaaagccacacaggaccttgcaaagtcctgaatgtcagtactggaatggatcactgggtttgagctcttcactggcagggacatcgttttcaatgnttttgactctttctttctcatagtcctcactagagtcnggtcctattcagtattcacttaataaatgtttgtacaatatgtgaactgtctcacctataccctggggcacatgaaggaagaaaccaagaggcatgcataaggcatctatcagggtcctcccggaagcccaccaaacacccatgttttcatgcttactttaaaaacgttcctttcttcttcatcttcagtttccttgacatcctcagctcctgcttcgattgccatctccagggcacgctctaggttcacagccttcttctctctgtcctccacttcaaccacaatcaccccctttttgtcaaaagagtgacgagctcctacagccatcactcctctgacagggaaggaaacaggctggcatgagtggatgcctctagaagctcagcctccataaagctcatcattctatcactgtctctttcttacccagtctatgaagtacacacagacatggagcagatcgcatcctcaaggagaaaatgcagctgctgctgggtaagggaacagcccaagaatgtccccacgctcgattttctgccctgattgcagttgggaggaagcagacttagctgataatttcctgtgccattaagatgccagtcctggtggagcattttaagacttaggcattatatggctacagatggggataataggacaaagatccccttctacatccgatgaacaagtctttgggatcctgctagtagaaactacattaagggaaagtcaattaactcattagattctgctaaggagcaagtgtgcttaaaacctgaaacatggccaggcatggtggctcccagcactttgggaggctgaggcaggtggatcacctgagatcaggagttcgagaccagtctggccaacatgatgaaaccctgtcacctctactaaaaatacaaaaattagctgggcatggctgtgggtatctttaatcccagctactcaggaggctgaggcaggagaatcacttgaacccagaaagcagaggttgcagtgagccaagatcatgccattgcactccagcctgggcgacaagagtgagactccgtctcaaaaaacaaaaaaacaaaaaacaaaaccctgaaacactagcagagatcaacagtacttgccttgcagagaattggaacataaaggctctgtcccctaccactcctcccagacgcacacttacccattcttattcaggatatgtctaatgtctgcttggcacttgtggctactgttagataatgcctcgatgagcagagaagagccaccagggcctcgaccctcatacagcaaataagtgtccttggatttctgcaataaacaacacaagcacattttcctgtttcccaattccttcccacatgtcagcccagaactacaagtatcgcaaaactaactccatgggatgggctctctaggctggagcctgagctctcaatctttatttttgtccccaccctctaaccaacttttgaggtaacaggaagtactacccctaacttggaaggagtctgtttctccggtccctgaacaatccatcagccatctctcagctttgcttcctaccatccctaaccaaatgccacatctagtccctacccaatcccactcagactcatcctcctacacccccatcctgtaagaaacccaccggtcaagtctcaaggtccctaccctgggctgctgagtactgctgtgaaatatcacacacctaggccttgtcgtaagagctgctgaaaacagcatggtctcaaaattgaaacaattaatccagagctctagggactaatctcttctggaccttccatgcccctactcatcccttgtccatgtattcaatattccccactccaagcaccctgtcctgcaactttccaggaattctcaactcataacttctcccttcctctttcacaaaggtaaaaagggccactaggtggggaaaatagttgctgtctccaccaccttctctgcaccatggcctacatgaaggcaataagcataacggttagagcacaggctctaaagtctgactatctggtttcaagtctgtcattttctatgcgacttgagtcaactcacctaacattcctgtgcctcagtttctacttacggtggttttgaggattcgatgagataacacacatagagtttttatccatgcttagcctgcaggaagcactcaataattttgagctattaagataactattacttcctcagagcctccctacctgccccagagaaaggtgtacccttacgtggactctatatacctgcccctcccaccatctctatcacccccatcctctccctttctactggcttttctcctttagggcataaacatctgaaaaacaaacacttcctccacctaacgtaagggctttctcccacactgccccttctttctataatacctcatctccctacaacttggctgagcagtcccggtcttgactgtatggccctgcatactgcctatgcatcctactcccagttgtgctcctagaaccaatgaccaaggacggtgagctctcagaagactctaggctgagggcgtcaactacattgctaccgttctctctgataatttttttttttttttttgagacagagtctcgctctgtcgcccaggctggagtgcagtggtgcaatctcggctcaccgcaatctctacctcctgggttcaagcgatcctccacctcagcctccccagtagctgggattacaagcatatgccaccacgcccagctaatttttgtatttttagtagagatggagtttcaccatgctggccaggctggtctccaaactcctggcctcaagtgatccacccaccttagcctcccaaagtgctgggattatagtcgtgagccactgcacttggcccctctgataatttacagtgtgtttgttggccatccagacatgagcccggtagaggctgtgatcaataaaaagcatgtcaaacagtacacacctccattttcagtgctgtctcaatcgttgacttgggcatatgtttgctgcgacacacctctaagatattggc

SEQ ID NO: 7818 - DNA, 521 bp, Homo sapiens; identical to SEQ ID NO: 7816

SEQ ID NO: 7819 - DNA, 6439 bp, Homo sapiens
ccgattttttggagaccacacatcaaacctcagtatatttggatgcaaatatcgctacctcccagagagacctcatttaaggagattagtgcgagggtcagtctgtggtgagtgtctgacatacttatgggtgtcttccctgggaattaagtagtgaaaatagaacttggaaatgtgcagccatggtaattcagagcacctgccatgtgcccagtgttcagaggaggatattctctcaccctttaagaataaaatttaaaacttaaattttgttaccaggacactacttatatgagcaagtagtaattttgtttgaaaaagcagcttattaatcacacgcagaaatctgaagttatttgcctcttaaatttctgaaaccctgtcgtaagccacttaacaagaggggcagtgtcatgtatatttttgtaatggacaatatccagcagcaggtcgtacacatatcctccactcattcatggaggacctgcaatacagtacagcatggagcgtagcctaggaaggcaggggaaaaaatctaccttttagagccctgtaatagagttccattatgtctatataagtgataagttgcatatatttttcattgttttaattattaataggtaacagttaatataataagtatcaaatgccctcagtgcatacaaacccaagtttaattatccaagtgaaaatgcttttgtggattgactttttaccccctcttcctcaacaacacatagtagcctcatacacaaccccttcccacactggtacacaagtatgcaaatagaaacacagacacctgcccataaacaaatcaccctggccaaatgccactgcctttgggtaatgcagggttcttcggcggaatatttcttcttctgctcctctggaatgtattccattccctgctgctctggaatgtaaccatgtgagatttcttcccctttttcatcacatggatgtctgttagaattccttttctggccgtgtttctcatgtgtaggcaatactttttatcatcttccacatttccgttttccttcctacttttgcctagttgctttatgaaaatctttatatctctccttagcccttggtcacttcatgactgttgtgaaccattttcctccttagaagcatatgatacctgatcagaacaaagctgatgttagtgatagatttctatcaggtaaaagatagaacatgtatacgcaaatgcactttcacatatggaaaccaatgccgtcattttctaaaatctatgtgatctctataaaaatattcttcctgaggttaatggaacataattttccacagccaatagcattcaatagtcaagactgcttttaatgattttccagtgcgtgccgcttcttaatttgcaaatatggtggatgttataattatataaccaatatgtatgtattagttaaacagatattggagggataactagggaatctaaccttaacctctaataccatgagaaaatcaattgcaaattaagttctgagatagaagctgtttgcaaatctgtatatggagagagcaacatgaaaacacaaaatcactgtattttttgcattgttattttattttctacttcagtgccacctttaatttggtcgtggcagtgtgtttccgtccattctttattttaaatagagaagtcatttatttggctcatggttctggaggctgagcagtccaagatgtagtggctgcatctggtgagggcctttgtgctgcaccatagcatggcagaagggccagcaagcccacgagacacagaaaatgggagccaaacttacccttttgtcaggaacccactcccttgataactaacacgctcctatgatagtggtattaatccagtcataagggctctgctctcaagatctaatcacctcttaaaggcccaacctcccaacctcctttttggcctgtcttttgtgtgtgcaggcgcatgtgtgcaaataaaatcacatcaggttaagcttgtcaaagtagggagcagctggctttaagataaactctctcatccacacatattttccccaccccaagcacagctgcctcttaactgctgttggaccataactccaagtgaagtggtcctccctcccccatctccacaaatagcaggaaaagtaatgttgtaatttacaaagttacttactccctgccatttcagagagaagatggagtataggaaagccctcccacccactgtccttgtgtgatgtgacacaacttgctccctcagtcttggaatacagcctcatgtggtccttggccagaggcagagaaagggccttcatctctctcacagctgaagggtgggaaacatggtcttcattccgtgtaaccacgtgctcagctagagatcagaggttctgctcataaattataaaggagaagagagatttggggatgattagcagcctctgacataggggcatctcccccagtgaggcgtgggcagattattaaaggaatggtactgggaataaaagtggctgaggataaattttaaattctcatattacttcttacaaaaattctaagttttaaatcaagtcgtataatttttaagaataggtcttcaattgatttctagatggcaaataatttatataaacaaaaacaatggagccttctccaaaaatgaatactcaattaaaaaaaaaaaaaaagacaagcctggagccagaattgaagaaatacaaatagccaatacatatgttcaaaaatattcagtgttactagctgtcagagaaatgtaaattggcagtctcaaaatgagatactttgagtattattaacttgataagacatctgctaactattgattagcaaatgttttatcaagttaatacttaatattggactttcatacttaatgaattgaaattttgtacaattcttttgcaaagaaatttgatactaatgtgaaggccattttaaaacatgataaatctagataaactgaaaatgggttatgtgcaagtataatttaaaatagggaaaagaaacaaaaaattaagtataggaatatttaaataaaatacgatatatggatatgatagcaattaaaaatgatgttttagagcaatgttactaacctaggaataagagatagtatgcctagtcccttaaaacagtttcaaaagtagatgtaaacatgttttgaacatggattacataattggaataagtttatttcctatctcgttccttcaattctgtgatatttgagaggaaaaagaaaatcaatgctgttactttttagttatgttttattactattaggaaaatatactgataattatttaaaaaggaaatatgaatgaacagactgagctatgtgcataggagaaaaacacattcttttaaaatatatgtgcttatatattctaaactcttaagcatcactttaagagtgtactaaacgtaattattcaatgggacttattacttacttggattctgtcattggcaaaaaatataaataaaacccatatctagacatggtgctaatggaatggagatctttttaaattagatatttaaaacagtgttgtatacatgtctggtcatctggttccaaagatcatttcttaagaataaaaaagttagtatgttttgacaaacttccaacaaatggctgtattagtttcttttttagtgtaattgattattctaaattactgtcctttaatttatagaatgatattgctgtttcatccttaaattgccttgtgagtctactgcaaagtttctctctttctcatctcttattgcatttgagttgtgcggccctgaagctgtgtcacatgccgtaaggtttaaaatacaataacaacatgtatttactaacctcttttttgtgcctgtgtctttcaaagtcagtgggattctgatgttggactctgctatgtatacttatggctagagtttatcatcactgcttagtgattcatttagaaaagaaaatgctggctgataccacttgacatccttaccagcactttgcctttttattttataagtgcttcctttttcaattcgttaaaatgattcacttgagtaactttcaacgtactaggtatttattcatagttttctctaacatcttgaaacgtcccatttttagttcagtctgttaggcgttcatattattagttttctttggacccaggatgtaaataaaccacttctttagatgtgggcttggacagaagccctctgtaggacctaccagctctccatgttatgaggtaacaagattttctcctaccaactcaaaatgtgccacttctttcttaatcttttagcattgcgaacattgaaaatggaaaggatcttaaggaaaagcacaaagatgaactgtcctggtagaatacagtaagccagttgctttggaatgtttttggttagaaaggataagtgatttatgtttgatgcatgtgctcaggactttggtgaagttactaaacttacatgtgtatatctgttctatacctaatcctgatacatttcttagatatatacagccttaagtgtaatcagactacttaaaaaataatatacactgtggtatttaaaaagcatcactgtaattatttggtaggttagttttaagactccttaaataattttgccttttgttttccagctggaaaattattcattgcacctctaattatggttttgggattggcactaggggccatagcggttgtaatcggtaagaaacacttcatgcatctgagattagaattatctgagggccatagagagaatacgagtgtaaatgtaataatatgaatcagttattaagtggacataatttatgttgtatgcctgctttagatagattaccagcatatcatttaaaaggtcagaggagcgtgtttcctgtaggatatgttagtatgaatttttcagtctatgaacactgtgattcatgtaccttataaagcattattaacccttttataacacaaagctaatagaattagtatccttagggaaaaaggcaagtggaatagaacccaaattttctaattctgagttcaggttgaagcatcaaggaaaagaagctctgcaccttatgtgtttcatttggtccagtaaaagatgccataggtacaaacagataatgtcagtgtgtacaggaacatatacccaacatacacttgagcactgacaaatagaaaaccttgcagtgatttgcatagttttatttatgcaagtatattaaaatgtgtattttaaagcagtggttctcagactctagcatgctttagaatatcctcaagggctggataaaacacacattgctggtttcggtctgcagtttctgactcggtatatgggaaaagtccattgatttttatttttaaaaagttcccaggtgatgctcatgcagctggttcagggaccatactttgagaactattgctttagtaattttaagctaaatgctatagataaaggctgctttgatcattgttccatatattagatggggtttttttgctaaataaaatgattttcgtatgtcaacttgggtttagcaagtaataaatgtgcaggacagatagaattataaagtatctgacatttaagttcttgcaatgtgagttaggacattatgtaatagatattattatctgtattatacagttgaggaaattaagacttactggaacctcataagtggtagaaccaggaatcaaacccaacatttggctccacagcctgtgttgttaagtgatatgctatactgcctgaaacaagtgtgagtatcatagtgtgcaaatgatatgactgtggacaataaagaagatttaaaccaaagttttgatatttggatagaaatcattattattaaactggtatcactgagggtgctaaaggggagaaaagctaaagggaaatattaaagaatgaaatattgaagaagtaaatacatttcatagcatagatgtcttcttctttgtatgttcgtacactgcaaataaataaacatagacattttaaaataggaaaacctaaatgcctctcatcctaactaactttaattttttcttatccctaggtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataa

SEQ ID NO: 7820 - DNA, 6439 bp, Homo sapiens
ccgattttttggagaccacacatcaaacctcagtatatttggatgcaaatatcgctacctcccagagagacctcatttaaggagattagtgcgagggtcagtctgtggtgagtgtctgacatacttatgggtgtcttccctgggaattaagtagtgaaaatagaacttggaaatgtgcagccatggtaattcagagcacctgccatgtgcccagtgttcagaggaggatattctctcaccctttaagaataaaatttaaaacttaaattttgttaccaggacactacttatatgagcaagtagtaattttgtttgaaaaagcagcttattaatcacacgcagaaatctgaagttatttgcctcttaaatttctgaaaccctgtcgtaagccacttaacaagaggggcagtgtcatgtatatttttgtaatggacaatatccagcagcaggtcgtacacatatcctccactcattcacggaggacctgcaatacagtacagcatggagcgtagcctaggaaggcaggggaaaaaatctaccttttagagccctgtaatagagttccattatgtctatataagtgataagttgcatatatttttcattgttttaattattaataggtaacagttaatataataagtatcaaatgccctcagtgcatacaaacccaagtttaattatccaagtgaaaatgcttttgtggattgactttttaccccctcttcctcaacaacacatagtagcctcatacacaaccccttcccacactggtacacaagtatgcaaatagaaacacagacacctgcccataaacaaatcaccctggccaaatgccactgcctttgggtaatgcagggttcttcggcggaatatttcttcttctgctcctctggaatgtattccattccctgctgctctggaatgtaaccatgtgagatttcttcccctttttcatcacatggatgtctgttagaattccttttctggccgtgtttctcatgtgtaggcaatactttttatcatcttccacatttccgttttccttcctacttttgcctagttgctttatgaaaatctttatatctctccttagcccttggtcacttcatgactgttgtgaaccattttccttcttagaagcatatgatacctgatcagaacaaagctgatgttagtgatagatttctatcaggtaaaagatagaacatgtatacgcaaatgcactttcacatatggaaaccaatgccgtcattttctaaaatctatgtgatctctataaaaatattcttcctgaggttaatggaacataattttccacagccaatagcattcaatagtcaagactgcttttaatgattttccagtgcgtgccgcttcttaatttgcaaatatggtggatgttataattatataaccaatatgtatgtattagttaaacagatattggagggataactagggaatctaaccttaacctctaataccatgagaaaatcaattgcaaattaagttctgagatagaagctgtttgcaaatctgtatatggagagagcaacatgaaaacacaaaatcactgtattttttgcattgttattttattttctacttcagtgccacctttaatttggtcgtggcagtgtgtttccgtccattctttattttaaatagagaagtcatttatttggcttatggttctggaggctgagcagtccaagatgtagtggctgcatctggtgagggcctttgtgctgcaccatagcatggcagaagggccagcaagcccacgagacagagaaaatgggagccaaacttacccttttgtcaggaacccactcccttgataactaacacgctcctatgatagtggtattaatccagtcataagggctctgctctcaagatctaatcacctcttaaaggcccaacctcccaacctcctttttggcctgtcttttgtgtgtgcaggcgcatgtgtgcaaataaaatcacatcaggttaagcttgtcaaagtagggagcagctggctttaagataaactctctcatccacacatattttccccaccccaagcacagctgcctcttaactgctgttggaccataactccaagtgaagtggtcctccctcccccatctccacaaatagcaggaaaagtaatgttgtaatttacaaagttacttactccctgccatttcagagagaagatggagtataggaaagccctcccacccactgtccttgtgtgatgtgacacaacttgctccctcagtcttggaatacagcctcatgtggtccttggccagaggcagagaaagggccttcatctctctcacagctgaagggtgggaaacatggtcttcattccgtgtaaccacgtgctcagctagagatcagaggttctgctcataaattataaaggagaagagagatttggggatgattagcagcctctgacataggggcatctcccccagtgaggcgtgggcagattattaaaggaatggtactgggaataaaagtggctgaggataaattttaaattctcatattacttcttacaaaaattctaagtttcaaatcaagtcgtataatttttaagaataggtcttcaattgatttctagatggcaaataatttatataaacaaaaacaatggagccttctccaaaaatgaatactcaattaaaaaaaaaaaaaaagacaagcctggagccagaattgaagaaatacaaatagccaatacatatgttcaaaaatattcagtgttactagctgtcagagaaatgtaaattggcagtctcaaaatgagatactttgagtattattaacttgataagacatctgctaactattgattagcaaatgttttatcaagttaatacttaatattggactttcatacttaatgaattgaaattttgtacaattcttttgcaaagaaatttgatactaatgtgaaggccattttaaaacatgataaatctagataaactgaaaatgggttatgtgcaagtataatttaaaatagggaaaagaagcaaaaaattaagtataggaatatttaaataaaatacgatatatggatatgatagcaattaaaaatgatgttttagagcaatgttactaacctaggtataagagatagtatgcctagtcccttaaaacagtttcaaaagtagatgtaaacatgttttgaacatggattacataattggaataagtttatttcctatctcgttccttcaattctgtgatatttgagaggaaaaagaaaatcaatgctgttactttttagttatgttttattactattaggaaaatatactgataattatttaaaaaggaaatatgaatgaacagactgagctatgtgcataggagaaaaacacattcttttaaaatatatgtgcttatatattctaaactcttaagcatcactttaagagtgtactaaacgtaattattcaatgggacttattacttacttggattctgtcattggcaaaaaatataaataaaacccatatctagacatggtgctaatggaatggagatctttttaaattagatatttaaaacagtgttgtatacatgtctggtcatctggttccaaagatcatttcttaagaataaaaaagttagtatgttttgacaaacttccaataaatggctgtattagtttcttttttagtgtaattgattattctaaattactgtcctttaatttatagaatgatattgctgtttcatccttaaattgccttgtgagtctactgcaaagtttctctctttctcatctcttattgcatttgagttgtgcggccctgaagctgtgtcacatgccgtaaggtttaaaatacaataacaacatgtatttactaacctcttttttgtgcctgtgtctttcaaagtcagtgggattctgatgttggactctgctatgtatacttatggctagagtttatcatcactgcttagtgattcatttagaaaagaaaatgctggctgataccacttgacatccttaccagcactttgcctttttattttataagtgcttcctttttcaattcgttaaaatgattcacttgagtaactttcaacgtactaggtatttattcatagttttctctaacatcttgaaacgtcccatttttagttcagtctgttaggcgttcatattattagttttctttggacccaggatgtaaataaaccacttctttagatgtgggcttggacagaagccctctgtaggacctaccagctctccatgttatgaggtaacaagattttctcctaccaactcaaaatgtgccacttctttcttaatcttttagcattgcgaacattgaaaatggaaaggatcttaaggaaaagcacaaagatgaactgtcctggtagaatacagtaagccagttgctttggaatgtttttggttagaaaggataagtgatttatgtttgatgcatgtgctcaggactttggtgaagttactaaacttacatgtgtatatctgttctatacctaatcctgatacatttcttagatatatacagccttaagtgtaatcagactacttaaaaaataatatacactgtggtatttaaaaagcatcactgtaattatttggtaggttagttttaagactccttaaataattttgccttttgttttccagctggaaaattattcattgcacctctaattatggttttgggattggcactaggggccatagcggttgtaatcggtaagaaacacttcatgcatctgagattagaattatctgagggccatagagagaatatgagtgtaaatgtaataatatgaatcagttattaagtggacataatttatgttgtatgcctgctttagatagattaccagcatatcatttaaaaggtcagaggagcgtgtttcctgtaggatatgttagtatgaatttttcagtctatgaacactgtgattcatgtatcttataaagcattattaacccttttataacacaaagctaatagaattagtatccttagggaaaaaggcaagtggaatagaacccaaattttctaattctgagttcaggttgaagcatcaaggaaaagaagttctgcaccttatgtgtttcatttggtccagtaaaagatgccataggtacaaacagataatgtcagtgtgtacaggaacatatacccaacatacacttgagcactgacaaatagaaaaccttgcagtgatttgcatagttttatttatgcaagtatattaaaatgtgtattttaaagcagtggttctcagactctagcatgctttagaatatcctcaagggctggataaaacacacattgctggtttcggtctgcagtttctgactcggtatatgggaaaagtccattgatttttatttttaaaaagttcccaggtgatgctcatgcagctggttcagggaccatactttgagaactattgctttagtaattttaagctaaatgctatagataaaggctgctttgatcattgttccatatattagatggggtttttttgctaaataaaatgattttcgtatgtcaacttgggtttagcaagtaataaatgtgcaggacagatagaattataaagtatctgacatttaagttcttgcaatgtgagttaggacattatgtaatagatattattatctgtattatacagttgaggaaattaagacttactggaacctcataagtggtagaaccaggaatcaaacccaacatttggctccacagcctgtgttgttaagtgatatgctatactgcctgaaacaagtgtgagtatcatagtgtgcaaatgatatgactgtggacaataaagaagatttaaaccaaagttttgatatttggatagaaatcattattattaaactggtatcactgagggtgctaaaggggagaaaagctaaagggaaatattaaagaatgaaatactgaagaagtaaatacatttcatagcatagatgtcttcttctttgtatgtttgtacattgcaaataaataaacatagacattttaaaataggaaaacctaaatgcctctcatcctaactaactttaattttttcttatccctaggtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataa

SEQ ID NO: 7821 - DNA, 535 bp, Homo sapiens
gacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaatattaagttactgaagtgtatatgcgtaggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatgtagacaacaggccatttcg

SEQ ID NO: 7822 - DNA, 535 bp, Homo sapiens; identical to SEQ ID NO: 7821

SEQ ID NO: 7823 - DNA, 2026 bp, Homo sapiens
ggaatttgactggggagggatgtacagtgagcatcagttgttacctatgatcagggaaggatccaggttttgtggggcctgatgcttaaggtgtgtgtgtgtgtgtgtgtgtgtgtgtgtgtgggagttaccctctaaaaaaaggactttacaataaatctgcctctcactggttattgtaagagtgtatgtgatgcactgagaagtcatttctgaagatacgtggggcgctctttgtagagaagtgaaaataacattcactatgacaatagctaacatttatcgagcccttaccatatgccaggcactcgggcaagcatttgcaggcttttctcattgattcctcacaatcagcctaggatacagatgctgcctattagtctcattttatggctgaggaagcagaggctcagaggggttaagtcatttgcccaaggccacacagctagtatatgatagagtcagggttcaagcatatggagcaaaacaggacttgtttcctatggtttaagcattccctacatagtgatctctcactgtcataattacatgcctactatgttctcttcagtaaagatctcttatttttagttgactagaggaagggcaatatgagcagaaaatttttcttgttttggggatgaggtctcactctttttccaaggctggagtgtagttgtgcaatcatagctcagtgtagcctggaattcttggactcaagcaatcctgctgcttcatcctcccaagtagctggaactacaagtgtgcaccatcacatctaactaatttttgtagagatggggtctggctatattgcccaagctgatctgaagctcctggcttcaagcaatcctcctgccttggcctcccaaactgttgggattacagtgtgagcctggaaaatatttgctaaaatattaaaaaataaagttttatttcttcccacttcacgaaggttatatttggaattaagacagtgtgttctttaatagtatttttcatagtaattgatttgatgagtaggcaagaatgatttgtgataagttaaatgtcttagataagtgtatgattaaaaaatagctcatccgggtgtggtggctcatgcttgtaatctcagaactttgggaggccgaggtgggcggatcacttgaggtaagtagttcgagaccagtctggccaacatggtgaaacccatctctactaagaagataaaaattagctgggcatggcacctgtagtcccagctactcaggaggctgaggcaggagaggcaagagaatcacttgaacccgggaggcagaggttgcagtgagccgagatcacaccactgcactccagcgtgagcgacagagcaagactctatctcaaaacaacaacaacaacaaaaacctcttgaaaattcttactactttatctgttggctgaactaatgccaagctcccatcatgaataatcaagaatttcaacctgatgacttcttggtaataataaagttcaatggggttcttctcatatggagtgtacataaaacactgtgagggcccagaacagcaaaacgtgcttaaaggtggacatgggatctgcttcagggtatctgctgaggttaggactctgtgtgcctgtgggcataaacatgtggacataccttcctttggatcctgaaatggccaattccacagtagggggaaaggaggaaggacagctgtgtttgaatctatcatttcttgagacagcttgcattaaaagtcaaaccaagaaaacccaaatggccacttggctttctgtggtgtttgggaaggcagtttgaggagtggtctgtgaagtccctgggcaggagggctcgggctgagggctcagctgtggcacccccagatgactgctgaggtcatgaaggagctcatagcaccattcatgtttctggactcagtcattgtgcctggggtccccatagcaaggaaagtagggaagtgaaccaaggtccagccagtgttgctcttggctgcagggaaggaaaaaaaaaaaaaaa

SEQ ID NO: 7824 - DNA, 98 bp, Homo sapiens
cgggtggatcacttgaggtcaggagttcgagaccagcctggccaacatggcgaaaccccatctctactaaaaatacaaaaatttgccaggcaaggagg

SEQ ID NO: 7825 - DNA, 209 bp, Homo sapiens
ctggaggccctgtgtggggatgctggggtagggatcccaggaaatgagttgaggggtaggtgaggtggggagggttgtaatggctagagcaggggtgttcaatcttttggcttccctgagccacattggaagaagaataattgtcttgggccacacataaaatacagtaacactaatgacagctgatgagcaaataagcaaattgcaaa

SEQ ID NO: 7826 - DNA, 15413 bp, Homo sapiens
ctggagtctggaaaaccacgcgggaggaggttgtggggatatggacgagcatccgaggcccccgggtgcgtacggctgcgcatgagtgggctgtaatcgggtgtctgggggtgagtgactgcgttcgtgcgatgcgcgcggggagcagctgtcactttgcccaccctgctccggggcaaggtctctggcgccaggatcttctgggtgggtgggagcagcgcccctcccctccgatctgggcccgcccccaatgcagagcccgcccctccctctgggtacagctaataacctctaattagtgcacattaccccgcccgtctaccggggaggggttgcagagggaccctggggtcacagggcgcgagcctgggcttcacccttcccctcaaaacccggtccactcggaacctctgttttctcgccggcaaagcagggaattaaaacagcacttgccatctggagacatggggaggattcaatagtctatgtatttaaatcgcttagcgcaaggactgcatacagtaagcactccatacatggtgactgcaatttattgttaactataattcccatcactttccattgacccccgctccaccgccccagccggggtttcagggcgggcgcacagtcttccccctaggccgcgttctgcggtctccgcgccccctggtgggcccgggcgacgcggcagcttcagccaaatcctgggttctgaggtgggggtgatgccgggcgcgcatctggggagggcaaggcgcggggggaatatcgtggaagacggatccaggctgggcaagggtgcctatccatcagccaggacatgtgtgtctaactgacctcttctcgacctaggaccatacccgtgtccccttatctactgctggagtcaataatgcagggaggatccattcatttatttatttcttgaaacagggtctcccccctgacgtccaggctggagtgcagtggcgcgaccacggctcactgcagcgttgacctcccggactcaagcgatcctcccacctcagcctctggagtagctgggaataggcgcgtgccaccacgcccagctacttttattttttattttatttttgtagagacggagtctcgctgtgttgccagggctgttctcgaactcctgggttcaagcagtcctccctcctcgacctcccaaagtgctgggattacagatgtgaaccatcgcgccaggcattttattttattttattttattttatttattttttttgagacagtctcactctgtcgcccaggctggagtgcagtggcgcgatctcggctcactgcaacctccgcctcttgggttcaagctattctcctgcctcaacctcccgagtagctgggactacaggcgcgtgccaccatgcccggctaattttttgtatttttagtagagaaggggtttcaccgtgttagccaggatggtctcgatctcctgacctcgtgatccgcctgcctaggcctcccaaagtgctgggatacagacgtgagccgccgcgcccggccctatttttaaatttttactgtttttttttgagacagagtcttgctctgtcacccagactggagtgtagtggccctatcacggctcactgcagtctcgacctcctgggctcaagctatcctcccacctcagcctctgtagagctaggagctaggaccacagaaacacgccaacatgtctggctaatttttttttttttttttttgaggagtcttgcactgttgccccctggagtgcagtggtacgatctcggctgactgcaacctccgcctccagggttcaagcgattctcctgcctcagcctcccgagtagctgaaatcaggcgtgcgccaccacgcccagctaatttttagtatttttagtagagacggggtttcaccatgttggccaggctggtctcgaacacctgacctcgtgatccgcccgcctcggcctcccaaagtgctgggattacaggtgtgagccaccgctacctggagtaatttttaaattttttgaagagaggctggtctccaacttctatccaaattaattctccctcctaggcctcccaaaatactgggattacagtcgagagccaccgcgtcggcgggaaaacccctttagcatcccctctcccagtccatagaaagtgccagggctcgcccctccccgcacaacggctccgattataaagtggttagacacaagaatttacttaaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaagaatttacttaagttgcagggaaaagacgtgaatgcgcttgtgtaacaggggtggagcacctccgtctcaaaaggatcttgaggacctcccaccccaaaaagggccagggcgaggatgggaggtgggaccaccctcggatgcacaaggctgggccaggctgacccctagcggcagggcgggcgcccgaacggtgcccggatccaagatggcggggctggaggcaagagcgggcgtagggaggagattacgttccgaggcggagcctgggcttgggggcggggcggggcctgcgcctaggggggcggggcggggcggcgctctaggccgagcgggaggtcggggctgcgggcgctcgctggtggcggacccggaggctgctgcggcgccggggctccgtggcctggattgaatccgatcgggagccatgagcgtggacaaagctgagctatgcgggtctctgctcacctgggtaggtcgtggggcggggctaggggaaggtgagcgcccgctcctcttgcccgggatccctggccctggttcggtcagtctcttggtgctggggctgggaggtgcggggtcgtcgacttgctggaccgttggactctggcccgagcacccgcccccgtcacgtggcaagtctgcgtggaaaggacaggtgaggccccgcccctctgtggttggttcacgtggggcgaggacacaggtgaattggcctggtcacgtggtgcctgtggggcccaggtgactcgcgataccaccctggcctggacgcgcagggtttgttgggcagaggtgaggtgaggccacgccccctccggtctcaggtgagcagaagccagtccctcgcagagctgctgtggcggagcagcgcccgccccaccatgtgaggttcgctgactggaaaagtctgcaaaaggggagcggttcggcgctcccaggccctaactctttccttgtcctttcctttacccctcagttacagacgttccacgttccgtctccctgtgccagccctcaggacctgagcagcggccttgccgtagcctatgtgctgaaccagatgtgagtggagctgaaggggaggatcccaaaagtgtcccccagtctgctcatcccaccttctcgcccccagagacccctcctggttcaacgaggcatggctccagggcatctcggaagatccaggtcccaactggaagctgaaggtgacaagtggactcctgattagaggacagactggtgaagagatgaccagggacgggccagctaggcacatgtcctgggtgatgggcaggaagagggacagatgtctggtgatcaaccatttgttcatccattcatctatggagtactcaccctgtgccaggcctgggcattcagcaaggaataacacagacaaaaacctgccccacacagccatcattctagtgacaagcaacacatacacaaccataaaaattaacttccaggctgggcgcagtggctcatgcctgtaatcccaacactttgagaggctaaagtgggtggatcacctggggccaggagttcaagaccagcctggccaacaagttgaaaccccatctctactaaaaatacaaaaattagctgggtggggtggtgtgcacctgtaatcccagttacttgggaggctgagacatgagaatcacttgaacctgggaggtggaggatgcagtgagctgagattgagccattgcactccagcctgggcaacagagcgagactcttgtctcaagaagaagaaaaaaagaaaaagaaaaagaaaaagaaaaaacttttgatgccagtagttctgtgaagacaacaaaaaagcagggctttgagagagagcaatgagggcataggtggctgattacatcagatgggttaatctccaagtgaaatttgggggaacggtgttccaggcatagggaatagcagatgtaaaggccgtgatttgggaataaacttggtgtgatggaggaatggcagagagggcagaacagagcaagagggcaagatttgtaggagatgaggtcatcaggggcctggcaggccatggtgggggtgtggattctatttttaagtgctgtggaaagtcaaggcagggttttagcagagcaaagatgcaacctggcttgggctttataaagctccccctggctgcatggagagaaataaaatgtaggcagcaaaagtggaagaggagaggcagctggtgcactaatccaggtgagaggtaaagatggatgggtagggctgaaggatggtggggcaggtggtgagaagtgacttggttctggagacatatgaaggaagatggtcaggcaggccgggcacagtggctcatgcctgtaatcccagcaattttagaggctgaggtgggaggattgcttgagctcaggagcttgagaccagcctgggctacatagcaaaacctcctctctacaaataaaaaaaagtagtcgattgtggtggcatatgcctgtagtcccagctactgggaggcagagataggaggattgcttgaccccaggaggtcgaggctgcagtgagccaagattgcaccactgcactccagcctgggtgacagagccagaccctgtcttaaaaagctaaagcaaaaaaaaaaaaaaaaaaaaaaagaaacaaagatggtcaggcagacaaaaggggcagacagccagacaggtcacccctagaggaaggcgcacgcagacagaataggatgagatgagcagggaaggagaagtgaggtggagagaggatgggacctacagattcagagtgggaggcctctgaacttgtccacagttccttgttcctccctaggtcagcaatctgaagatggtcttacggagcctagtagagtactcccaggatgtgagtaactgtaaagggattcagggggttgagttgggagaagggtgggcccatgagcccctgacacccccttctccccaggtcctggcgcatcctgtgtcagaagagcatctcccagatgtgagcctcattggagagttctcagacccggcagagctcggcaagctgcttcagctggtgctgggctgtgccatcagttgcgagaaaaagcagggtatggggagcttagggggtccccagggctggcctgaggaaatcctccttcctccccacctcacccctgggtctcagcctcccccaccttgatccccagaccacatccagagaatcatgacgctggaagaatcggttcagcatgtggtgatggaagccatccaagaggtgggtgggggcactcagtgtgcaattggaaaatgtcaggagaggggacatctctagggcagagagaactgggcacaggtcctgccctggtaaggtctggactctgcctggaactcagctggccagacatctctgtctcatgtgtctgccagctcctcccagctctaagtcgcaatctagcaggctcaagggatctggcttccctctgtgttggaggcacggagggcagcctctgggctggggttattgggcagaactggccttgacgggaggatggagaggttctcaggttggatagtagatactttgaaggctggcctcagatatccagttcattacaatgccccttcccactcctcagctcatgaccaaagacactcctgactccctgtcaccagagacgtatggcaactttgacagccaggtaagagatttgggggaaaggtgttccaggcacagggatcagcaaatccaaaggccgggagttggggataagtttgctgtgattaaccttgtgacttaaccttgttaaaggtccagaccccacttacagatgctcagggtagcctaagggggaggggcttgtccttaagcctgtaagccacgcccatcttccagggtgctagccacttcctgtaccaggtctccagtgttctggaatcgctcttccttcagtctccaaccccagccctgttttcttttcttttctttttcttttttttttttttttttgagatggagtctcactctgtcacccaggctggagtgcagtggcacgatctcggctcactgcaacctccgcctcccgggttcaagcgattctcctgcctcagcctcccgagtagccaggactacaggcacacgccaccacacccggctaatttttgtgtttttagtagagaaggggttcgccacgttgggcaggctggtctggaactcctgatctcaggtaacccacccgcctcagcctcccaaagtgctgggattataggcgcgagccactgcacccggcgccagccctcttttcaatcctgagggtttcttggccccctccatttggcctctagagatctcagcctccctccccccgtccttctcctgaatccctgagttcctcttccccctcatctctgcagtcccgcaggtactatttcctaagtgaggaggctgaggagggggacgaattacagcagcgctgtctggatctggagcggcaggtagggccctaggtggggcagggtcacttgagtagcccctctccaagcccaagctcatctttctgccctgcccgcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggtgtggtcagctggggactgggccaggcaagccaggggaccgggggagggcagccccctcatgtgctcttcccccaacacccccaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggtgagtggtgggttcctgggtccccatcacggggggcggggggtaaacctgtttccagagttcccctctgatgccatagcagctctgtaattttcatgtgcccagtgaacccccaatatgccccctggactccacagtgccaccctgagccctacagaacgcccaaggccacattgcactatcctgaattccaccatatcccctggaccccacactgccccccccttatcccacagtatgcttccaagaccccatagcatccctgtggccccccaaaacacaagaacctcccctacaatgctctgcagatcccactgcacagtttgggcttcataatgcccctggatcccatggtaccttctaggactccacaatgcaattactttgcacccccttttgactctactgtgccttctgtaaccacaaagggctccactgggcccctatagcatctctgtaatgcgaaggtactagtgcaccccccaattgcacttctaaggaccccgcaggtcctcttgtcccatacctcccccaatgactccaaggtatccttggcagatgctcagacctctctaggctccccatcactccccctataaccccaccctctgtgtccccacaattccaccccaggggatacctgattataaccctgggctaaccattgctgtaatgactctcaacagctccaggccctgattgacccctaaccctcaactttcatgaccccttcaccttgaacccaaaagcctcaggctgaacaacaccctgtgctccaagggccactccacatcccagctgacccctgatcagagctctcagccctcccccttccctcccactcccctaggcagtcttcggagcgtgctgggcagctggaggccacgctgaccagttgccggcgccgcttgggcgagctgagggagctgcggcggcaggtgcggcagctggaggaacgcaacgccggccacgcccgagcgcacgcgacaactggaggatgagctacgccgagcgggctccctgcgcgcccagctggaggcgcagcggcggcaggtgcggcgggggcggggttagggccggggccccgcccctggcagcaagtctctcaccgttggccagccctccgcccacccctgatcccctcccttatttgtacgtaggccacgctctccgggcctcttccctccacccacgctgctcttctgtctgggttagtaagcccagcctttcccttcccttaagtaccgctcctctaaattctttgatgcccgccgcttcaccatgctgcttgatttccttggggctacctaaccatgtaacaaaactcgtggtaaattgaaaatatcctaaaatgcataaaggccaggcctggtatcccagcgctttgggaggctgagccgggaggatcacttgagcccaggatttcgaggttgtagtgagctgtggctgcatcactgcattccagcctgggtgacagggtgagaccctgactcaaacaaaagaaaaagaccgggtgcggtggctcgcgcctgtaatcccagcactttgggaggccaaggcgggcaccccataactccttctgtaaccccacatcacttgaggccaggagtttgagaccatcctggccaacatagcaaaaccctgtctctacttaaaaatagaaaaattagtctgggcgtggtggctcactcctgtaatcccagcactttgggaggccgaggcgggtggatcccgaggtcaggagatcgagaccatcctggctaacacggtgaaaccccatctctactaaaaatacaaaaaattagccgggcgtggtggtgggcgcctgtagtcccagctactcgggaggctgaggcaggagaatggtgtgaacccgggaggcggagcttgcagtgagccgagatcgtgctactgcactccaggctgggcgacagagcaagactccgtctcgaaaaaaaaaaaaaaaaaaattagccgggctggtggcgcgcgcctgtaatcccagctacccagaaagctgaagcacgagaatagcttgaacctgggaggtggaagttgcagtaagccaagatcgcatcactgcactccagcctggttgagagagggagactgtctcaaaagaaaaaagtaaaagatattaaaaaaagaaaaagaaaaagagagctgggcgtggtgactcatgcctataatcccagcactttgagaggttgagatgggagatcgcttgaggccagcagttcgagaacaccctggtcaagatagcgagattccatctgttttcaaaaaataaaaatttttaaattttttttaaaaaagaaaatccattgaacatactttacctactgagcatcacagcctagcctagcctaccttaaacatgctcagaaaacttaccttagcctagtttggcaaaatcatctaccataaagcctattttataataaagcgttgactatataacgcaatttattgaagactaattcattgcaattgaaaaacagaatggttgtatgggttcctactattaacattcacagtcggctgggtgcaacggctcacacctgtaatcccagtgctttgggaggctgaagtgggaggactgcttgaggccaggagtttgagatcagccagggcaacagagggagaccctgtctctaaaaaaaacaagcaaaaacatacacagctgaaagcaccatagtaaagtcaaaaaaataataagtcaaagcatcctggatcggggaccatttgtactcagcccctgcccctgctcccagccctgctgtccttattcctcccctctctgtgttcaggtgcaggaactgcagggccagcggcaggaggaggccatgaaggccgagaaatggctatttgaatgccgcaacctggaggaaaagtatgagtcggtgacaaaggagaaggaggtgaggctgaggttccactgcccaagccccaccctgccaattctggggtagcccatttcccaggaggccgagcctgacccgtggagtgtcttgtaccctgtccctgcagcggcctgttggcggagcgggactccttgcgggaggccaatgaggagctgcgctgcgcccagctgcagccgcgggggttgacccaggccggtgagatgaagccccatcccggggtcttacctgtcctggtgtactgtttgggtagaacaggttgtgtcccagtgcatgtctaggttggggacagagctaggccaggctggaggtgaccagaaagaggtgacacggtcaaattgaagagagaggctcagggtctcagggtggagcaaaggctaaaaagcttggccaaccctcccggttctctatcaagccggggatggagcttgtgtcaagccagactgttggctgaacttgaagccccaaaagatgatccttgggaagaagaccctaggggcggggacaggggatgcgaagagacctgaagacttttctcgcattcttcagatccctcactggatcccacctccacacccgtggataacttagccgcagagatcctgcctgcggagctcaggtatcctggggtcactcaaaactctggccccacccaggcttgccaaggcccgccctcagccccgctcccgccctcccatcttctgctagccccggttgcttggtctcagctccaggtgccagccgggctcctaggcccacttactcctgatttggctctgtccagccctaccagatgactttgcctctcaagggtctatccttagtacacaaattatgtccaacacctggctccagttcctgcacaaaaatcctatgccctagccccgctgactttgatcctttcccccagcgtccacccctgttagtgtaacctctgtgagtttcagtcccctgtgccctgccgggattaactctcccaccccgggccaggcacggtggatcatgcctctaagtcccagcactttggaaggccgaagctggaggatcacttgagcccaggagtttgagagcagcttgggcaacatagtggccctctctacaaaataaaaatgatttaaaaacccgaaaaacgaccgggcgcggtggctcacgcctgtaatcccagcacttcgggaggccaaggcgagcggatcacaaggtcaggagatcgagaccatcctggctaacacggtgaaaccccgtctctactaaaaatacaaaaaattagccgggtgtggtggcacgcacctgtagtcccagctactcgggaggttggggcaggagaatcgcttgaacctgggaggcagaggttgcagtgagccgagatcgcgccactgtattccagcctgggcgacagagcgagactccatctcaaacaaacaaaaagccaaaactaaccaaacaaacaaacaaaaaaaccccgaaaaactgtcccatcctagttcttcccatttctgcttcccgctttccagcagtcccatcccagctgttcgaatccactcttgtagctccgcccctgcctagccccacccactatcccagcttagagctccgtccactttaaccctgggccgggaacctgaacccgtagtaggtcctcggtgctccaaccccatggtctggctgggctcttccccagggctctgtcccgcccctagctccactctccctgagccccagcgagcctgcgaggtgactcgaccctggccctgctctctcctcccgggtctgcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggtgagcgcctggggacctacctgcgcggagcagggacagagggggccaaaagtgggcacaggcactaagcggccccccaccctcgcaggctgaaccagcagcagctatccgagctgcgggcccaggtggaggacctgcagaaagccctgcaggagcaggggggcaagactgaagatgtgagtgtcacccaccacctcccagcctggccctcccttgtgccccgaagtaaccctcctctctctcccatgctgcccgatgccccatacaggccattgtaagtaccatgggcccaggatggcaccccctaccctcaccctgggaaggaagaattagggcctctctggatcccccactcaccttgcctcttctctctcccagtccattttgctgaaaaggaagctggaggaacatttgtaagtcgcagaaagagggaactcctcgtgggggcatggatttgatattagtggggagtttcttaggcatgtgccaccatgcctggctgattttttatatttttagtagagacggggtttcactatgttggccaggctggtctcggactcctgaccccagatgatccacccgctttggcctcccaaagtgctgggattacaggcatgagccaccgcgcctggcctgctttcttttcttttacctgtctgctattgaagagatttgtattctagaaagatccctggctgctggatggagtgcttgagagtagaagaagctagcaagggaagatggtggctgaaccagcttgggagctgtgggatgggaagaagtggacagcaggggctgttccggggcatacctgctaagggtgcggagggttgtggctctgacagctgtggagccggtgggaccagggcacacagccccaggcatgaggggcaggcagagagggctctgtggccatgtaggggcatttctggctggcggggaggtctgtggctaccactgggacaaaagagaagccagcccggaggtcagcccactgctgctcatccccggcccacaggcagaagcttcatgaggcagatctggagttgcagaggaagcgggagtacattgaggagctggagccacccactgacagcagcagtaagtaggacctagtgaccagagggtggggagatcccagagcccagcagcgtggagctgatgggccacctcttccgccagcagcccggcggatcgaggagctgcagcataacttgcagaagaaggacgcggacttgcgggccatggaggagcgataccgccgctacgtggacaaggcccgcatggtgaggacgctgggtgttcccacaagttgcctgccctggcttcttactttttgtgcctcctattgagtcaaacctcctgcttgcacatctgtgcccccaactcatacctgtcataccccaccataagacagacttctgcatgattccccactgctactgattgtcacattaaaatactgcacagctggctgggtgccgtggctcatggctgtaatcccagcactttgggaggtcaaggcaggcggaacatgaggtcaggagtttgagaccagcctggccaacatggtgaaaccccatctctactaaaaatacaaaaattagctgggcatggtggtgggtgcctgtaatcccagctactcaggaggctgaggcaggaaaatcatttgaacccgggaggcggaggttgcagttagctgagattgtgccactgcgctccagcctaggcgacagggcaagagtccatctcaaaaaaaaaaaaaaaaaaaaaaaaaattacgcacagccaggcgcagtggctcacgccgctaatcccagcactttgggaggctgaagcagctgatcccttgaggtcaggagttcgagagcagcctggccaacatggcgaaaccccgtctctacgaaaaatagaaaaattaggcgggattggtaacatgcgcctgtaatcccagctactcgggaggctgaggcaggagaatcacttgaacccgggaggcaaaagttgcagtgagctgagagtgcgccacttcactccaggctgggcaacagagccagactccatcacaaaaataaaaataaaaataaagtaaaaataaagtactggctggatgggcacaatggctcatgcttgtaacctcaacactttgggaggctaaggcaggagaattgcttgatgccaggagttcaagaccatcctgggcaacatagggggactctgtctctataatgaatgaaagaatgaatgaatacacacaccccagtatgtcccagggggtttcaaggccaaagtcacctggctatgacttcctcaacctgtaggtcatgcagaccatggaacccaagcagcggccagctgcgggggcacctccagaactccattccctgaggacacagctccgagaacgggatgtccgcatccgacacctggaggtgggtgtcctcgtccctttacgctgcctccaacgtatctaggcccctgacacttgcctccttgacagatggactttgagaaaagccgaagtcagcgggagcaggaagaaaagctgctcatcagtgcctggtataatatggtaagtgtggggtctgggctctaagatctcatgggtagaatattggtgggggggtcctgtgagctcacctgaccccaaccacacctcctcctgaagggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgcc

SEQ ID NO: 7827 - DNA, 7443 bp, Homo sapiens
ctggagtctggaaaaccacgcgggaggaggttgtggggatatggacgagcatccgaggcccccgggtgcgtacggctgcgcatgagtgggctgtaatcgggtgtctgggggtgagtgactgcgttcgtgcgatgcgcgcggggagcagctgtcactttgcccaccctgctccggggcaaggtctctggcgccaggatcttctgggtgggtgggagcagcgcccctcccctccgatctgggcccgcccccaatgcagagcccgcccctccctctgggtacagctaataacctctaattagtgcacattaccccgcccgtctaccggggaggggttgcagagggaccctggggtcacagggcgcgagcctgggcttcacccttcccctcaaaacccggtccactcggaacctctgttttctcgccggcaaagcagggaattaaaacagcacttgccatctggagacatggggaggattcaatagtctatgtatttaaatcgcttagcgcaaggactgcatacagtaagcactccatacatggtgactgcaatttattgttaactataattcccatcactttccattgacccccgctccaccgccccagccggggtttcagggcgggcgcacagtcttccccctaggccgcgttctgcggtctccgcgccccctggtgggcccgggcgacgcggcagcttcagccaaatcctgggttctgaggtgggggtgatgccgggcgcgcatctggggagggcaaggcgcggggggaatatcgtggaagacggatccaggctgggcaagggtgcctatccatcagccaggacatgtgtgtctaactgacctcttctcgacctaggaccatacccgtgtccccttatctactgctggagtcaataatgcagggaggatccattcatttatttatttcttgaaacagggtctcccccctgacgtccaggctggagtgcagtggcgcgaccacggctcactgcagcgttgacctcccggactcaagcgatcctcccacctcagcctctggagtagctgggaataggcgcgtgccaccacgcccagctacttttattttttattttatttttgtagagacggagtctcgctgtgttgccagggctgttctcgaactcctgggttcaagcagtcctccctcctcgacctcccaaagtgctgggattacagatgtgaaccatcgcgccaggcattttattttattttattttatttattttttttgagacagtctcactctgtcgcccaggctggagtgcagtggcgcgatctcggctcactgcaacctccgcctcttgggttcaagctattctcctgcctcaacctcccgagtagctgggactacaggcgcgtgccaccatgcccggctaattttttgtatttttagtagagaaggggtttcaccgtgttagccaggatggtctcgatctcctgacctcgtgatccgcctgcctaggcctcccaaagtgctgggatacagacgtgagccgccgcgcccggccctatttttaaatttttactgtttttttttgagacagagtcttgctctgtcacccagactggagtgtagtggccctatcacggctcactgcagtctcgacctcctgggctcaagctatcctcccacctcagcctctgtagagctaggagctaggaccacagaaacacgccaacatgtctggctaattttttttttttttttttttgaggagtcttgcactgttgccccctggagtgcagtggtacgatctcggctgactgcaacctccgcctccagggttcaagcgattctcctgcctcagcctcccgagtagctgaaatcaggcgtgcgccaccacgcccagctaatttttagtatttttagtagagacggggtttcaccatgttggccaggctggtctcgaacacctgacctcgtgatccgcccgcctcggcctcccaaagtgctgggattacaggcgtgagccaccgctacctgggtaatttttaaattttttgaagagaggctggtctccaacttctatccaaattaattctccctcctaggcctcccaaaatactgggattacagtcgagagccaccgcgtccggcgggaaaacccctttagcatcccctctcccagtccatagaaagtgccagggctcgcccctccccgcacaacggctccgattataaagtggttagacacaagaatttacttaaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaagaatttacttaagttgcagggaaaagacgtgaatgcgcttgtgtaacagggtggagcacctccgtctcaaaaggatcttgaggacctcccaccccaaaaagggccagggcgaggatgggaggtgggaccaccctcggatgcacaaggctgggccaggctgacccctagcggcaggacgggcgcccgaacggtgcccggatccaagatggcggggctggaggcaagagcgggcgtagggaggagattacgttccgaggcggagcctgggcttgggggcggggcggggcctgcgcctaggggggcggggcggggcggcgctctaggccgagcgggaggtcggggctgcgggcgctcgctggtggcggacccggaggctgctgcggcgccggggctccgtggcctggattgaatccgatcgggagccatgagcgtggacaaagctgagctatgcgggtctctgctcacctgggtaggtcgtggggcggggctaggggaaggtgagcgcccgctcctcttgcccgggatccctggccctggttcggtcagtctcttggtgctggggctgggaggtgcggggtcgtcgacttgctggaccgttggactctggcccgagcacccgcccccgtcacgtggcaagtctgcgtggaaaggacaggtgaggccccgcccctctgtggttggttcacgtggggcgaggacacaggtgaattggcctggtcacgtggtgcctgtggggcccaggtgactcgcgataccaccctggcctggacgcgcagggtttgttgggcagaggtgaggtgaggccacgccccctccggtctcaggtgagcagaagccagtccctcgcagagctgctgtggcggagcagcgcccgccccaccatgtgaggttcgctgactggaaaagtctgcaaaaggggagcggttcggcgctcccaggccctaactctttccttgtcctttcctttacccctcagttacagacgttccacgttccgtctccctgtgccagccctcaggacctgagcagcggccttgccgtagcctatgtgctgaaccagatgtgagtggagctgaaggggaggatcccaaaagtgtcccccagtctgctcatcccaccttctcgcccccagagacccctcctggttcaacgaggcatggctccagggcatctcggaagatccaggtcccaactggaagctgaaggtgacaagtggactcctgattagaggacagactggtgaagagatgaccagggacgggccagctaggcacatgtcctgggtgatgggcaggaagagggacagatgtctggtgatcaaccatttgttcatccattcatctatggagtactcaccctgtgccaggcctgggcattcagcaaggaataacacagacaaaaacctgccccacacagccatcattctagtgacaagcaacacatacacaaccataaaaattaacttccaggctgggcgcagtggctcatgcctgtaatcccaacactttgagaggctaaagtgggtggatcacctggggccaggagttcaagaccagcctggccaacaagttgaaaccccatctctactaaaaatacaaaaattagctgggtggggtggtgtgcacctgtaatcccagttacttgggaggctgagacatgagaatcacttgaacctgggaggtggaggatgcagtgagctgagattgagccattgcactccagcctgggcaacagagcgagactcttgtctcaagaagaagaaaaaaagaaaaagaaaaagaaaaagaaaaaacttttgatgccagtagttctgtgaagacaacaaaaaagcagggctttgagagagagcaatgagggcataggtggctgattacatcagatgggttaatctccaagtgaaatttgggggaacggtgttccaggcatagggaatagcagatgtaaaggccgtgatttgggaataaacttggtgtgatggaggaatggcagagagggcagaacagagcaagagggcaagatttgtaggagatgaggtcatcaggggcctggcaggccatggtgggggtgtggattctatttttaagtgctgtggaaagtcaaggcagggttttagcagagcaaagatgcaacctggcttgggctttataaagctccccctggctgcatggagagaaataaaatgtaggcagcaaaagtggaagaggagaggcagctggtgcactaatccaggtgagaggtaaagatggatgggtagggctgaaggatggtggggcaggtggtgagaagtgacttggttctggagacatatgaaggaagatggtcaggcaggccgggcacagtggctcatgcctgtaatcccagcaattttagaggctgaggtgggaggattgcttgagctcaggagcttgagaccagcctgggctacatagcaaaacctcctctctacaaataaaaaaaagtagtcgattgtggtggcatatgcctgtagtcccagctactgggaggcagagataggaggattgcttgaccccaggaggtcgaggctgcagtgagccaagattgcaccactgcactccagcctgggtgacagagccagaccctgtcttaaaaagctaaagcaaaaaaaaaaaaaaaaaaaaaaagaaacaaagatggtcaggcagacaaaaggggcagacagccagacaggtcacccctagaggaaggcgcacgcagacagaataggatgagatgagcagggaaggagaagtgaggtggagagaggatgggacctacagattcagagtgggaggcctctgaacttgtccacagttccttgttcctccctaggtcagcaatctgaagatggtcttacggagcctagtagagtactcccaggatgtgagtaactgtaaagggattcagggggttgagttgggagaagggtgggcccatgagccctgacacccccttctccccaggtcctggcgcatcctgtgtcagaagagcatctcccagatgtgagcctcattggagagttctcagacccggcagagctcggcaagctgcttcagctggtgctgggctgtgccatcagttgcgagaaaaagcagggtatggggagcttagggggtccccagggctggcctgaggaaatcctccttcctccccacctcacccctgggtctcagcctcccccaccttgatccccagaccacatccagagaatcatgacgctggaagaatcggttcagcatgtggtgatggaagccatccaagaggtgggtgggggcactcagtgtgcaattggaaaatgtcaggagaggggacatctctagggcagagagaactgggcacaggtcctgccctggtaaggtctggactctgcctggaactcagctggccagacatctctgtctcatgtgtctgccagctcctcccagctctaagtcgcaatctagcaggctcaagggatctggcttccctctgtgttggaggcaggagggcagcctctgggctggggttattgggcagaactggccttgacgggaggatggagaggttctcaggttggatagtagatactttgaaggctggcctcagatatccagttcattacaatgccccttcccactcctcagctcatgaccaaagacactcctgactccctgtcaccagagacgtatggcaactttgacagccaggtaagagatttgggggaaaggtgttccaggcacagggatcagcaaatccaaaggccgggagttggggataagtttgctgtgattaaccttgtgacttaaccttgttaaaggtccagaccccacttacagatgctcagggtagcctaagggggaggggcttgtccttaagcctgtaagccacgcccatcttccagggtgctagccacttcctgtaccaggtctccagtgttctggaatcgctcttccttcagtctccaaccccagccctgttttcttttcttttctttttcttttttttttttttttttgagatggagtctcactctgtcacccaggctggagtgcagtggcacgatctcggctcactgcaacctccgcctcccgggttcaagcgattctcctgcctcagcctcccgagtagccaggactacaggcacacgccaccacacccggctaatttttgtgtttttagtagagaaggggttcgccacgttgggcaggctggtctggaactcctgatctcaggtaacccacccgcctcagcctcccaaagtgctgggattataggcgcgagccactgcacccggcgccagccctcttttcaatcctgagggtttcttggccccctccatttggcctctagagatctcagcctccctccccccgtccttctcctgaatccctgagttcctcttccccctcatctctgcagtcccgcaggtactatttcctaagtgaggaggctgaggagggggacgaattacagcagcgctgtctggatctggagcggcaggtagggccctaggtggggcagggtcacttgagtagcccctctccaagcccaagctcatctttctgccctgcccgcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggtgtggtcagctggggactgggccaggcaagccaggggaccgggggagggcagccccctcatgtgctcttcccccaacacccccaggctggagagtggcagggaggatgagcgcctgcgctgtgccgagctggagagggaggttgcggagctgcagcaccggaaccaggcgctgactagcctggcccaggaggcaca

SEQ ID NO: 7828 - DNA, 104 bp, Homo sapiens
ttttttttttttttttttttgagatggagtctcactctgtcgcccaggctggagtgcagtggcacgatcttggctcactgcagcctctgcctcctgggttcaag

SEQ ID NO: 7829 - DNA, 427 bp, Homo sapiens
tggcagaggggcactgttctccagttgtgggactgagggtccccttctcagccctgatgaagactggatccctgcccagatgtgaacgctggagggggcaggccggggtccagctgtggccacagggaggggttgagtcagccgcttcccagcagtacaacctaggctgggcccagctgttcctggaaaccagtagagggggtgggctccccaatccagctgggggctgctggcccagacctgcacaccagggctctgtgtccctacaaatggcggccttcagaccatcccccaaaacgttgggggctctctttacctaaaacaggggtttggatccttcttccaaaatgtggagggtttttcagcccctcttgctgaattaaaggtgcctggatctccgcacagcggggctccctgtgtttcaaaa

SEQ ID NO: 7830 - DNA, 427 bp, Homo sapiens; identical to SEQ ID NO: 7829

SEQ ID NO: 7831 - DNA, 2749 bp, Homo sapiens
agaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcatttttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgttttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 7832 - DNA, 4190 bp, Homo sapiens
gtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaacatatatctatatctatatatatagatacagatacagatacatatctggtggaacaagaaatacctgtaccattcccacttgctctttgatagccacctcctaggaatggagacaataaaactctgtatttgcatgtga

SEQ ID NO: 7833 - DNA, 4192 bp, Homo sapiens
gtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtga

SEQ ID NO: 7834 - DNA, 279 bp, Homo sapiens
ggggttcaagcgattatcctgcctcccgcatgaaatggggttttgccatgttggccaggcttgtctcgaactcctgacctcaggtgagccactgtgtccggccctgttgtggtatgttgaagtatataaagaaaatccaggttcacacggatacatatttttaaatggagaaatattggaatagccttttcagataattatggatattcttctttgatactgtacaaaatttggcaagtgatagttccttcaaagatagctgcagtgtggaatctgaaa

SEQ ID NO: 7835 - DNA, 972 bp, Homo sapiens
agaaggtggaggaaagttacaccattctttgccaaaggctggctggatcagccctcacagacaagcactcaggtatgtaaaagttgtgagttccagactctagactaatcatcctacactgaatgaaatgacttatcatactttgaagtgaaaaccttctgagattccatttctcttctgtctttaaagaactgcctgtttctaaacatcagatatcaagcggaagctcatgcctgctgactctactcttctctaagaggaactgcagttgtcagttcccataccatcccctcttctctctcttttcaccttttcaaagcagaaggcagagcagtgggaagcctggtaaatcacagattcggtgtgaggcttactggtactgctgtgactccctagtgtggaggatttggccttattggatgttggtgcacttgcctctgctgacagtgtggctggtgtctcccctgactgcagatggatttgtgttccctgcagcagtttatactcatctgcttacatactgattcagaaacaaagattgaaccacgcccacagatgtcatgggtattctttgcaatgttagtatattctttttcttaatatcatttccatgtatctttattcttctcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaa

SEQ ID NO: 7836 - DNA, 279 bp, Homo sapiens; identical to SEQ ID NO: 7834

SEQ ID NO: 7837 - DNA, 972 bp, Homo sapiens
agaaggtggaggaaagttacaccattctttgccaaaggctggctggatcagccctcacagacaagcactcaggtatgtaaaagttatgagttccagactctagactaatcatcctacactgaatgaaatgacttatcatactttgaagtgaaaaccttctgagattccatttctcttctgtctttaaagaactgcctgtttctaaacatcagatatcaagcggaagctcatgcctgctgactctactcttctctaagaggaactgcagttgtcagttcccataccatcccctcttctctctcttttcaccttttcaaagcagaaggcagagcagtgggaagcctggtaaatcacagattcggtgtgaggcttactggtactgctgtgactccctagtgtggaggatttggccttattggatgttggtgcacttgcctctgctgacagtgtggctggtgtctcccctgactgcagatggatttgtgttccctgcagcagtttatactcatctgcttacatactgattcagaaacaaagattgaaccacgcccacagatgtcatgggtattctttgcaatgttagtatattctttttcttaatatcatttccatgtatctttattcttctcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaa

SEQ ID NO: 7838 - DNA, 5850 bp, Homo sapiens
ccaccacctcatagcctaggcgcacaaagaagtccagctgctccttccagatggccagggaaccgccgacaccatggatgaaaaagagcaccacgtcggcctgggcgcctttgcagctagtgatgcgcttctcacagtcaatatggatggtcctcttggggcgcctggctcgccgccgccgcccaccactgccactgccgctgccgctgcctgcgctgccgggggccaagcggccatcgctgcccgccggatctgccagctccacctccagggcggccggcggctccccagagccattctgcccgtgtaggaggtcggctcgaggggctcggcccaggttttccaccagcaaccgcccattgcggtacacggtgatccggcgctgacagcggaccaagccggagaggtccccctgggctgcatccgaggatgcggatgatggtggaggtggggcagcggctggggcgggtcctgcatgcttcacccgcagcacgcggccgggcttgacctctacaaaggtgtagccatcgctggactcgacgctctccagtggccccacggcgttggggggcgtgcccagcaggcaacagaagataccgtcggtcaccccggtcagcatggtgtgtcctgtgagtgaggacagcagccagttcaggtgctgtctcaatgagaaccctgcaccgtgcagcaggcactccctgagccttgggagaactgttttagactccagtttggggagcgccagatcaagtgagccacggcactgagatttttttgtttgtgtgtgtgtgtgtgtgtgtgtgtgtgtgtgtttttgagacagtctcgctttgtcatccaggctggagggcagtggccggatttcggcttactgcaacctccccctcctgggttcaagcgattctcttgcctcagcctcctgagtagctgggattataggcaggtgccaccatgtctagctaatttttgtattttttgtagagatggggtttcaccatgttggccaggctggtcttgaactcctgacctcaaattttcctcctgcttcggcctcccaaagtgctgggattataggtgtgagccaccgtgcactgacatgttttgtctgagcagtgcctttgtggtagttaccctcctgggtcaccctagtctatcctcagagagaaagacttggctatggcttaccccacagggtgtccacagggaaggtggtggcgtcttgtgtggggatgttcctggagaaggggacattgtggcaaatgtggaccagccggaagacaccccctccccccagctggagtttataccatttatggcctcctaactcattcattcaggtatacactaactcatccattcaggtatacactaactcattcattcaggtatacactaactcactaactcatccaggtatgcactcactaactcacatatccccagggcctcctaaggcatctaaaatatgcaaatctttggtgagcccccagtgaggctcctggctctgaatttgactcctgaaaggtgaggccctaggagagggggatggggactgagccacagaaagccttgctcagctcccctagaccggggtgagccggggtctgtttcatagagggccaagctgaggcccagacactctgagaggaagctagactctgaacttcctccttggcaccctggattctggggatctgctatacaagtccccagaggtggcgaagaggatgggagaggcagggccctggctgggggcctccaagcctccatcccactccttgggccacccccgcccccgtgtccatggcaaccacaggcggttacataacctaagggggggatacccgagcagtgcacccccattgtcgaggtgtctagggcctggagatgggaccagctgcctgcctgccccctaccccaggttgggcgccgctaaggtaacgcacgcccgagactgagccgcagtggccccagacatactggaggggaagcaggccatgccccccacctcgagtggggccctaatcccggattgtggagggcaacgcacaggcgccaccccagccccgcttccccgcccccggcccccgccttccaggtgttcgtcatccctgcagcggggtcgagcccactggggctccgtggcttcctacgagcccaaacgcggggttggtggacaccactcctccgaagtggaggccccggggcttcgatctctccttttggggcccgttccccgctcacctcatcgagggccgcggggcccgggtcggggcggaggggtcccaggcggagaagccagcgtccgcctgctggcgccgtttacatggtggcgcggggtcaggccgggtgcgtctacgcgggcgggcacctgcccctggcggtcagcgcaggggcatcccgcggccgccgaaacagccggccctttaagttcctcccccgagtaggcggagccacgtgccgacgggcgggcacttcggcctatcgcagctgcggactgacctggcctagttaggagcccaatgagaggcggcaattccgtagtggaggcgggctctgggagcaacggccccgccccttttgggggttcaccgaggttgggggagggatggggcctggctcaaggcggagaagggggttgcagtctagggtctgcgggacgcctgggagtgtgcggccggggccctctctctgcaaatgggtctcccaagcccttgccccccagcccctgcctcccaattgccctgttcctctccaaacgaggcccccatactcttctctctgtattgacctttccattctagaagcagagactccaagatctttttccaatctccggtggggaaactgaggctcataaagggcacaagagcataaatcaagcaaggagcaaagctgggacttgaacccaaggctgtgtgattccaaaccctgggaaccattatttgctaacctcccccctacgccccccccttttcttttggtagggacgaggtctcgctatcttgcccagactggtctcgaactctgggcatcaagcaatcctctcgtctacggcctcccaaagggctgagatcactggcgtgagccatcgtgacgggcttctctaaagctttcaaggaaagtcttggagctgtgggtaattagagagtttgaatttcataatcagccgatttaacccatggctgccatggttctgagaagggctgatagcaagaggcaggcatcccagctctgtggtaccggcggggccatggtaggccctcaggagagctcaggtctcaaatccagcctctgccctttgctgatgtgtgacctcgggcaagttacttcactttcctgagcctccgtttatttctctatgaaattaatcctctcataagtttgctacgcaggtaaagcactcatcatagtgtcgtgcatataacaaatgctccatatattatgggcattattatagtggtgatgttttgctaaacgatgctacaggtaggatgggcttcggaggacgaggggttaaatgctccttgctgcttggccactcacatcccctggaatttgctgccagagctggattccgtccagacacctactcttgcccactaagggcacttctgggagactatacagtttattcatttagcaaacacctctctgcatgaaccccaagctggcacttgtagggatacagccccaggcccctggcccttgaggagcccttgaacttgggggagagtcaagggaaagcagtcgggccagaagaatggacagcggttgagagaagacgactccttttttttttgagaaaggatctcactccgttgcccaggctgcagtgcattggcgctatcattgctcactacagcctggatctcctgggttcagggaatcctcccacctcaccttcaagtacttgagactataggtggttgctaccatgtccccaggctggtctcaaactcctggccccaagggatcctccctcctcagcctcccaaaatgctggaattacaggcatgagccacacctcactcagcccttggagaggaaaggatttttaaagggcggataggggaacaccaggcagagaggagagtgtggctgaaatgtaagatggtgtgtgtagagggttttgcatgcctgatggaagggctgagcaggttttacctggggaaatggggagccaaggatagtgtgtgagtaggggaggggttcagatctgagtatcagaaaatttttcttccttttttttttttttttttttggttctaacaacagaggagaattcttctagggcccaaaatgggggcaagattgccaaagacaagcttgcaatccctgagtttacagattgagaaagcccagagtggcgcagggaccaccccaaggacacgcagcgagcttgaactcaggcctcctcggcttcctgccaagaggcggagacttggctgcagccaggacaagctgccagccagctgtgtgccatctgcccagctcccgctgggggcgggaagaccaaccagccgcttcctgcagctgccaccagctgcgcccggccaccgcggggcaccctctgccggtcaataggagagagaactacagctcagctgccagctgaccgcgggagataatgccttgtgcgcacgcgcttgctcagaaggcgccgttcgccggctacctgttggtgtgtatgcagagcatccctgtgccccgcggatatagactggcgcgcctctgttgcgcaggcgcagaactacaacttcagggttttccccaacggcctcttttttgcacgttaggagaaactacatttcccataatcctttgttccagggctggagcggctctgggctccggaatcgcccgcagccggtactgcgggacccactgcggatatggctgtcttggctggatccctgttgggccccacgagtaggtcggcagcgttgctgggtggcaggtaagtcctcagggggacccttccccaaatcagggaataagggcggcttcggaggctggcgccactcttcactgcccgcgtgacctgccagtgccttgcgcattttgcagccaggctctgtctccgggagccgaggctcagagaggttgagcgccaaggtcacccagcgccccgtctgacctttctcgccgtccctctacccacgcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcagaatgtatctctccaagatgagagctcattaaaagacaattacaaagcttatcacatccaaaagaattatcaataattttgaaatattattaaacgtgtaataaatgttcaaagttccacttgcctta

SEQ ID NO: 7839 - DNA, 124 bp, Homo sapiens
ctcccgagtagctgggattacaggcatgcgccaccacgcccggctaattttgtatttttagtagagatggggtttctccatgttggtcaggctggtctcgagctcccgacctcaggtgatccgc

SEQ ID NO: 7840 - DNA, 5097 bp, Homo sapiens
gtaattttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagatggggtttcaccatgttggtcgggctggtctcaaattcctgacctcaagtgatccatccgcctcggcctcccaaagtgctgggattacaggcctgagccactgcgcctggcctggtttgtttttgtttttgagatggagtctcattctgttgcccaggttggagtacagtgatgcaatctcagctcactgcaacctctgcctcctgggttcaactgattctccttcctcagcctcccgagtagctgggagtacaggcatgcaccaccacacctggctaatttttgtattttttagtagacacagggtttcagcatgttgctcaggctggtcgagaactcctgacctcaagtgatccacccaccttggcttcccaaagtgcggggattacaggcatgagccactgggctggcctgttttgtttttgtttttgagacaaggtttcgctgtcgcctaggctggagtggtgcggtggcgtaatcatagctccctgcagccttgacttcctgggctcaagagatcctcccacctcagccttctgaatagctgggactacaggcatgtgccaccatgctcagctaatttttaaaaatttttttataaagacagggtctccttatgttgcccaggctggtcttgaactcctgggctcaagtgatcctctggccttaacctcccaaagtgctgggattataggcgtgagccgtgacacccggcctggtgagggggttcatgtcctccccctacccagaaggcaggtccttggaagccaagattcttcccctggggtccatggacacctgaaggggtgagggatgagtgcggcctctcaaataccgtgaaagtgtgagtttgagtgttgaggatggaacttattttgaagagagaatctggatccagaagtttcaccagactttttattttaattgtttaaaatttttgtagagatgggggtctcactatgttgcccaggctggtcttgaacttctgggctcaagtgatccttccaccttggccttccaaagtgttaagattatagatatgagccactgtgcccggccctcatcagattcttcaagccaccatgacccaaaagcggtaagaattactcatcagcaagtggtaggaaagcaatctgattaaacaaatgcttccggctgcccaggggaggtcactgtttcctactatcccttccctttcaggatgttctgccacctgcctctgggcatgacatatctgtcttccttatacaagatggaaggcctgagaagcccccaaagctgagctcctcattcctacaaaagcaggggtcaacaaactatgtacggcctgtgggctagtcatttgcttttttaaatacagtttacacttttggagatttgaaaaatgtttcctaaataaggtttttttttttttttttgagatggagtcctgctctgttgcccacgctggagcacagtggcgcgatctcggctcactgcaacctccgcctcccgggttcaagtgattctcctgtctcagcctcccgagtagctgggattacaggcatctgccattatgcccggctaatttttgtatttttagtagagacggggtttcaccgtgttagtcaggctggtcttgaactcccgacctcaggtgatctgcccaccttggcctcccaaagtgctgggattagaggcgtgagccaccgtgcctggccaaaaaatgtttcctaaataaagttttatcagaagttccaacagtgactgtatggcctgcaaacctaaaatattcgctatccgatcctttaaggaaatgtttgccagcccctgctgtaatgaggaaaggatacagacaggagtcaggcagacctgattgtgtcagggacttcctgtatgcctttgggcaggttgcttcacctctctgagcttcagcctccacattcctgaagttgtaaatgtgctgacctaatagcactgttatggggtcatgggaactattgtaggtgggtgttttttttgtttttttgtttttttctcgagacagagtcttgctctgtcactcaggctggagtgcaatggtgcgatctcggctcactgcaacccccacctcatgggttcgaatgattatcctgcctcagcctcccaagtagctgggattataggcacctgcaaccatacccagctactttttgtatttttattagagacggggtttcaccattttggccaggctggtcttgaactcctgaccttgtgatccgcctgcctcggcctccaaaagttctgggattacaggtgtgaaccactgtgcccagcaggtgggtgctcatttaattagaggaatcatttctcataagcatcaacttttgagtatgttatataaagaaatataaacaaataagagctgttacctctcagtctagattcctttcttttagatacttatgtaacttctttgttttcttttcttttttttttttttttactttttagttttttgtagagatgagatcttgcttatgttgcccaggttggtcttgaactcctcagctatagcagtcctcccacctcagcttcccaaagtgttgggattataggtgtaagccaccacacctggccacttatttatttttcttttttctttttttttttttttgagatggagtctcactctgtcacccaggctggagtgcagtggcacaatctcggctcactgcaagctccacctcctgggtgcacgccattctcctgcctcagcctcctgagtagctgggactacaggcgcctgccaccatgcctggctaatttttttttgtattttttagtagagacggggtttcaccgtgttagccaggatggtcttgatctcctgacctcctgatccgcccgcctcggcctcccaaattgctgggattacaggtgtgagccaccacgcctggcctttttttcttgtctaattgcataggctagaatctctaaaacagtggtgctcaacttgcctggctgttcaatcttgcctttcttcctggataaaggagagaatgaggccacttggtagtggtcaagccctggggaccaagccttccatggaggggttcttggtaagttttaggttgtattacctgccctttaagcaggagtgaattacagtaacccatgcctttgtaaatgcctagaatttacaggattccgatgagcgcttcctgaatgcacagtgttctccagggcagttgattttttaacttagtctaaggcagtggttctcagctgggggtaattctgcccaccagggcacgcttggcaactactgaagacatttttgactgtcatgatcaacactagattgtgtagttgcatccagtgggcagaagccagggatgctactaaacatcctatagcccctcacagaaaaaaaataacctggccaaacacgatagtgctgggattgaacaacactgcttttttttttttttttttttttttgggcagagtctcactctgttgctcaggctggagtgcagtggtgtgatcttggctcactgcaacctctgcctcccaggttcaagtgattctcctgcctcacacccccgagtagctgggattacaggcacacaccatcatgcctggttaattttttgtacttttagtagagatggggtttcaccatgttggccaaactggtgttgaactcctgacctcaagtgatctgcctgctttggcttcctaaagtgctaggattacaggcgtaagccactgcacctggcctgagcaacactgctttagaacaatgtgaaacaatatcagtgatgacggaaatccctgtctgattacatatgctaatgggagttttcagcctggtatagcggctcatgcctgttaccccaccacatcgggaggccaaggagggaggatggcttgagcccaggagttcaagaccagcctgggcaacataatgagaccccccccccattctctatataatttttttttgaacttgaaaattggcctggtgcgttggctcacgcctgtaatcccagcgctttgggaggccgaggagggcgaatcacgaggtcaggagatcgagaccatcctggctaacacggtgaaaccccgtctgtactaaaaagacaaaaaattagccaggcatggtagcgggtgcctgtagtcccagctactagggaggctgaggcaggagaatggcatgaacctgggaggtggagcttgcagtgagccaggatcacgccactgcactccagcctgggggacagagtgagactccatctcaaaaaaaaaaaaaaaaaaaaaaattaaggctgagcacaatgactcacacctgtagtcctagcactttgggaggctgaggtgcaaggatcacttgagcccagtagttaaagaacatcttgggcaacatagtgagatgccatctctatttaaaagaaaaaaaaattttaaaaatgtaaaaattaaattgaaaaatgggatttttttcaaggagaaaaattaggatttttgtttgctttgttttgttttaggagataaggttttgccatgttgtccaaactcatctccaatgatccatccacaaagtgctgggattacaaatgtgcaccaccgcgcgtggtggccccttttttttttttcatgacggagtctccttctgtcgcccaggctggagtgcagtggcacaatatgatcttggctcactgcaagctccgtctcccgtgctcatgccattctcctgcctcagcctcccgagtagctgggactataggtgcccaccaccacacccagctaattttttgtatttttagtagagacagggtttcaccgtgttagccaggatggtctcaatcttctgacctcgtgatccgcccgcctcagcctcccaaagtgctgggattacaggc

SEQ ID NO: 7841 - DNA, 11799 bp, Homo sapiens
actcggcgggggaggggtcgtgtacattgtcccaccaggcgcaatgtagccgggcggcgcagaggatttcttttttggtcttgagagcatagagtcccttttcatattcacgtgtactcttaagaaagcgtctgttctccaaactggctttccattctccccgtcctaaatggtgcgtggctgacaccgtagtgttttcaaaactggatatggccaggatgctatagcattgtcagtgtaagtcccttttgggtatttttatttaattgtgtagtgacttgacagaagtgtttcccagcttgacctaagtaatgaatttgcataggatttcagcatcagtatggaagtgatcagatgtcagtggctggtgccaccttgcagataaatggccactggtccacgtagttcgtctttactatacattttgattaagttctctaggaccagctgactggtaattataagtcacatgaaaccctgcagagatgagagcttacattgaacacttcttaacaagttttctattctttgtttcatctgttacaattaaactcaccttcgtctagggtaagaccattactttacgcaataacatactagcttaatttacggtatttatatgtatttatatatattgtatatacataatcatacatataattctataacatttagtttgactctaaagttggaaaatcaggaaaataacaggtgatgttgagtactgattgtttgccgggcctgtgccaaatggtgtgcatgctttatgtaacttaatctaaaaaaatttgaatacgtgagtttgatttcagtgtgtccaaatgtgaaacgtgtacattattgttattgttttgttttttttgagacggggttttgctctcgttcaggctggagtgcaatggcactgtcttggctcactgcaacctccgcctcccgggttcaagcgattctccttccttagcctcccaggtagctgggattacaggcgcccgccaccacgcccagctaagttttgtatttttagtagagacggagtttcaccatgttggctaggctggtctcgaactccagacctcaggtgttccgcccgcctcggcctcccaaagtgctgggattacaggcgtgagccaccgcgccgggcaaacgtgtgcattaaatgcttgtttatgcctttgtaaaataagagtgttggcaatataaaatgttacccatagagtaaattaatgtgtttttcaagttggaagatggctttaaaaattcatagaagtacaattagtccctttatttaggtgctgaatagtttccaaagccccgtgtctcttatttatcagagtttctattatataacattgtcacccagtgaacaggctatgctaggacattggaaaaaggtaaatattgagaaagccctaatggtcctttcttaaatggccccctctttccatatttaatttctaagtgacattcctaattaagggtaaacaaacataatgaaacaaggctaattttccaataccaaactaaaaaaataaaaaacagtggactggctattactttgttgatgagtctagcacagttttactgggcatttaaatgttaaggatgttatttacattgtagctagttgtgaaagatttgtgtgtctaagtttttagtttgcctttaaatgtcttgaacatatgcttagtattgagtccagtactttgtgcattaatagtaagttttttgattggatttaattgaacagttttggcttccttaattttattttgaagatagaatttaatgatttgtgtaggcataacagttacaattaacagtgattccgagatgagcgtagggtttaacttaacagttcacattttcttgcgagttgaaaggactggagagttggatgtgtgtcttctttgtgattaaaaaagcatgctggaacttagctatcagaagattctggtggtccatctttgggaagaggaaaagattaagaatgctttgctagtcagtatttacaagagggtttctttacttaaaggcattttctctttggggaggggaggagttgagagttgtcattaatggaaggatcttagaataaaaaagatgtatacatgttttcctttggagtgaatttgtgactggagatggggtttcactgtgttagccaggatggtctcgatctcctgacctcgttatctgccctcctcagcctcccaaagtgctgggattacaggtgtgagccaccgtgtctggcctatgtgctttttaaagatggaactgatttagaatgcagtatattacagtacatgaaaaaattttggaatttctgtatgtttttcactgttggaaagccatagtgagtgtaataacagcattggctcctgttcataaggcatttaaatgatgtgtttcctatgacaggaagacaagcgtttctcattccttcaaaatttggctctcagatggagtgccctttaagctccctgaatgcagggacttcttctgtttcactcattgtcttttttctggggcctagaacagaacctggcaaactgagagtgctatgtaaacctttgtagaatgagcactttccctggggaatcctctctccactttccactagtgaagatcccacctgcttttaggtgcagggccactccagcctgactttctctgcaatctgcagcccacaatgattctttgaacattaactgtgtataccacactctgtgacagtgaatcttttatagctttatattgatacatgagtgtttcatgtattttgtttcctcacccaaaatataagctcttcaaggctacaggatatcctatttttgagaattgccttggtatccagtataatatataatattatataatacctataatatataatgtaatatatgtaatatataatatatataatatacatgtatatatacagagtaggtttatatttacctattaaatgaatgttacataccgtggggaaacatcaaagatactcaaaatggtaggttatattttagttaggcaaacctagtgtacacatgtgaaacagtactagaatttggagctaaataagagttaatacttatgtcgtgcttaaaatgtgaacctcacaacaatcctttgaagtaggtacaattatttcctcatttttcagaggaagaaatggagacacagcaaagtaattaagtttgttgctcaagatcgtaccggaaatcataagtaggcagtctggctccagaggcggtgtggtttctctggggagctttactttatacttcgaagggacatctaagcactacttttgcagctgtaagagatgctcttttaaaaatttcaaagtagcgtaagagattgcagtgtctctaaactgcagaaggaatgctggattttctatatagaggacattgataatggaatggttaaggggacattatatattgaaatgactaaagatggtggagagaaactgaagtttgaatctcaaagctgaggattatgattttttatagatactgaattctagaacagtgattcaccaggacataggacaatgattgcttgttactaatttagtatcaaaaaacttatgccaaataaaataatattgaatgacactggatatcttactgcatttctttttttaaacacttaccagatttgaagccctagtggtagtaatttaccttaatgtgggtattactaaaggtttcctatacacttctgtccatttgctttatctttttgtggaatctttttttttttttttttttttgagacagggtctcactctgtcgcccgggttagagtacagtagtgtgatctcactgcagcctctgcctcaagcaatcctcccacctcagcctccagagtagctgggactacaggcacgcaccactgtgctcagctaatttttaaattttgtgtaaagatgaggtctcactatactgcccaggctggtcttgaactcctgggctcaaacaaccctcctcctgcctcagcctcccaaagtgctgggtacgtcagtgagccattgtgcctggcctttttgtagaatcttttttttttttttagacagactccggctctgttgcccaggccggagtgcagcagcgcgatcttgcctcactgcagcccctgcctcccggattcaagcaattcttctgcctcagcctcccgaatagttgtgattacaggtgcttgccactacgcccagctaatttttctatttttagtagaagacggggtttcaccatgttggccaggctggtctcgaactcctgacctcaggtgatccacccaccttggcctcctaaagtgctgtgattacaggtgtgaaccactgtgcccaacctttttgtagaatcttgattcactttttcaggttgtattgagcaatagagaatgctgttggggtcaggaggtctcttcaaaccaagtaatactcctttggtggaaaaaaatgtaaaattgtgtgattgatttggtgacacacctggaataaagtcagtttgaagctgtttagaattagatgagggcctataaatttcagcaagatgaagaacagtggtatttctctgaaagtcccagtatgtctcccttttgttgggagctgacagtatgattttgggggcatcgggcatcaacagtcactgaatctaaatggctccacagataggggagtgtatacatcaccacaccagctgtccaggaattaggaggaagtgcccttgaatgaagcctgggctgcaagcctggttagcagccagggaggacacacacacgttgcaggtacagtattctgtattacacagattgtttctactgggaaggatatcatatcatttatcttgggggtagcttcagaatttgagtcagtgatgaaatgacttgctgctttcgttatgctcccttaagaagaacatcatatatttcgggatggcctgcataaaagaaacttgtaataatgaatattgacctataccttgtgttctgtttaagtatctgaggaagtaatttggaaaacttgagttaaaatagtctatattgtagtttttatccaatttgcacgttagccctaatcttcatttcagactcttccctgaatgggaaacttttagggaaagagagaatgatacactgattaatttattttcagcctacgaagctaggataatttaatgaaatctctaccagtcccatgttatgaattttagggttggagagctggattctggacgtgatctattctttaactaggaatgtacagcagaatgacccagggtttatcctgaaagtagcagatgtcttcacttaactcctgagacgcaaatttggtagagctgctgccacaggccccggacatcagtattaaaccatccttaagtgattctggtgccttttctccagtaagaagaaccagccctgtattttatatttaagaaaacctgggcaaacaaatgacttgcctagatttggttcagtggtaccaagatttagtcaccagataatacagtttcagaatcctatggctggaagaagtttaccaagtcatcaattcagtagttcatcttacagcggagtgtaaaccatgcttttcaattatttgcggttcttttactgtataccctgtgatgcccttttaagtttttttgaaaatattgtatacttaaaactgaagtgaaacattaaaatttcttattagaattatttttcagtcttagctgaaatacaatattgtatgaaaatttgcactgcattattagtttttttttttaatctagttgattttcaacttttcttttttaaaggcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgtgagtggactgcctggccaaatgactcatgaagatattcacggaagaatagtcaaaaaccaaagaaaaggcatattctagaagcaccttcaattccatcgaggatttttgagcagctgaagaagaaagttctgaaaatatgagtgacaggactccagcacattttttttagttgtttcttacattatctttgttaacccatccgcttttgtgtataatattaagttattttccactactgcaatggctagtaatttacttaggctcagagttttactctgtatggacagagaaataggaggtaacaacagtgggagaacaaataggaacagttcactgggatgttggtccccagaaattggctttcattgaataattcctaaagggtgtcgtgtgctgaattgctttttcatagtgatgtgctgcttcttgttcatactcttatgactttaatttcacctttatctactcccagcctctgtatatgcctacgtttttaaaaataatttttggcactgaagatctgattaccatattttttcagtttaaaaattaaatcctcgcaaatagatctttggtatagttgcattctaccctaggttattttctaggatcaagaatagaacaatttctgttctttccagcattactctttactattcatatgttcttgttcagtgttttgttgttctcatattctaggtggaaatgaagggtaatctctatgttctattttcagttttctaggaaaccagaaaaacatgggtagtagaaatgtatagaaaatgtatgaggtctcttaaccattgtgttaaacttgcattaagcttcttttttagcaatatcgatgtcagtgttacctcttctttcctttttatttattttttttgagacagagtctcattctgtcgcccagactggttggagtgcgatgatgcgatcgcggctaactgcaaccgctgcctcccaggtacaagtaattctcgtgccttgggctcccgagtagctgggatttttagtagagaacaggtttcaccatattggccaggctggtcttgaactcgcaacctcaggtgatccacccacctcagcctccccaaagtgttgggattacaggcatgagccaccatacctggccccttttgttgttttgaggggcaggcagtaagaagcagggatttcttcaaatgctagtaagcacaaagagagggagaagtttttgtaagtaacgaacagggccgggcatggtggcgtgagaggccgaggtgggcagatcacgaggtcaggagttcgagaccagcctgaccaacatagtgaaacccccgtctccactagaaatacaaaaattagccgggcatggtggtgcacgcctgtaatccagctagtcaggaggctgaggcaggagaatcgcttgaacctgggaggtggaggttgcagggagctgagatcacgccactgcactccagcctgggcgacagagtaaactcccgtctcaaaaaaaaaaaaaaaaaaaaaagaacagttgatcattaaggccattaatgtgcatggacagtttgttgcccaggttggagtgtgatgacgacgcaatctcggtaaatataaacctactctgtaacctccacctcctgggctcaagcagttctcgtgcttcagcctcccgagtagctgggatcacaggcatgcgccactaagcccagctaatttttgtatttttagtagagacggggtttcaccatgttggccaggctggtcttgaactcctggcctcaagtgatgcgcctgcctgggcctcccaaagtgctgggattacaggtgtgagccactgcacctggcccaataggcacatttttttaataagtagtttgttgattagaacgaagagcacttgccgtaagtgcatgtcattgttttcagctgttatggctaagtcagttaacctcatcaacaattttttcttctgtaaattgaggacaatttttgcttttatgaatgaagtcttaaccagcaggaagaaatataaacaaaggaacatatttttaatttaatgaagcaaaattccatacatcattttgaaaatagtgtttctttccctgataggcctgttctgcatcattcttttagcttccttctgccctgtttatcacttggtcccacttttatatttttcctcttcggtccagaatttcttatttagtttcttgtattttgcctactccctcccttctccatgattcagcctagtctttccgtcctctgtggacttgggtgtgccttcctctgggccacctcgtcttttgctgctgttagccctcccgcctgcgcacctgccacttcaccctcgcctgtggtccacttacgttccactcagcccggtcagtcctgctttgttcttctccaccgccttggtctcccgtgtgtcttatctagctctggttccttctcgtctccacatttattttgttttcttcctgtgcttgttagtccttgtgcacttggtccttgagctctttttctattaataggtattactagatggatttgttgtctgcctttacatagaacacacatccttactgtgcatttcctgggtagccaggatgaatcaattattattaacttcccttcgaacattgagcttcctctgttttctgtttctaagaattagattagtattctagaagactaatactactttaaagacagtcaaaacagtcatacgctgccatttcagccctttatttaagagtttgtgacatttatcactcccttgaaagattaaagaacacccaaagcaagtttggggtggaggtggggaaggcaggaagagaaaggtaagtgctataaaaggactcattgttaatttctagaaattggactgagatctgaaagcataagccttaacattttttagataaacggtccctgaaaagaataaaaagtatcagtacttccgttaactagctttagtattgggtcatttgtagtttacattctcctttaagttttaagaccttcagtagttaacaaagcagacagagactggccaggcacagtggctcacacctgtaataccagcactttgggaggctgagttgggtggatcacaaggtcaggagattgaaaccatcctggccaacatggtgaaaccccgtctctactaaaaatacaaaaaaaaaaaaaaattagccaggcgtggtggcaggcacctgtagtcccagctactcgggaggctggggcaggagaatttcttgaacccgggaggccgaggttgcagtgagctgagatcgcgccactgcactccagcctgggtgacagcgagactctgtctcaaaaagaaaaaaaaaaaaaaaagcagagacttaatcttgtaaatactcattttatttttgagaggcttaatgtctccttaaatattaacctgtgtcattttgtaattatactgtaatagtgtcagaatgccattaacaaccaacccttttcgtttcttgtgtgggaaagctcataaattgtgtggtcttacccctctggaccctgtagttgtagcattgtgaaaatggagcttttggcaaaactttgtattatgctgttgactcacattgtctcatatttttcctttattcttctatattctatgaatatggtgctgtcctgtcatttaattattataatatatgtgaactgctggaggtagactgatgtgagtgcagtttttcaacttaaaaacccttatatatcacattcatggtgtttaagatataagaacagccctacaaagaggggttgattgtattgaagattctttctgctgagcctgccttaattgtgagggtggttgtttgggtatcttagagctaaaagaatggctaagagtccattaatggtcctgtaatattcaccatccctgagcagttagtaaagaatggccgcaaagccacaattaggctactaacaaggaacttatgtagatgtgctaggtccagcctgtgttctggaactatagagatgaataaggtatggtcctttctctctggaggctcacagttgaatagggaatattaatacgtgaatgatagcagtacagtgtggcagatgctaaaatatatgtgtgtagcagctattacaggagaactgattaatagggagagtctggctgggctcagtgactcacccctgtaatcccagcactttgggaggccgaggcgggcagatcacttgaggtcaggagttcgagaccagcctggccaacatggtaaaacctcatctctactaaaaaatacaaagaaaattagcaaggcgtggtggcgggcatctgtaatcccagctactggggaggctgaagcaggagaatcccttgaacccgggaggtggaggttgcagtgagctgagatcatgccactgcactccagcctgggtgacagagtaagactgtctcaaaaacaaaacccaaaatactaaccatatttatagttagtcacctcaccctttttttagttaaaagaagtttatttagcctgatcagtttaccagatgtcttttttagtgacttttgtgtcttccataaatccattctcaaaatttgcaacagttgagcatatttgaccaaaatgtgccacaggtttctgaagcctgttcaagaagaagcatgtcaacattattggagtaggtcttcgcaatgactacttttgggaagatttgagtaaaatttatggatacagaagttttggagtatgttagaatattactaagtcttgttagtagttgtaatccccacactgggctatatagatgtaataccaacctgagtatagctcctgaagaatatctggtttggagacttggacaaagtgaacttttttgcttttttaaaagttgctgtttaaattaacttcctgcatttctaatgtagaaaaaatatggcacagtgatttgaattttgtttatggtttattatcttcctaaattatcagctctttaaaatatgggtctctggcctgtataccatctgataaattaggttgggtaaatttttcacctgaaaaaattcattcttttgacccaggttgtttggcttggaaaaaaaaaatcacatactcattgcatgattaaacttgtccatcagattgtgattttgtgcgttatgaggattgtagctggggtaattttaaaatgttggtatttggatagaactgccagcccaggattttgataaagatcaaaatatatactgtatctaaagtttcttttttaaaagttatttcacttataatcaaaaggtttaaataagtttagtgtatattttatgattagtattattttgtatcgattcagagagaggaaaactgcattcccatagacagggagacttggtgcattaatatccaaagcttagtttaagctggtgatgattagaaaagtggctttcatttgtgttctctggaagattctcagtagtcctgtgggcatgtgaacaagagcatgtgtaatcttcataatgtatgtcttgttagcagaaatgtctgaggcattgctgagatgtaggatgagctgaggtactggttttgtctttcatggttccctattatgttttttgagaaactgagcttttcctgacagtgtttagtttttcttggctatttactatgctattaatagtaacagtttccattatggagcctcagtaggttcttgacatacattaacccattgctattatgtaattttctaataaaatgatgtgataaaacatattttctgtaatatactcatagaatatgtgattataagtaaataaatagatgttggggtagtcctccaga

SEQ ID NO: 7842 - DNA, 3783 bp, Homo sapiens
  misc_feature (273)..(273): n equals a,t,g, or c
  misc_feature (522)..(522): n equals a,t,g, or c
tgagttggatgaagagaagaaaatccggcttcggttgcaggtgcgtccctttgggttctgctgcccgtgagtcctaggctcagtggggcaggacattgtgagggcttttatttcaaaaataaatgattgtcacctctctgcagatctggatacatttcctgtgaccatcttcttagaatcgtatgggcttactacatatcgtttccccaggaagtcttggggaagggaaacattaggaaatgtgccccaaattgggtttctcatttgggaatnatctttcttttttttttttttgttgagacagagtcactctgcacccaggctggagtgcagtggcaaattctcgggctcactgccacctctgcctcctgggttcaagtgattctcctgcctcagcctcccaagtagctgggactacaggtgcctgccacacacctggctaattttttgttttttaaaaaaacgggtttcactggttagccagaaggctctcatctcctgaccctaaggaaccttcctgcntcagcctcccaaagtgctgggattacaggtgtgagccacggcacccagccgtggaatttatcttaaacatctctgcgaaaagcccctctcccacctccatttccaagaggcctcattatatgtggtcactatggctccaggggccacagctgtccatgttcgggggcatttgctcttgatttctcagtgatggccatttctgtcctgccagggcgttagagctctgtcccctgtagcctctgattcaacactgctgttaccaaatggcagagaatgcgtgggagttctgattgaccgaaggtagactttcagctttcatccagttggcgcccttgtggtgatggggacccatgctgcttaacaaaggataggtagctgcttgccatcattttgggggtgctgacagacacccccttgagccaaccacagctgccttccaacactgccagatggccccgcctgttaggaccgcctgctctaccctctggctaagaaactggaattattgctgcttttgacaaactttgcagcctggcagcctgagaatcaaaatgtgcaccatttcctagtgcctcgtgtctgtgtgcctgttctgtgttgatgtcacttctggcattgctgttgattgtctattcagatgtcatgtcacctttaaaattgtcagattgattgttttctttcagtcgaccgggttgataatctttcagcttctataaaaccagccgattcattatgactttgttccattcttatttttctctttctagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaagggagggaaagttgtattatttcctgcactgggttacccgtgtgtgttatcgtttaaactgtattcacataatgtcatttgccttgctcacttgtaaccccttcctcaggtccaagagaatgggaggagggtcatgttgaagtgtagccactggaactttcttgcatttatggagttgctttttctttcccaaggaaactgatgtttgcctgtccgctttatctttgtagtacatgaacagttcagccttagactatgtaactgttttctcatccttagctgaaaatgaggggcctactgtattgcgagactgttcaggggtaggggtggagggggtggtcccttaatggcccctgaagatgttggatgtgtttctcaaaagctgctttgtctctttcctgagtttaatagtgaaactactaaacattaatagatttgcacagccacaaagaatgagagttgataataccgaagaagtgatgcaaaaacaaaaaatcacattactgatcattgatagtattacaaataaatgtctcttcctttctcttcctcccttcctccccctgccttcctcttaacctatgtgctcatccttgctacttgaggctgttatttccctccgagtatttaaggagcccaaacaccttggtcttcctgggtgggggcataattaagggaagggagtgtataaggaaggaaacctcataccctccattcccatccctggatatattgccttttcagcagcctcgggttcagtgtgcttggggtcaggagtgccaggttcccaagagcagcgtaaaacatccctgtaccccttgacagttataagcatttctgcgttaaacttgaagattccagagattccccacgacctaatgatctaagaatgcagattggattctttgatgttcaaatttctcatttacttatgaaaatccctaattatatagttttatataatgtgtatacagagtaggattgttgatgaaattgagcggttggaacaccctcatggaacactggcaacatggaatgtagagagctgatgtcttccccctcatagaggccattggcttcctttgtataaggagagggagaagtgattctggaaggagaagttggtatgtctagcttcattgcggcccctcgggctacccagcaagaggattctgcatcaaggaactggacgagccgctacccaaactgccaccatctttactctttacaaaatggacccatcgagaatgttgaaaagcttggaagtatcacttttgaaaaaaaaaaaaattattttgcattcagcatggactcgaccaggcatctatggagattatttttttgcttcattttataaagttgtatttagaaaagtcttaagtattgtgctttgtaaagaagatgattaaaatgaaattttgtgagaatagttttgttca

SEQ ID NO: 7843 - DNA, 3791 bp, Homo sapiens
tgagttggatgaagagaagaaaatccggcttcggttgcaggtgcgtccctttgggttctgctgcccgtgagtcctaggctcagtggggcaggacattgtgagggcttttatttcaaaaataaatgattgtcacctctctgcagatctggatacatttcctgtgaccatcttcttagaatcgtatgggcttactacatatcgtttccccaggaagtcttggggaagggaaacattaggaaatgtgccccaaattgggtttctcatttggaatttatctttttttttttttttttctttttgagacggagtctcgctctgtgacccaggctggagtgcactggcgccatcttggctcactgcaacctccgcctcccgggttcaagcgattctcctgcctcagactcccgattagctgggactacaggcatgtgcaccacacctggctaattttttgtatttttagtagagacggggtttcactgtgttagccaggatggtctcgatctcctgacctcaggtgatcctcctgcctcagcctcccaaagtgctgggattacaggtgtgagccacggcacccagcctggaatttatcttaaacatctctgcgaaaagcccctctcccacctccatttccaagaggcctcattatatgtggtcactatggctccaggggccacagctgtccatgttcgggggcatttgctcttgatttctcagtgatggccatttctgtcctgccagggcgttagagctctgtcccctgtagcctctgattcaacactgctgttaccaaatggcagagaatgcgtgggagttctgattgaccgaaggtagactttcagctttcatccagttggcgcccttgtggtgatggggacccatgctgcttaacaaaggataggtagctgcttgccatcattttgggggtgctgacagacacccccttgagccaaccacagctgccttccaacactgccagatggccccgcctgttaggaccgcctgctctaccctctggctaagaaactggaattattgctgcttttgacaaactttgcagcctggcagcctgagaatcaaaatgtgcaccatttcctagtgcctcgtgtctgtgtgcctgttctgtgttgatgtcacttctggcattgctgttgattgtctattcagatgtcatgtcacctttaaaattgtcagattgattgttttctttcagtcgaccgggttgataatctttcagcttctataaaaccagccgattcattatgactttgttccattcttatttttctctttctagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaagggagggaaagttgtattatttcctgcactgggttacccgtgtgtgttatcgtttaaactgtattcacataatgtcatttgccttgctcacttgtaaccccttcctcaggtccaagagaatgggaggagggtcatgttgaagtgtagccactggaactttcttgcatttatggagttgctttttctttcccaaggaaactgatgtttgcctgtccgctttatctttgtagtacatgaacagttcagccttagactatgtaactgttttctcatccttagctgaaaatgaggggcctactgtattgcgagactgttcaggggtaggggtggagggggtggtcccttaatggcccctgaagatgttggatgtgtttctcaaaagctgctttgtctctttcctgagtttaatagtgaaactactaaacattaatagatttgcacagccacaaagaatgagagttgataataccgaagaagtgatgcaaaaacaaaaaatcacattactgatcattgatagtattacaaataaatgtctcttcctttctcttcctcccttcctccccctgccttcctcttaacctatgtgctcatccttgctacttgaggctgttatttccctccgagtatttaaggagcccaaacaccttggtcttcctgggtgggggcataattaagggaagggagtgtataaggaaggaaacctcataccctccattcccatccctggatatattgccttttcagcagcctcgggttcagtgtgcttggggtcaggagtgccaggttcccaagagcagcgtaaaacatccctgtaccccttgacagttataagcatttctgcgttaaacttgaagattccagagattccccacgacctaatgatctaagaatgcagattggattctttgatgttcaaatttctcatttacttatgaaaatccctaattatatagttttatataatgtgtatacagagtaggattgttgatgaaattgagcggttggaacaccctcatggaacactggcaacatggaatgtagagagctgatgtcttccccctcatagaggccattggcttcctttgtataaggagagggagaagtgattctggaaggagaagttggtatgtctagcttcattgcggcccctcgggctacccagcaagaggattctgcatcaaggaactggacgagccgctacccaaactgccaccatctttactctttacaaaatggacccatcgagaatgttgaaaagcttggaagtatcacttttgaaaaaaaaaaaaattattttgcattcagcatggactcgaccaggcatctatggagattatttttttgcttcattttataaagttgtatttagaaaagtcttaagtattgtgctttgtaaagaagatgattaaaatgaaattttgtgagaatagttttgttca

SEQ ID NO: 7844 - DNA, 149 bp, Homo sapiens
ccaccatgcccagctaatttttgtatttttagtagagatggggtttcaccatgttggccaggctggtctcgaactcctgacctcaggtaatccgcccgcctcgacctcccaaagtgctgggattacaggcgtgagccaccgcacccggc

SEQ ID NO: 7845 - DNA, 404 bp, Homo sapiens
taataaaaataaataaataaataaataaaataaaggaaatatatatggagtggtaaaaacatctgcaataaaaattacaagaagagccaggcttagtggttcatgtctgtaatcctagcactttgggaggccaaggcaggaggattgctagagcccaggagttcaagaccagcctgggcaacatagtgagacccccatctctacaaaaataattttaaaaattggcctggcatggtggtgtgcgcttgtagtcctagctactcaggaggctgaggcaggaggatcgcttgagtttgggaggttgaggctgcagtgacccatgatcgtgccactgcacttcagcctgaacaatagagcaagcccttgtctcaaaaagaaaattgtaataagtacatttaaagccc

SEQ ID NO: 7846 - DNA, 384 bp, Homo sapiens
ataaataaaataaaggaaatatatatggagtggtaaaaacatctgcaataaaaattacaagaagagccaggcttagtggttcatgtctgtaatcctagcactttgggaggccaaggcaggaggattgctagagcccaggagttcaagaccagcctgggcaacatagtgagacccccatctctacaaaaataattttaaaaattggcctggcatggtggtgtgcgcttgtagtcctagctactcaggaggctgaggcaggaggatcgcttgagtttgggaggttgaggctgcagtgacccatgatcgtgccactgcacttcagcctgaacaatagagcaagcccttgtctcaaaaagaaaattgtaataagtacatttaaagccc

SEQ ID NO: 7847 - DNA, 23461 bp, Homo sapiens
ttttctctcccaggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaaggtaagaaagaatgcttagattgcaagtttttagttcaatattgaaatgttgggctgggcgcagtggctcagggccaggcgcagtggctcaggcctgtaatctcagtaatttgggaggccaaggcgggaggatcgcttgagcccaggagtttgagagtagcctgggcaacatagcaagaccccatctctataaataaactttaaaaattagccgggtgtggtggtgcgtgcctgtagtcccagctactcaggaggctgaggcaggaggatcccttgagcccaggaattcaaggctgcagtgagctatgatcacagcactctactccagcctcagcaacagagcaagataccatgtctcttaaaaaaagacatgtttatggtgggtttcacttgctgtgtgcctttattgttatctgttgttattttgcaagggatggtggtagttacacttctgatatttactaatcaacctgcgaaaatggagatactttgtttctaagtatatcctgttattgaaagtctgcttatatttattcctatttgataaataggattaggagaactataaatgtattaatttcagccattaaaaagatcacacctgggtgcagtggctcacgcctgtaatcccagcactttgggaggctgaggcagacagatcacctgaggtcaggagttcgagaccagcctggctaacatggtaaaaccccgtttctactaaaaacacaaaaaattagcggggtgtgatggcgtgtgccccagctacttgggaggctgaggcaggagaatcgcttgaacccaggaggcagaggttgcagtgagctgagatggcgccattgcactctagttgaggcaataagagcaaaactccatctccaaaaaaaaaaaaaaaagatcacagctcttctgagaagttgtgcctgtggcttatgttacatgccttccaaaatcaaaactgtcattttattagctgtgtctatgctactgttgatttgacactaaggtaagatgaaaatagagcaagtaactgttgtttttgtcatttagggtagagttttgtgttccagaatgtaaactctttctctattcttgtagttgccttttcctgaaggacatattaacgctttaagttttgcagggaaaagagtgaagacagagaaaggtgcattcacagtgttcagatttaggggcttcctatgttttctacaactttattttaatccattagtacttaagagattcacttcctaagtcatgggtcttctccgagccactgatgttaaactataaatgcttaaaaagcatgaatacgtgccttgaaggcaggttccaaatgttagtaccctcctgctcctccttggaggcccagctgaggaggtctgtgcaggccacagggctggaggaaaggcctgctctccctgagcggctgcagcaggaaggctccgaggaagctggtgggctgtcaggagcagaggcagcgctgcccagaagagcacggggctcggtgagggggagccgtgggttcacacgtcaaccctgttagccaggcagcctcactgtgctgggtctgcttcttgatcctgaagatcggggtcgttaaaacagttaaatgagatacctggggaggagagagggatgtatcagttcagttcccatgtgtctcaagcacctatgtgtctcatgttgtaaatgaatcattattgtgccagagtcttaaaaagcagagccaagtcactgttcatctccagacccagcgcagagctgccgaagacagcaggatggtggcctccagggggtcggggtgctgtgtccttcagaacgttattagtaattggaaaggacatttccaagtgtgtgctgatggactgaactgatttttgtttacagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcaggtgagagcttcctagtcctacgcgactgacttcacaagttttcttctgacaaacggtgtggtctttctctcaacgttagtagacgggcccaagaatttaatactgtgtttattgctgagacctcgcatgtatattcgacgttaatttctcatttccctgataaatgcatttgatgtatggccgttatttctgatgggagcctcaaggcactcgtgctgtaacttcttttccctctgtttcttctgggctcttttcaggccacctcacattgtaagggatgcttttattgtctggtaacagatatgccctaacttctttctggcactagcattaacttgtctgttttatacttacaagtatctctttgtttaacacccaaaggctactactttgacataggctggtgttctttactgaacaaaccttgtcaatgaggggaagtggattatgacttcctgtctacctctgctggttaagggacgtctttgacagtctgctgttgttgtctcaggagcagtggagtccacgcggggtgagatagcctttcctttatgcagcagaaagaaagatacttttgtgatagcagcctcgcagcacttcccttgctggatgagacacaactcttcagtcttatatgcaagagggatgaaagtcaggaatttttttgatttattaagttttggtcaataatttggccttagtagatacattatcctgctgaaaataatagaacctttaaaataaaagccccccaaacccctgtgagtgtttaaagattcatctgtatgggagttttatgaattgcctaagagatctgtccagaggaaacacatgtagtatgatgtacatcttctgtgaagaaaagaagtgtttctagtcctttattgttagcaccaaaggctttggacagccccaaggaagcagcagtgatgactgagtagtacctggattcagaggaagctgcgtacgtagccatgcagataccaattgctggtatgtgggtgggagtcttctgatcagctttctaggttgggactgtttccaccctgaaagaaactgaatgaaaaatgcctttttggcaatactgaagatatcttgaacattgattttggaaattatttttattatctacccagaatcagtatcgacttgctttatccacacggcagttctttaatatggttgatttaaaaatacaagaatatgttcattagaaactggaataagatcacgttttcagtgatcatatttgttaactcctgcgttcatcaagacttaccaaaagaagatgaatttgtttaaagtcaaattggaaaccccatccttttccacatgttgccaagacagatgttcagatatacatagaaaacgtgtgtgctggccaggcacagtggctcacgcttgtcatccctgcactttgggaggccatggcaggaggattgcttgaacccaggagttcaagaccagcctgggcaacaacgcaagatctcatctctacaaaagaaaacaaaacaaaaagcttgtgtgcttctgttgctgcagagctgtgtgtacattggaggctacttaaaatatagtaggagagttaacaggtggtgggttccttagtaaagggaataattgcccctaccctcgtcttttcatcatcagattttaccatttgagggttaacctcagagtactacaatttggaattcagtacctccccaactatctcaccgatttctaacaatgaagagatttcttagcttaacctctgatttccatgactttatcacacttattgtcattcagcacttaatagtattttgccatctttgttcacctaaaaatttagatttttttctaaatcattttaaagttagtttcagagtcttgatacttcatctcaaaatacctcattgcgcatctccaaaaactaaggacgtttgtctctataattacagttaacatttgcacacctatcagaatttgtaaaaattctcaagtattgattaattcttgattcatatcaaaatttgtcgtcttttgagaaaataaatttaagagaaactaagattatgtttttttaaatctgtcatcatccatccatccattcattcattcatgccattatttggcaggtctttttcttacagttttatagtagagcaagtgccgcccagagacggcagtgacttcctgtggtcacacaggccagcctcagcctgcgggtccagaccagcactcctcggcccgcactgtttaccgcacttactctaaaggttaacataggcacatttctttggatagaaacttttgttgctaaaccctaatatcatctttcttaaattatgtgccaagaaatttttcattcataaattgaattgtgttgtaacaatctaaaacggtaaaaatcataaatcagaataaaggatttaaaagatagacgtgctgggtgcagcggcatgcacctgtaaacccagccacttgggaggctgaggtaggagaatcacttgagcccagaagttcaagtccagcctgggcaacatagcaatacctcatctcttaagaaaaaaattttttaattaaaaaaaaaaatatatatatatatatatatatatatatacacacacatatacacacatatatatgtatatgtatcaaatgccagtattatattcctgacttccagaggcttggctttcttgtcattttttagatgaagagcttgacattcttctcagtcatgttgcgttcatgtttgtctttgttactagatacttcatatgatcatcagagtcttccgtagttgccctttgtgcatctacttcttctttttacaataatttaaattgtaggcaagttttattaggtttgttctactcttgctttactcttgtagctgtgctagcaagcgtttatcctatcacataaaacatgtctgctgaaattgtatattcagcactcatttctagagatcctagtcatcccttttcaaagttaaaaattccttttataggaatctactttaaaactatggacagggctgggcaccgtggctcacgcctgtaatcccagcagtttgggaggcggaggtgggcagatcacctaaggtcaggagttcgagaccagcctggccaacatggtgaaaccccgtatctactaaaaatacaaaaattaggccaggcacggtggctcacacctgtaatcccagcactttggaaggccaaggcatgtggatcacctgaggtcaagaccagcctgactaacatggtgaaaccccatctctactaaaatacaaaaattagccgggcatggtggtggatgcctgtaatctcagctactcgggaggctgaggcaggagaattgcttgaacccaggaggcagagtttgcagtgagccgagatcacgccatcgcactccagcctgagcaacaagagtgaaactccatctcaaaaaaaaaaaaattagccagccatggtggcgcggcccctgtaattccagatactcaggaggctgaggcaagagaatcacttgaaaccaggaggtggaggttgcagtgaaccgagatcacgccaccgcacttcagcctgggtgacagagtgagactccgtattaaaaaacaaaaaaagaatatatatattgtatatatattctacataaagatccttgcagacaaggatgattcttttaaacaatgttttactctcccagtagtaccttaaatatatatagtaacttcttatttcatgcggacaggttgttcatacgaatattagcttcttggaagattcagttatgcatagagtccgagttatgaaaattatttttgacataattctgaagtttttcctggacgattaaaacaacaactaactttattaaacgtggattatgtgatttttttttaaagactggcattacaacagtggtcctgctgtagaattacatttttaaatagtctctcagctcacggacagggatttgaagcaacagtctccgttcaaagcctgctttaagctcaataccagctctgcagtggggctccccttgggggaatagagctcaccttgcagtaggcaccatggtagcaaccagctcagaaaactaacctagggacagcagagaaatggaatgcggctctgccacattaaaaaagcaagtgtgcaagtgcgatgctacattgttttccaacccactttttctttgaggtgcaggctacatctgtgtgttggcagatggagagagacctcagatgtctcgagaaataagattagccatgagttgacccttgtggaagttggttgatggatgtgtgggttactgcatattcagtaaactagaagttccctgaggaccaggtgtgaccttgagcttggctctggtgcccagggcagtgctatgcactcagagcaggtgcccagcgaggaagggttgtgacatgctgggtgctgtcccagggttgcagtcctcactgcatggattttctaatcccgcttacaaagtagctgctgttttccagcattgctttgtgccagccctgtgctgagtgcttgtcacacatgatctcattggagtctcgctgcaggtgggtcttaagagccccattctacagaagggaagcagaagctcagacaagttgtgttatctgtctgggctcgcacagtaaggcagacaacaacgggatctggcctggcgtctgctcctgagcgcactgccctttctgtctcgccagcctgctccctgctacaggtgggaccgtgcacctgtttgccagtgggtccaactgcaggccagctgtgcaaacagattgaagaataaccttaaagtggttcatttttaaaacagaaatgcctttattttgaacattaactatcctattatgtattatattatgtatgttaattttctataatgcactgattgtacaacatttccctaaaatatgttgactgacttgtctctttgaatataattccaagatgaaagcaaatcccactaaaatgaacttttttcctccaactctcccctttagtatacactgcgctgtgacatgaagcggtctctgttggccaaggacttgacaaagacctgtgaatttatcgttcactccgctgtaagcttcactcggggactctggtgcttaatgataggaatctcccatggggtctgagagtttaccctatttacaagctcaccatttagcctcttactgtttcacgggtgctggcagaagacacaagacttctgggtcagagacagtcggtggcatgcgcatcacgtgtgcatcattgtcctgggcccagagtcccccagctgaggccgcgggccagagggactccacgtcggcacatcaggcaggacctttcctccccctggctctctggatggtagactggccctttgcatcccagcccctggataaaaaatgccaggcaggctctcatgaagctcggctgtatctgtagattctgaaattatgtaacatggaggtgatcactgttactgctgttttggtaacgtttaaagtatgattcttcaggtgacagctctatagctcagaggccaatagcaacctgacctcctgggttcaatgctcagccccccagctccaccactgagctgagcaggccactgagctctctgccccgcttgcctcgtctgtgaagtgggaccatctgggaggtgtgaagagccctttggagggtcactgtgctgaggtttcaaataagtacttgccaataacactgttctgtttcttagatctgattttaaaattctgaatctgaaaggcacgttggagattaagacatctctcccctcattttacagatgaggaaactgagtttcagcaagatggggaaatttgacagaactgtgttcaggacccaggcttgcgcctcttagttccccgtccttcctgcatcgccaggctgccgttggtttatttttgaaagggaaaagctatttgacctgcagaactcttggccttcacctactgatttcggtttcacctctcgttttagcctcagaaggggaagtttactcccagtcccgtggacttcacgattacacctgaaaccttacagaacgtcaaagaggtaagacgtcctgcacaggcgaatgccgtgggtatcttcccagcagccagaccccacggactagctattgcccgggtggtcttcatttggaaatcacgtcatcagccggcagagatttctgattgtacccaaattactcagtattttccatttgatttcctttttaagctcagtaaagcagcttagaagaggactgcttttgaaaagttcctcagggagggtccatgtctattaatctcaccattttccctcagttttactgcatcatgggcccccaagaccccctgctgcccatgacacggccacgtcccttcatttctcatggttagccggggcctgcgcccggccccctggcctgttgtcatcctccatggatgtttagtttgcagtttcttccccagcattcccatcagacagaggccgggcagcaacgtgcttttcaaagattccgcagtgccctccgtggtggacgcctcacggccagggcaggtacagtgaggacacagacgcctgggcagtgccagcccagctcccccgcctcctgcatcaggacagggctgtctggctgtcagtggcagccgctggtggagcctcagctggtccctcgagctgcacggtgaacttgggcccgtccaaaactctgcctggccccggcctccctgatcttgccctctcatccactgccatgcatttctcctaaacagtggagtcctgtagttcttcctggatgtaacttttcatccttcctctaattctttattctgctgtctggaccacactgactaggatcaagtgaaggacaagctgggaggcctgggccctgggatgtcattggcctcatccctcagaggctggacatgtgtcgtggggagcctttcagacaggtgagggaggaaaggccactcctctgtctgttctgcacgtctcccttctccgggctctgagggcacgcgaccccagtgggccactcagactcccgtctcccacctctgtagcctgtcttcggaagcgctgacctcagcagtaatgtgattcatttctagacaccgtttcttcttcgggatagctgctgcttccatgacggacgcagtggcctttcatctccttttcctgtattgattctgtttctcaggggttggttctgtttgtcgagtgtgtgtgtctttttcttgcttttgttttccttaaatgtgtattgatcctcggttgtcagtttacatttacaaatgaggatctaatgtgtgtggtggtgttgtagaggctgtatccttagcccaggtgagaacctgttctcctggtcctcagcacctgctcatcagaggcgctctgccctgggtgtggcacgtggccggggtgtttgtaggcagcttgtctcctgagtccagaggctcgctgtctgcattgtggctgtgaatgacgtgggacacttgtcctaccttgccccgagtctgcttttccgggtgggagatcccctttgcaggaagctgtggtgccagtctgtggcagcttcccccatctggtgagctcacctgtgatacctgcctactgcccttcgcaggcccccgcccgatggcaggctgaccacacgccctgcgagcacacccgctctcaccgctccccctgccacctggaggacgggtgccccgaactcccgggagccggattgtctgtccactttctgccggacagaaacacttcactggggtggtccccacggggcgttccttgtggcttttctaggtataggtttatttgtaaacacgaagaacttttctttccacagaaccattcaggtttattgttggaaaataagaaaataacacataaagcaaataaaataaaattgcttattcacaaaatgccactggtggttttttgttttgctttttaagtagaaaagagatgtattgtagaaaatcttgtagatttttaagtagaaaagagatttattggaaggatataagacagctttacaggaactactaggctggagctcagactcaaaatagtataggtttattttatttgtatatgttaatatcatgtcagtgggaggagagggaaaatgattgtttagtcagtatcttgagctgaatgttgaaagctatcctttttcatcagtcgcctaaaagaattttaatgtgtactgctactgctttttgtttttctacacaaatagcttctcttagttatttttaaaactctgtcttggccaggcacagtagatcatgcctggaatcccaccactttgggaggccaaggcaggaggatcacttaaggtcaggagttcaagaccagcgtgggcaacatagaacctgtctctacaaaagaaaaatgtaaaaattagctgggtgtggtggcatgcgatcgtagtcccagctactagggaggcttaggcaaaaggattgcctgagcccaggaggtgaggctgcagtgagccatgtactccagcctgggcaacagagcaagaccctgtctctaaaaatgtttataataaaaacaaataaataaaagctccatcttgaatgcagacttcttcagaggtctgtacctttggggactgccaggtccagagtcccgggcttttcaggtccagagcttcactgcctgatcaggtggccaccagccacacatcaccattgaccctggacacatggctggaccaagtagctgagttggatgtgtaaatactgaccagatttcaaagactcaggatgaaaagaagaatgtaaaacatcattcatatttttgatattgattatatgtggaagtgataacacttttgatatattcgttaattttaccttcttttttaatgtggctaccagaaaattccaaattatatatgtggcttccactcgcagcttgcattatgtttctgttggacagtagtatgccaatatctgatcctttcagtaactgggatccagccagaggtaaagattcctagaaaaattgtctctgtctagaccaagcccattcaacccacagcccaccggccaggatggctttgaatgtgacccaacacaaattcataaaccttaaaacatgagattttgtttctgtgatttttttttagctcatcagctatcattagtgttaatatattttatgtgtgacccaagacaattcttcttcttccaacgtggcccagggaagccaaaagagtggacacccctgctctagaccatcatcagtccttcctggccagcgtcaggtgtgcagagtaaaggtttgtaggcttctcatcaagcgtcaaagaaactagttttcttcaaatttccatgaaataaaataaatgtcttgggttttaaaaattgtacaattgggaacatctttgaatgtttttttttttaagagacagcatctcattcttgtcacccagactggagtgcactggtgtaatcattgctcactggagcctcaagcaatcctcctgcctctgcctcccacgtaactgagactacaggtgtgcaccagcctgcccagctaatttttaaaacattttttagagatggggtcttgctgtgttacacaggctgttcttgaactcctggcctcaagtgatcctcctgcctttgcctcccaaagccctgggattacgggcctgagccactgtgcctggccaggacttttctttttaactgtgtgtgtgtcaggttgtcttgaacaccatggcgactccctcagactttttcatgtcttattccttggtaagaaggagctttctagctctgagactaggcaattaggatggttctctgaggcattctctgtacacagagtgtcagtcaggtgccatatgtagagagtcgttgaataattcagccggctaatgtccaagacgtcagtacttcgctcctttcttcccgttttgtgagacggtcccggtggactgtgtaaccactatccaacttcgcttccaggttttatttgcaccaaagtatggagcactttccccccttgcctgcattctgatgtatttgttttcattttgttttagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcggtgagggccgtgccaccaggcctggcgcttgcctgtccccctcgactgccaccctcacgttccatggttaagaggatgctggggggctgggcacagtggcgcacccctgtaatcccagctactcaggaggctgaggtgggagggtggtttgaggctgcagtgagctgagatcgcaccattgcactccagcctgggcagcagagcagaccatgaccctgactctaaaaaacgagaggacgtcggggaagcaaaagtaagagcgtggctgtgccttagcagtagccgcgtgtctaaggaaagtgaggggaggggaccctggaggattcttggagcagactggtgggtggtgccggtgcggatgtggaccccgcagcctctgctggccctgaccgcgtgatgtggcctccctcccgcagggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtgggtaagtggcactcgcctcccagccctcatgggcccatgggaagggccgctcagcgccagggcctgctgtgggtcacagagctcagaacctgccgcccttcggtccctcagtgccagggcctgccacaggccatacagctcagagcctgctgcccttcggctgctcaacaaaaccttgttaaggagctgctgtgccgcacaggggacacacccacaggcagtcctggtgcttgtgggacttccactgtcacatggggaaacacacagacccacatcagtgtagacatgggcaggtgacgctgagctctgtgtagacatgggcaggtgacgctgagctccgtgtagacatgggcaggtgacgctgagctctgtgtagacatgggcaggtgacgctgagctccgtgaagaaaactcccgtgaacgagcaccacaggagtggggggtggtgtggatactgagaaagtggctctgtgtgaaggtccaggacccgtgaaaaccccagagtgagcgctcagaagcaggaaggccttgagccccgcggcctagatgcctctagtgagtttccatgaacctgtgtgttcatattttaaccatgggatctgaatcaggtcacagacacccttttatattctgcctttttcccttaacattgtatcatgaacatttccatgtttttaactcttcctataaatattgtaatgggacctccatcttaataagaatcatgttaattgggagatcactccacactacgaagaagtagaacagagagacccagtaggaagggaccgagccttctcagtagcaggggactgtgattcagagaggctcggggacctctaggttggaagtcaggagtgagcactgcatccacatcaagagcagcacctctgtgtgttcccctccaattccgtgcgagtgacctcaaatgcacggtcaggcccgagactggaactcactcggactctaagcagcgcctgggtatcatggcggctccagtgcagctgttttcctgctgtaaaggaaagcccccgccagctccctatcttgcctgctgggcatccctctctgtccactccagccacaccctccacccttctggggggcacaacaagaggggtggagaacccattgaagggagtggtggcaggaagtgcccagaggactctaatgtagtgacaataaagtgaggaaggacaggccggccactgctggtggccgactcttcttgtggctgatgtttgggcggaggtggacactcccacacggggatgttgtcctgcagaccccagccacaggtgggcactgactccaaggccccttccacagctgagctgccacagtgtggggctcagcacagggtgccctctgcccacacgatgcccttcccacccctcctcacactggggaaggagatggtgcttgtttgtcgtcaggtgcttcctcttcacacacatcccttttgttaggatcaacaaggctcacccatatcagctgaagagtcggtggagaaggaatcctgtttgctgaaaggtgatggatgaatagtatccaatggagcaacaatgaaattgttgcttctgaagactgtttctcacctggggattggggacatgggcccagacagctatgcgctggttcacagtctgctatttcattaagaaccgtaggaaatgtaaaaataaggcaaaggaatacaaatgaattgaaagggttctagaatatcctttttaggaaagcaaagggacagggaaagtgtagttggtgaagcctgatcactcatgttccaagatgagaggacaaaaattcacttagagaaagttgacagaggtagtcagacatcagcatagtcatctccactgaaagtttggctgaaaggtcagggtggcgctgaggggacagcaatgaaacccacccgcaccgggtgctccttcgccgttagagcttcctgcgactgcagtggtggcggcgtgtggtttcgctgcttggtaacagtgagcacaaacccaccctctcttctcttctcagaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggttcaagcgactctcctgcctcagcctcccgagtagttgggattacaggtgactgccaccgtgcccggctaatgtttgtatttttagtagagacggggcttcaccatcttggccaggctggtcttgaactcctgacctcgtgacccacccgccttggcctcccaaagtgctgggattacaggtgtgagccaccacacccagcctctgtagttctttttacaacatttttcattataactttaaattttttaagcaactggaaaagtgttccttgctctcttggggggatttggctggtgccgaagtgtttctgaagtctcaagaactgccataaaatctcacgctgccatttccctgaacagatacatacatagagagagacagttttccaaactgtgtcacgcaggctgagtgcactggcaggatcacagctcacggcagcctcaacctccctggctcaagcgatccctcccctcagcctcctgagtagctgagactacaggtgagtgccaccacactcagctaattttcaaattttttgtagacagggtctccctatgttgcccaggctggtcttgaactcctagactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgccactgttttgttggcccacaactaataggacctcaaaataagccatgctgctttgcacacacactagccttcttttgtacttttcattctggatgggcttggccaaaacaggctcaggccaaagacctcccaagctgtatgtacttccagtatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggatataaatatgactgctttccttagagaataattattacctgaagcgcatccagacaacgtggctacctttatcatttcattcaaccctgagtggcccaaacaaaggcctcaggccggccacttccttccacttcttggtctgacctctccatgatctgttactaggcaaaactcagatgtttggctaccttgggctgcaactgtcccactcttgcccaggcttgctggagttggggttatccacagtcagaggttcagagttgtcaaattctccaattagagcaagagatgaggaaaggaaagggagacgaaagaaagaggctgtgcctcagaaataataacgccgcatatctacaactatctgatctttgacaaacctgagaaaaacaagcaatggggaaaggattccctatttaataaatggtgctgggaaaactggccaaccatatgtagaaagctgaaactggatcccttccttgcaccttatacaaaaatcagttcaagatggattaaagacttaaacgttagacctaaaaccataacctaggcattaccattcaggacataggcatgggcaaggacttcatgtctaaaacaccaaaaccaatggcaaccaaaggcaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaacaagtgggtgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattcaaaagtcaggaaacaacaggtgctggagaggatgtggagaaataagaacacttttacactgttggtaggactgtacactagttcaaccattgtggaagacagtgtggcgattcctcagggatctagaactagaaataccatttgacccagccatcccattactgggtatatacccaaaggactataaatcatgctgctataaagacacacgcacgtgtatgtttattgcggcattattcacaatagcaaagacttggaaccaacccaaatgtccaacaatgacagattggattaagaaaatgtggcacatatacaccatggaatactatgcagccataaaaaacgatgagttcatgtcctttgtagggacatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtggggggagggggagggatagcattgggagatatacctaatgctagatgacgagttagtgggtgcagcgcaccagcatggcacatgtatacatatgtaactaacctgcacactgtgcacatgtaccctaaaacttaaagtataataataaaaaagaaaaattgcttcaaatgaacaacaaaaaaaaagaggctgtgaacaatgaatctaaaacaatattttcttttgggaaatgcccgttttggcaggaatacattttggctccgctgtgctgtgaattcggaggaaaagtagggagggccggaaagcccagggcttcatgcagagtagacatcaagaacccacctgctctggagtcttggtgggcaaggggaacgaaccttccagtccatttctaccgtcaccataattcctgtgtctgaatctgaatcaccttcttcaaaaactgggggctgaggttgcctccacatgctaacgctgattcagggcggcagcagatgctggtgttctcagttccttcctgcttccgcttcctgttcaggaacagggccgcattttcccatcctcttcggctgtaggcgtggtcacgtgaccaggagggcggggcgcgcctgcctagcatacgctggaggacggcgccctcaccctggcgggaggtggatccccagcgcggtgcagttacatcgcagacatgggctcgtctatacgctgctggacggccggggtctgggctccacagccggggggcaccaccctggagctggtgataggggagggaatcgccgctcgggcgcccgggcctcgcgcggagcctgcgtgcgcgggagttcacggggcaaatcctgcccatcctccgcgctcaggcgtggcttcaaaagcctcgggccgggtggtgcagccccagcataacctggcgccccggtggctgctggagtggttggctcagaatggaaggaaacggtggggtctgcgttactctgtggtgataaaaaagagaagcggcagcttagcgccaagaataaatgatgaccgccggaatccctgccgttaggcgcaggtcttggcatgagagctgcaacagggcggccagctgggcgccagggggcctgggccgcctgtccggtgcgggtccccgaatatcctgggctcttccgggaagtgccgctgcggtgaggccagagcctcccgctacggaggatgcgatgtgatgtgctgtgcgttgctctactcaacggagcgccattcccgtggtttcgccttgctgcagtttcagtagataccggctattgattttggtctgagactcgcagccatgtgaacattagtgttattctgggtcaggccgtcttctaagtgctgtatgttacctcgttatagcgaccctgtgaggagggaactgttagtagcattagcagtctaggaaaagaaatccattttgccaggcgcttgtccatccgtctgcgcacctccccaccgttccatcccaggcgagcagtctgtaacgtggtgcagttttgcctgcgctgcagcccattctttcacctcgcttcatttgggttttactttgccgtgtcattgacaagtttttctatgcatttgttcccatgtatgcatcacaggttattagctgcgtcaccacgtgttgagacgcgcgaagggctctgttacctcttcatggtttgaattgttacgtcaccctggcgttcttgaacaaagaattggacaaaacacacaaagcaaggaaagaaggaagcaacaaaagcagagatttgttgaaaatgaaagtacacccacaaggtgggagcagcccatgaggctgaagggcccggtgacacaattttctgggatttaaataccctgtagaggtttcccattggttacttggtgtacaccttgtgtaaatgaagtagtggaccataatcagtctgattggttgcaggagaggaccaaccagaggctgaagcgaagttataaagctataccctatgcaaacatctgattagttgcagaaagcaaccaatcagaggctgaagttacaaagttatactcccatgcaaatgaagtcttgacctgtgaacagcctcattggctgtgggaggggaccaatcaaaggtacttagagtttatctgccacgtggaaaaaggggggttgcagagggagtagcctctggtccttttgttacttggatgtggaaagttggggttttccttttgatttagttctaggaagtcagcgtgaattgggcttaggtttactgcctccagaccctattctcctgcctcagaatggtctcagttttgatcagctgagtcaaatgaaaatgaagtcctgagactaacgcaatcatttgcagctggatccagtttaggaaggaggcgagtgattaaaggaccagaaagtccgatctaattatattctaggactgatttcttctatgtagagtaaaaatactagggtatgttccagacccattcaaaggactgaaatgtcctttagtgaatgacctcacaataccttctgaggggtgtttattattcccatctcacaggtgagcaggctgaggcacagagaaactgacctgcctaagccacgtagctctgttgattcttggcctgatattcccccaacttactacaaccaacacagaattacagtagaccgccattgccctgccatgggtaagacctcattgatggggacacgatcagttcttcgtgaaccattactgttgaagccaccattcatcatttccagctggttttcaaaaaggtagaataaagttttatgcgaagaaatcagttttcattgtgagagctacccaagctaactcattttgggactccgaataagagtagatattaaaaacacaaagcagaacaactgcccgggaaaatgctctatgaaggtaaggtcttctttcgaatataaacagttctgcaacctaaaggctgtcaaaactagccactttggtagggagaaaaaaaaatcatacatgtgagtctaagaggtggaggtgagaataagcctcctgggtcagcatcttctccactatggccactgaaaattattcatatttgagactatcttaagtggctacagtggtcagagaatatgacattactaagaaacagaagggcacctaatttgtagaatcaaagcggatccagctatactcacacaaaatgcagtcaaattattagagtgtatcactcaaaagatgcagaaaggcagactgaggaattaaaactcagcaaggatctcctgtgctttactgtgcttttctatgaatgtcactggtaagatggaatcccttggatagaccccgctccaggccggcaggattctgactttgtagggcttttcatgtccaaccccagccagtctctttacagtcttgtgtataacatacaaaagacatatgctgtggaggttttaagtacttagaaaagtatgaaaacagaatttgtgcctatgtctgtatattgtcgcattctggggagtgccagcttgatcaggactaagggtcaggataataccaaaagtttatggtttactgtcatctgcatcaactgtcatttccccaaaagatgtttctggttccctttacaaacgtccagctgtggtaggaggctgagcatgaagacttagggacaaagcaactcaaacgaaaagcattatgagaggtagggtttggtcagcaaaggccccataaagcagggtgtggtcacttcctttctcagaggtcactgtcccccacctgggtcaaggactagaccttcaagaactagaccacaacctctgggtcttaagtgaaaggaaggagaccagcttttctgtctacagatgtatagcctctgatggggccacctggggaggctgggccaggagcccagatgtactgccgcatgatacaccaaaaaaggatgcacccaggcttagctgcagaaaggtgagagaaaggagcaaaaaactaaaatcttaaatattcatgtttgttttaaaacaattttcgacaccaatatgtattaagaaaacacaagttcaaagttgaattcaaaatcccctacatggctgggcgcagtggctcatgcctgtaatctcagcactttgggaggccgaggcaggcggatcaattgagtccaagagtttgagaccagcctggccaacatggcgaaaccctgtctctaacttaaaaaaagatagaaaaattagctgggcatggtagtacacacttgtaattccaggtacttgggaggctgaggcatgagaattgcttgaacccaggaggcagaggttgcagtgagctgagatcacgccacagcactccagcttgggtgacagagtgagactctgtctcaaaacaaacaaaaaagcaaaatcccatacataaaaaagatatgcttaagaagtgagtgtacttttaccacgattttcctttatatctggtagcaaatacatgttttttaatccatggaaactgcaaaaatcagttacatgcatagcaacaaaggaaatcacaattggctgggtgcggtggctcacgcctgtaatcccagcactttcggaggccgaggcgggcagatcacgaggtcaggagatcgagaccatcctggctaacacggtgaaactccgtctctactaaaaatacaaaaaattagccgggcgtggtggtgggcgcctgtagtcccagctactcaggaggctaagacaggagaatggcgtgaacccgggaggcggagcttgcagggag

SEQ ID NO: 7848 - DNA, 23461 bp, Homo sapiens; identical to SEQ ID NO: 7847

SEQ ID NO: 7849 - DNA, 455 bp, Homo sapiens
acccaggctggtctcaaactcctaggctcaagcaacctgtccaccttggcctctgaaagtgctgggactgcaggcatgagccaccacgcccagcctgagacgtgttgttctgtgtggattgtggattcagtctttctgttccgcttgatactatttcatcccctcaatttcctcttccactcgagcccctgtaacagattgagaccatccagttctatggtgacaggaagaaactgctctccaatagcgaatgcagttactatccgtaatctattactcagtaattatcttcagataaatgcacagatgatctgttgtgaagtctctcgatgatgtgtgaaccaagggaatggaggcgccgatgcctcctggtgtgagcaggaaccacagggacagggcagtccttctggaaagtggcatgctgctgcctcgtgggtggcaccaataacctccag

SEQ ID NO: 7850 - DNA, 455 bp, Homo sapiens; identical to SEQ ID NO: 7849

SEQ ID NO: 7851 - DNA, 2580 bp, Homo sapiens
cgatccgatccgatcccattccatccgttcctcgtctcctcccgtctgacccgttgcgcggccgtgtgttcgccacaccaggcatccaaagctgaggtcgctcctacggcgctgggcctcgctgttcgctttagagatgtttggcctcttccctcccaaacagcccatcttcaaaaccatggactcttggactggcacctggccacctgtccctctaccaagactccacttccgtctacccacttcttcctcagattcttggtaccccctgggttggagactgctcattttccttccaaattaatcccagaccccctaaaatattgacaaccttgacaaccccccaaccgaggagccagactttgttttggactaacttccatagccctatcatggaggcagtgtacctggtagtgaatgggttgggcctggtgctggacgtgctgaccttggtgttggacctcaacttcctgctggtgtcctccctcctggcttccctggcctggctcctggccttcgtctacaacctgccgcacacggtactgactagtcttctgcacttgggccgcggagtcttgctttcattgctggccttgatcgaagccgtggtccggttcacatgtgggggcttgcaggccttgtgtactctgctgtatagctgctgctctggcctagagagcctaaagctcctggggcacctgcctctcatggggcacttcggagcagggagatactgcaccggggcgtcctcaatgtgctctccagtgtccatgcttttctgccgccaggcctgtgacatctgtgccatttccatgagcctgttggcttatgtgatcaacagcctggtctacatctgcctcatcggcactcagaacctcttttccctggtgctgccctgtggatgcagtgaccgggcctctgtggaggatgacagacgtagtggctgccttcctagcccacatttccagcagtgctgtggccatggccatcctcctttggacaccctgccaactagccctggagctgctggcctcagctgcccgcctcctggccagctttgtgcttgtcaatctcactggcttggtgttgctagcttgtgtgctggcagtgacggtgactgtgttgcatccggacttcaccctgaggctggctacccaggcactcagccagctccatgcccggccatcctaccaccgtcttcgagaggatgtcatgcggctctctcgcctagcactgggctcagaggcctggcgccgagtctggagccgcagtctgcagctggcgagttggccaaaccggggaggggcacctggagctccccagggtgaccctatgagggtattctcagttaggacccggagacaggacactcttcctgaagcggggcgcagatcagaggcagaagaggaggaggccaggaccatcagagtgacacctgtcaggggccgagagaggctcaatgaggaggagcctccaggtgggcaagacccttggaaattgctgaaggagcaagaggagcggaagaagtgtgtcatctgccaggaccagagcaagacagtgttgctcctgccctgccggcatctgtgcctgtgccaggcctgcactgaaatcctgatgcgccaccccgtctaccaccgcaattgcccgctctgccgccggggcatcctgcagaccctcaatgtctacctctgaagcctccttccctgcctgcccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcaatgctgagggtggtgagtatgtcactatgcaagggccctgagactatttgctgtgggctctcctccagcctgcccagggcccacccagatgcctctggggttactcctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggtccaaatacagaagggcccagggcccaggggcttgcagcttcgtgaggggtctctggcccagtttccaatgaataaagttctcttgacagctctga

SEQ ID NO: 7852 - DNA, 2791 bp, Homo sapiens
acacaagatggcggcgcccagcggagtaggggctgcgcttggggtttgctgaagctggctgcctctcccactccccttttgggtgcaaagcgccgctagcgggaagacgggggccgggcggggacaggggcacctgcgtagctggactgagagcctgcgcccagcttacatcgaccccacccggccccggcccgacccgacgcgacccgatccgatccgatcccattccatccgttcctcgtctcctcccgtctgacccgttgcccggccgtggttcgccacaccaggcatccaaagctgaggtcgctcctacggcctgggctcgccttcgctttagagatgtttggcctcttccctcccaaacagcccatcttcaaaacctggactcttggactggcacctggccacctttccctctaccaagactccacttccgtcttacccacttcttcctcagattcttggtaccccctgggttggagactgctcattttccttccaaattaatcccagaccccctaaaatattgacaatcttgacaagcccacaatcgatgagccagactttgtttggactaacttccatagaccctatcatggaggcagatgtacctggtagtgaatgggttgggcctggctgctggacgtgctgaccttggtgttggacctcaacttcctgctggtgtcctgccctcctggcttccctggcctggctcctggccttcgtctacaacctgccgcacacggtactgactagtcttctgcacttgggccgcggagtcttgcttacattgctggccttgatcgaagccgtggtccggttcacatgtgggggcttgcaggccttgtgtactctgctgtatagctgctgctctggcctagagagcgctaaagctcctggggcacctggactctcatggggcactgcggacccggtagatactgtaccggggcgtcctcaatgtggtctccagtggccatgctatgctgcaccaggtctgtgacatctgtgccattgccatgatcctggtggcttatgtgatcaacagcctggtcaagatctgcgtcatcggcagtcataagctctttactcctggtgctggtcctgtgggatgcagtgaccgggcctctgtggaggatgacagacgtagtggctgccttcctagcccacatttccagcagtgctgtggccatggccatcctcctttggacaccctgccaactagccctggagctgctggcctcagctgcccgcctcctggccagctttgtgcttgtcaatctcactggcttggtgttgctagcttgtgtgctggcagtgacggtgactgtgttgcatccggacttcaccctgaggctggctacccaggcactcagccagctccatgcccggccatcctaccaccgtcttcgagaggatgtcatgcggctctctcgcctagcactgggctcagaggcctggcgccgagtctggagccgcagtctgcagctggcgagttggccaaaccggggaggggcacctggagctccccagggtgaccctatgagggtattctcagttaggacccggagacaggacactcttcctgaagcggggcgcagatcagaggcagaagaggaggaggccaggaccatcagagtgacacctgtcaggggccgagagaggctcaatgaggaggagcctccaggtggggcaagacccttggaaattgctgaaggagcaagaggagcggaagaagtgtgtcatctgccaggaccagagcaagacagtgttgctcctgccctgccggcatctgtgcctgtgccaggcctgcactgaaatcctgatgcgccaccccgtctaccaccgcaattgcccgctctgccgccggggcatcctgcagaccctcaatgtctacctctgaagcctccttccctgcctgcccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcaatgctgagggtggtgagtatgtcactatgcaagggccctgagactatttgctgtgggctctcctccagcctgcccagggcccacccagatgcctctggggttactcctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggtccaaatacagaagggcccagggcccaggggcttgcagcttcgtgaggggtctctggcccagtttccaatgaataaagttctcttgacagctctga

SEQ ID NO: 7853 - DNA, 947 bp, Homo sapiens
agtgattgtctgcctggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcatgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactttcaattctgagttggaattatatttctttttggtggctaatgagtttaatcttttgtaataaaattgacttcagttttcattttttaaataacttaatatctagcatgtgtaactttttttatgttctacttcttactaatttatgataaaattcttgttcaaagttgtgattaaaccgtacttaacatgt

SEQ ID NO: 7854 - DNA, 3606 bp, Homo sapiens
ctttggtatactaatgacccttgagaaactatagaagtgcatctgaaactagagttagtggttattgattttttagcttaatgtgtttacctagtggtaactcttcagcccacttttacagtattgggtatcaactcccagaaagtgcctaaagtttaatgttcagatatgtacccactctcccctttacatttttattcaaaagaatttatatctttaaagagatttaaatatcaagagtttttttaaaacttaattttagctatttaaatttttattctactgcctaactttctttttcattaaaaggcctgaaaactgtgactctttgagagggaaagaatcgcagaaattaagtatttaatgtgatcctttccacctaaactgttttgtatggaatacaatcagtgtggtggtagtggtggtggttatctgcaaaatagtttctggtgattaaatctgactttttttttttttttcttttaaatgagacgtagcctcactgtgttgcccaggctggagtgcagtggtgcaatctcagctcactccaacctctgccacccgggttcaagcgattctcctgcctcagtttcctgagtagctgggattacaggcacctgccaccgtgcccggctaatttttgtatttttagtagagataggtttcaccatcttgcccaggctggtcttgaactcctgaccttgtgatccacccgcctcggcctcccaaagtgctgggattacaggcgtgagccaccgcgcctggccataaatctgacatctttaaaggaaagttttcattgtgagattaaggcttaacagcccatgaggtcatatacacatgaacgtatctattccatttaaagcaatacacactctggcttctgattaaaaatagccaggaggagagtctctgaatctactgtgattctggagtctgcccaatttggaaaaaaaaaaaaaagaaaaaagtcaggaggaccaatttgccagggaaactcatagaaaagaattacaaagagatcacaaaaactggacatattcttttgactaattagaccacttatggctgggcgcagtggctcacacctataatcccagcactttgggaggtcgatgtgggaggattgcttgagcccaagagttcaagactggcctgggcaacatagtgagaccttgtctctactacaaaataaaaaaaaattagctgggcgtggcctcagctacccaagaggctaaagtgggaggatcacttgtgcctgggaggttcaggctgctgtgagccgagaccacgccactgaactccagcttaggccacagggcaagaccctgtcttaaaataatattactaattttggtaattaacttatcaaaactatagtgacatatacacgggcagaaacttataagtagagttgtaatgcagccaaatattcttacaaattccctaacaagaagctcaaatctttctcacaggcaaattgtaaaaattctagttttttgtttaaagagctgtgattttcaaaagtatcccttcagtttaagaaatctggggaattggtaacttttcttatgggaaatgattgccatcatctctactgaaggatgcctcttactgaaaaatgtcttttgaaggagttcttgcctaaagcattctttggatgtaatttcatacactaaacatatagaccagtagttagtgggcccctcctcttaaacagtaacttttgaagtactgatacatgattaaaatgttagatatttttcactggagctaagacttaaaattagggcattttgaaaggtgtatttgtttctgtttcttgtttgatatattttggttatctactcttttaaaaaactaaacgtataaaaggtatcttcaaattactgagtgtttcatccatcccagtaggtgaagtattctccagtgaataaatctatatatatatatagattttaaatagcttgagcggtgtagcttgaaatgttttcagggaaagactatttgaatcataaggaatagctttgattttcttttttatgtctcaaatatagaattatttgggggtggtcactcagatggaagaatattggcaattgtgttgaacattttaccttatatagttttgagaatttttgccaaaaactgatttcttagaaatatcctcccccagctgtgctttggttttttggtttttttgttttgagacggagtcttgctctgtcgcccaggctggagtgcagtggcatgatctcggctcactgcaagctctgcctcccgggttcacgccattctcctgcctcagcctcccgagtagctgggactacggacgtccaccaccatgcccagctaattttttgtatttttagtagagacggggtttcaccgtgttagccaggatggtctcaatctcctgacccgcctccacctcccaaagtgctgggattacaggcatgagccaccacacccggcctctgctttgttttttaaaaaaaaagaaatgcaagagagggagggaggcagcctcctgaccataaaagctgatttcttgatttttttttcttttttttttgaaatggagtcttgctctgtctccaaggctggagtgcagtggcatggtctcagctcactgcagcctccgtttcctgggttcaagtgattgtcctgccttggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcgtgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactttcaattctgagttggaattatatttctttttggtggctaatgagtttaatcttttgtaataaaattgacttcagttttcattttttaaataacttaatatctagcatgtgtaactttttttatgttctacttcttactaatttatgataaaattcttgttcaaagttgtgattaaaccgtacttaacatgt

SEQ ID NO: 7855 - DNA, 3607 bp, Homo sapiens
ctttggtatactaatgacccttgagaaactatagaagtgcatctgaaactagagttagtggttattgattttttagcttaatgtgtttacctagtggtaactcttcagcccacttttacagtattgggtatcaactcccagaaagtgcctaaagtttaatgttcagatatgtacccactctcccctttacatttttattcaaaagaattatatctttaaagagatttaaatatcaagagtttttttaaaacttaattttagctatttaaatttttattctactgcctaactttctttttcattaaaaggcctgaaaactgtgactctttgagagggaaagaatcgcagaaattaagtatttaatgtgatcctttccacctaaactgttttgtatggaatacaatcagtgtggtggtagtggtggtggttatctgcaaaatagtttctggtgattaaatctgacttttttttttttttttcttttaaatgagacggagcctcactgtgttgcccaggctggagtgcagtggtgcaatctcagctcactccaacctctgccacccgggttcaagcgattctcctgcctcagtttcctgagtagctgggattacaggcacctgccaccgtgcccggctaatttttgtatttttagtagagataggtttcaccatcttgcccaggctggtcttgaactcctgaccttgtgatccacccgcctcggcctcccaaagtgctgggattacaggcgtgagccaccgcgcctggccataaatctgacatctttaaaggaaagttttcattgtgagattaacggcttaacagcccatgaggtcatatacacatgaacgtatctattccatttaaagcaatacacactctggcttctgattaaaaatagccaggaggagagtctctgaatctactgtgattctggagtctgcccaatttggaaaaaaaaaaaaaagaaaaaagtcaggaggaccaatttgccagggaaactcatagaaaagaattacaaagagatcacaaaaactggacatattcttttgactaattagaccacttatggctgggcgcagtggctcacacctataatcccagcactttgggaggtcgatgtgggaggattgcttgagcccaagagttcaagactggcctgggcaacatagtgagaccttgtctctactacaaaataaaaaaaaattagctgggcgtggcctcagctacccaagaggctaaagtgggaggatcacttgtgcctgggaggttcaggctgctgtgagccgagaccacgccactgaactccagcttaggccacagggcaagaccctgtcttaaaataatattactaattttggtaattaacttatcaaaactatagtgacatatacacgggcagaaacttataagtagagttgtaatgcagccaaatattcttacaaattccctaacaagaagctcaaatctttctcacaggcaaattgtaaaaattctagttttttgtttaaagagctgtgattttcaaaagtatcccttcagtttaagaaatctggggaattggtaacttttcttatgggaaatgattgccatcatctctactgaaggatgcctcttactgaaaaatgtcttttgaaggagttcttgcctaaagcattctttggatgtaatttcatacactaaacatatagaccagtagttagtgggcccctcctcttaaacagtaacttttgaagtactgatacatgattaaaatgttagatatttttcactggagctaagacttaaaattagggcattttgaaaggtgtatttgtttctgtttcttgtttgatatattttggttatctactcttttaaaaaactaaacgtataaaaggtatcttcaaattactgagtgtttcatccatcccagtaggtgaagtattctccagtgaataaatctatatatatatatagattttaaatagcttgagcggtgtagcttgaaatgttttcagggaaagactatttgaatcataaggaatagctttgattttcttttttatgtctcaaatatagaattatttgggggtggtcactcagatggaagaatattggcaattgtgttgaacattttaccttatatagttttgagaatttttgccaaaaactgatttcttagaaatatcctcccccagctgtgctttggttttttggtttttttgttttgagacggagtcttgctctgtcgcccaggctggagtgcagtggcatgatctcggctcactgcaagctctgcctcccgggttcacgccattctcctgcctcagcctcccgagtagctgggactacggacgtccaccaccatgcccagctaattttttgtatttttagtagagacggggtttcaccgtgttagccaggatggtctcaatctcctgacccgcctccacctcccaaagtgctgggattacaggcatgagccaccacacccggcctctgctttgttttttaaaaaaaaagaaatgcaagagagggagggaggcagcctcctgaccataaaagctgatttcttgatttttttttcttttttttttgaaatggagtcttgctctgtctccaaggctggagtgcagtggcatggtctcagctcactgcagcctccgtttcctgggttcaagtgattgtcctgccttggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcatgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactttcaattctgagttggaattatatttctttttggtggctaatgagtttaatcttttgtaataaaattgacttcagttttcattttttaaataacttaatatctagcatgtgtaactttttttatgttctacttcttactaatttatgataaaattcttgttcaaagttgtgattaaaccgtacttaacatgt

SEQ ID NO: 7856 - DNA, 125 bp, Homo sapiens
ctgtaatcccagctacttgggaggctgaggcaggagaatcgcttgaacccaggaagcagaggttgcagtgagccgagatcacgctattgcgctccagcctgggcaacaagagcgaaactccatct

SEQ ID NO: 7857 - DNA, 4971 bp, Homo sapiens
agagatgtggtatggtgtattcctgtgggcactggtgtcttctctcttctttcatgtccctgctggattactggccctcttcaccctcagacatcacaaatatggtaggttcatgtctgtaagcatcctgttgatgggcatcgtgggaccaattactgctggaatcttgacaagtatgttagacattaaaataccagtcaaaaatgtttaatatgactagtcaatttcaggacctattctagaaaacatatctgagtaggatgaaggaaagagtgccttttaactgcaagtccagacagggtctccctatgtcaccaaggccggagtgcagtggttgcaatattggctcactgcagcctccacctcttgggctcaagtaatcctcctccatcagcctcccaagaagcttggactacaggggtgtgccaccatggccccgctaattttttttgtattttttgtagagacagggtttcgtcatgttgcccgggtctcgaactcctgagctcaagcaatctgcccaccttggcctcccaaaatgctgggattacaggcgtgagccactgtgcctggcccagtttttttaatgtattgattttttttttccacccccaaggtcctattacttggctaacctctttgacttcttgagtcagatttcatctcagtggcttcagggaagtcatgttaaactttgtgagatatatctcgtgagagaggccaccagcaagaggaaaatttatctttttggaagctacttctcctctctgatcagctatcacttgagcattggccctgcaagatggttggtgaattacttccactcatgtgggtgtggttgctgtaaagatagaagacaaattttgatgacaagaattctttgccaggtgtagtggctcatgactgtaatcccagcactttgggaggcagaggtgggaggcttgctgaagcctaggaaattgagactagcctcagcaacatagcaagaccccatctctacaaataaaaataaaaaatttagctgagtgtggtggtgtgtacctgtggttccaactacgtgggaggctgaaatgggaggattgctggagccaggaggtccaggctgggctgcagtgagtcgtgatcacaccacagcactccagcctgggccacagagcaagacccgggggaaaaaaaaagaattcttgcttagaaaagtacccgattagtgctctagttatttttttccccttaggactttctgaataagaattggagtaacatgatgttatgaattattttcaggcttgtttttggggcgtttggtttgttatggcttttgcttatgggataagaaacagttacagaaatgagaacaataagtttaaatcatttcaaagctcatgcataaatataaatgtgtattttatataaactgaaaattctaagtaattaaaatgtaaaatcctccattttctcatccctaaataatagccacagtttacatcttggtgtgtattcctttttttaggtatagatgtaaacataaatacatttttataatatagaaatgtaatattcctactgatttgtaactttttttcactgtgaattgaaaccttagcatcaagcagaaatcgccctctatgtctttgacttgaggtgttttttttttttttttgagagaaagtggcctagtttctctgtgttctaactgtatcacctactgctgctttggagaccctctgccccaggatgactggctgctagggcctgtcttagtttgttcctcagtaaaataggggtaatactacccaacctcatacccttgcatgattgagctaatgtgtatatgatgtaatacctgacacatagtaattgtcgaataaatgttgtattcatttctgtctttaaggctctatgaatagtctgttccctttccatttgctgctctcttggatatactttttcctttcttcgcttcattatcccaatcccactttagggcccagttcaagttccttaagcttctttctatccaacccagtctttcttgtgtacctaaattttggaggggcccaatgaaacatgtctttcagatgttagtaacaaaatgtacgcattgccagtggagctgggcattttaaatcactaaatgttcaaggcagccaacctttggttaatattgttctttcttcttgttaaaatatgttaatataccttcacatcacatttgtgaaatgtgccaggcatggtggcttatgcctgtaatcccagcactttgggaagccagcttgggaggattgcttaagtccaagagttcaaaaccagccttggcaacatagtgagaccctgtctctacaaaaaataaataaataaaatagccaggtgtggtggcgtgtgcctgtagtcccagctgctcgggaggatcacttgagcccaggaggttgaggctgcagggagccatgatcatgccaccgcattccagcctaggtgaaagagtgagacactgtctcaaaaaaaaaaaaaattgtaaacgtgattgagacactgtatgttattttgcattattgcaaatctgtttctgtcttgtgtccccagctagattccaagtaccttgagaatagcgatcataccttataaaacacagaagtgttctgcagatgaaaattggagtgaatgaacacactatgacaaaggagaattttgttggagcattttgtggggagggtcatctgggaaatctggatctattcttttctttttaaaatttttattatttatttatttatttttatttgagaacagggtcttgttctgtcacccaggctggagtgcagtggcatagtcacagctcactgcagccttgacctccctagctcaagtgatccccctacctcagccacccaagcaactaggattacaggcacgttcactacacccagctaatttttgtattttttgtaaagacaaggtttggtcatgttacccaggatggtctcaaactcctgggctcaagcgatcctcctgcctcggccttccaaaatgatgggattataggcttgagccactgtacttggccggttctttttttttttgagacaggatcttgttctgttgcccaggcttgagtgcagtgtcgcgatgtgagctcacaacaacctccacctcctgggttcaagcagctctcctgcctcagcctcccgagtagtagggattacaggcacgtgccaccacacttggctgattttttgtatttttagtagagatggggtttcaccatgttgcccaggctggtctcaaactcctgagctcagatgatccacccatctcggcctcccaaagtgctgggattacaggcgtgagccaccgtgcccggccggatctattcttttcaaacgaatgaaatgttaactttcttggtacacttccttggtataatgctgaactcgtatagtaactcaaatgggtatctgcatagatacaggggttttcgttttgtttttccaatttgcaggaaattatagtgactagcgtaataaaaacaatcaatgacttgggagacaaaggaatccctgagtatctctcctctcatgccctgtgaatgaataacaactttatggcttagagtcctcctgtcttcccttttcacccctctagtccctcctccgtccatttcttgaagggaactatgagtgtgatagaaggtggagtggggattccctgtggcctgaaacatttcttgcttagtctaactcaaaagatcctttttcatttgttaccaaaaatgtattaggtccctgttgaaggctaggcatggggtaactggtaggggaatacagatatttttgagttcataatctggtcatgtgggaattgctatctttgtgattttgattatttcttccagattattttattcaataaatctaggagactctgggttttaaggagtcagcatctaaaagtgatcttgcaagccatgcaatgaatactcaaagtgtagagtagtccacagaaagaatagggaaaacctaacatttctgtaagatttaaatttcagtataaaatctggaacattctactcgcagtagtattttaaatgttgtattttcgtgagtttgttaaccttcgttttttgtttttgtttaacattcttgcattttaaatcaggtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttaatttaagcagttttcatgtgtacctttacgcaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaatttaagtataactcaagtagtggctttggttccactgtttataaataaaaagtagataacaatgaataatgtgacattttctggacaactgtcttgacttctgattaagatattttaagagatgtgaatttgttattttgtatgtttta

SEQ ID NO: 7858 - DNA, 4967 bp, Homo sapiens
agagatgtggtatggtgtattcctgtgggcactggtgtcttctctcttctttcatgtccctgctggattactggccctcttcaccctcagacatcacaaatatggtaggttcatgtctgtaagcatcctgttgatgggcatcgtgggaccaattactgctggaatcttgacaagtatgttagacattaaaataccagtcaaaaatgtttaatatgactagtcaatttcaggacctattctagaaaacatatctgagtaggatgaaggaaagagtgccttttaactgcaagtccagacagggtctccctatgtcaccaaggccggagtgcagtggttgcaatattggctcactgcagcctccacctcttgggctcaagtaatcctcctccatcagcctcccaagaagcttggactacaggggtgtgccaccatgccccgctaattttttttgtattttttgtagagacagggtttcgtcatgttgcccgggtctcgaactcctgagctcaagcaatctgcccaccttggcctcccaaaatgctgggattacaggcgtgagccactgtgcctggcccagtttttttaatgtattgattttttttttccacccccaaggtcctattacttggctaacctctttgacttcttgagtcagatttcatctcagtggcttcagggaagtcatgttaaactttgtgagatatatctcgtgagagaggccaccagcaagaggaaaatttatctttttggaagctacttctcctctctgatcagctatcacttgagcattggccctgcaagatggttggtgaattacttccactcatgtgggtgtggttgctgtaaagatagaagacaaattttgatgacaagaattctttgccaggtgtagtggctcatgactgtaatcccagcactttgggaggcagaggtgggaggcttgctgaagcctaggaaattgagactagcctcagcaacatagcaagaccccatctctacaaataaaaataaaaaatttagctgagtgtggtggtgtgtacctgtggttccaactacgtgggaggctgaaatgggaggattgctggagccaggaggtccaggctgggctgcagtgagtcgtgatcacaccacagcactccagcctgggccacagagcaagacccgggggaaaaaaaaagaattcttgcttagaaaagtacccgattagtgctctagttatttttttccccttaggactttctgaataagaattggagtaacatgatgttatgaattattttcaggcttgtttttggggcgtttggtttgttatggcttttgcttatgggataagaaacagttacagaaatgagaacaataagtttaaatcatttcaaagctcatgcataaatataaatgtgtattttatataaactgaaaattctaagtaattaaaatgtaaaatcctccattttctcatccctaaataatagccacagtttacatcttggtgtgtatttctttttttaggtatagatgtaaacataaatacatttttataatatagaaatgtaatattcctactgatttgtaactttttttcactgtgaattgaaaccttagcatcaagcagaaatcgccctctatgtctttgacttgaggtgttttttttttttttttttgagagaaagtggcctagtttctctgtgttctaactgtatcacctactgctgctttggagaccctctgccccaggatgactggctgctagggcctgtcttagtttgttcctcagtaaaataggggtaatactacccaacctcatacccttgcatgattgagctaatgtgtatatgatgtaatacctgacacatagtaattgtcgaataaatgttgtattcatttctgtctttaaggctctatgaatagtctgttccctttccatttgctgctctcttggatatactttttcctttcttcgcttcattatcccaatcccactttagggcccagttcaagttccttaagcttctttctatccaacccagtctttcttgtgtacctaaattttggaggggcccaatgaaacatgtctttcagatgttagtaacaaaatgtacgcattgccagtggagctgggcattttaaatcactaaatgttcaaggcagccaacctttggttaatattgttctttcttcttgttaaaatatgttaatataccttcacatcacatttgtgaaatgtgccaggcatggtggcttatgcctgtaatcccagcactttgggaagccagcttgggaggattgcttaagtccaagagttcaaaaccagccttggcaacatagtgagaccctgtctctacaaaaaataaataaataaaatagccaggtgtggtggcgtgtgcctgtagtcccagctgctcgggaggatcacttgagcccaggaggttgaggctgcagggagccatgatcatgccaccgcattccagcctaggtgaaagagtgagacactgtctcaaaaaaaaaaaaaattgtaaacgtgattgagacactgtatgttattttgcattattgcaaatctgtttctgtcttgtgtccccagctagattccaagtaccttgagaatagcgatcataccttataaaacacagaagtgttctgcagatgaaaattggagtgaatgaacacactatgacaaaggagaattttgttggagcattttgtggggagggtcatctgggaaatctggatctattcttttctttttaaaatttttattatttatttatttatttttatttgagaacagggtcttgttctgtcacccaggctggagtgcagtggcatagtcacagctcactgcagccttgacctccctagctcaagtgatccccctacctcagccacccaagcaactaggattacaggcacgttcactacacccagctaatttttgtattttttgtaaagacaaggtttggtcatgttacccaggatggtctcaaactcctgggctcaagcgatcctcctgcctcggccttccaaaatgatgggattataggcttgagccactgtacttggccggttctttttttttttgagacaggatcttgttctgttgcccaggcttgagtgcagtgtcgcgatgtgagctcacaacaacctccacctcctgggttcaagcagctctcctgcctcagcctcccgagtagtagggattacaggcacgtgccaccacacttggctgattttttgtatttttagtagagatggggtttcaccatgttgcccaggctggtctcaaactcctgagctcagatgatccacccatctcggcctcccaaagtgctgggattacaggcgtgagccaccgtgcccggccggatctattcttttcaaacgaatgaaatgttaactttcttggtacacttccttggtataatgctgaactcgtatagtaactcaaatgggtatctgcatagatacaggggttttcgttttgtttttccaatttgcaggaaattatagtgactagcgtaataaaaacaatcaatgacttgggagacaaaggaatccctgagtatctctcctctcatgccctgtgaatgaataacaactttatggcttagagtcctcctgtcttcccttttcacccctctagtccctcctccgtccatttcttgaagggaactatgagtgtgatagaaggtggagtggggattccctgtggcctgaaacatttcttgcttagtctaactcaaaagatcctttttcatttgttaccaaaaatgtattaggtccctgttgaaggctaggcatggggtaactggtaggggaatacagatatttttgagttcataatctggtcatgtgggaattgctatctttgtgattttgattatttcttccagattattttattcaataaatctaggagactctgggttttaaggagtcagcatctaaaagtgatcttgcaagccatgcaatgaatactcaaagtgtagagtagtccacagaaagaatagggaaaacctaacatttctgtaagatttaaatttcagtataaaatctggaacattctactcgcagtagtattttaaatgttgtattttcgtgagtttgttaaccttcgttttttgtttttgtttaacattcttgcattttaaatcaggtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagattttgatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaatttaagtataactcaagtagtggctttggttccactgttataaataaaaagtagataacaatgaataatgtgacattttctggacaactgtcttgacttctgattaagatattttaagagatgtgaatttgttattttgatgttt

SEQ ID NO: 7859 - DNA, 2154 bp, Homo sapiens
catgcctatcactgtccccgaaggccttccagtgggatgaaatgtggagatggaaggcagtgacactgatgatcctgaccctgtctaggtccaggctaatgtgtgcgtttgtgtcttggtttttaacaaagaagtttaaaaggtaaaaagaaagttaaaaaatttaaagtagaaaacagcttacagaataaaaatatacagaaaatatttttgtacagcagtacaatgtgcttgtgttttaaactgttattacaaaagggtcaaaaagctgtaaaaaaattttttaagttcatgaagtaaataatttacagtaagctaggtttaatttattattgaaagaaaaaagcgtatgaataaatttagtgtagcttaagcataccgtgtttatttttatttttcataatgtctgctcagtaacaagtgtacagtgtttataaagtctacagtagtgtacactcatatcctagggcttcacattcattcaccactcattcactcactcacccagagcaacttccaggcccacaagctccattcatgctaagttccctagataggtctatcattttttatcttttataacatatttttactttaccttttctatatttacatatgtttagatacaaaaatatttaccattgtgttccaattgcctgcagtatttagtacagtaacatactgtgtaggtttgtagcctgtagcctaggagcaacaagctataccatatagcctaggtgtgtagtaggctatgccatctacatttgtgttaagtacactctatgatgttcacatgacaaggaaatttcctactgacaatgtatttctactgttaagtgatacataactatatgtatattagtttgtattgttcagtaatggagagattgtgttagactctaggggccagggatcaagtaactgtactagggtccccaacacttaggtgccatggcaataaataaatgaagagctaaccaaatgcctgcattctggacagctctgtttaaaaggtatttcatggagtttttcatttaatcaatagaaatccaatcactaggccaggcatggtacctcacgcctgtaatcccagcactttgggaggtggaagcgggtggatcatttgaggtcaggagtttgagaccagcctggtcaacatggtaaaaccccacctctactaaaatacaaaaattagccgggtgtggtagcacatgcctgtaatcccaggtacttgggagcctgaggcaggagaatcgcttgaacccaggaggcggaggttacggtgagtggagatcgcaccactgcactccagcctgggcgacaagagcgaaactctgtctcaaaaaaaataaaaataaaaaaagaaaaaaaaaaagaaatccaatcaataaaagcagagaatagtttccattcagtaagtggtaaacaacaactaatgcatttggcactttctctttcacagcttctatctaaagccaatctcatgaggcaccaactttcataccaggcactatcacttctctgcttcctatatctccctcctctcccagagacagaatgtttcagaaagtagatttgctgcctaagattcatgtcattgaagctgcagtagaagagtcatttaatatatgaaatataaggcaagacttttcaaaaaaaattctctctcagaaaatacaagtcactttatattcaaatacttacaaagtacctcttgctgtaggaagttttgcaatttccttattttgaatacaaagtaccagctggggatgacacaataccctaaaacaacctcagttaaggctgctttggctaatggtaatcagtgaaacaagataaattaaacacaaatttagtaattatccctggagatataaactcacacttccatgtgtaaactgccattgtaaggccagctttttattttgtttattcattttttactttttttagagatggagtctcaccctgttgcccaggctgtctcgaatttgtgggctcaagctatccacccacttggccttccaaagtgccaggattacaggcatcagtcaccatgcctggccagtagaccaacgttttaaagatcattttagctgggcgcggtggctcatgcctgtactttgggagtccaaggtgggcggatagctcgag

SEQ ID NO: 7860 - DNA, 702 bp, Homo sapiens
ctttttttttttttttttgagacagagttttgctcttgtcatgcaggctggagtgcaatagcatgatctcagctcactgcaacctccacctctcaggttcaagcgattctcctgcctcagcctcctgagtagctgggactacaggtgcctgccaccaggcctggctaatttttgtatttttagtagagatagggtttgaccaagttggccaggctggtctcaacctcaggagattcgcgtgcctcagcctcccaaagtgcagagattacagatatgagccattgcacccagccccaggctaggtgtttctgtgtacagaatgttttcaagtttgctggtcaggctttatacatacatacatacatacatacgtacatatacatacatacacttatatgcacacatgtatatatataaaatatatacatatataatatacacatatatctttaaaatatataatataaactaagtatgtatcaacttataaactatacacacatatatgatataaactaatatagtaatgtgccacataaggatgttttggtcaagaacgtaccccatattccacggcagtcccgttaagactatgatggagctgaaaaatccctacagcctagtaacacagctttcatgatgttgtagcacaaagcattactcacatgcctgtggtgatgctggtgtaaataaacctactgc

SEQ ID NO: 7861 - DNA, 11864 bp, Homo sapiens
aggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagtatgacagcccgaagttggagtgtgggtggcactcggaggaccccaacccgtgggagtggccagaaccccatccctcaacctcactcctggaagagcagaagggagcccccagatctggcctcccagcgccggtgtaggacggttttgaggccttcctctttcatcccaagtctgttcctgcaggatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggtgcagctcccaccgcgctgctcaggcccggcctaggggtggggacctgggggtggtcagaccttgctgacctccacgcccactcaggcagggcgaccgctccgactgcacttacatcgtgctcaatgggcggctgcgtagcgtgatccagcgaggcagtggcaagaaggagctggtgggcgagtacggccgcggcgacctcatcggcgtggtgagcgcgacccccacccactgacctctggccttttccaggccagtccctcgacaacgcacacacatcatcccgggtaatccagggagtggtgaatgcagctcccgacctctgaggtcacccagtccactccccgcccagacctcatttcgttggaaaaggggattccgcctgtcgtggatccctgtcctctccctctccccagagctctaatgggtagcgagcgaggcttgcttccctacacccccattgcaggggagccctagatggggcagtacagccccctttccacccatcttcggcctcctcattccccacccaagcagccccaatcatgcacgcggccccccaggtggaggcactgacccggcagccgcgagccacgacggtgcacgcggtgcgcgacacggagctggccaagcttcccgagggcaccttgggtcacatcaaacgccggtacccgcaggtgcggcctgttgtgggcggggcagagaggcggaggcgggactccgggggggtgggggccgggcctagtgtgtgggcggggcttacagaggggcggggtcgagggaggggccgaagcgagagagtgagggcgggggctctcgggggtgggacccaggtaacgggcacccaggagccccggcataggagggagaggtgggacctggacagccgcttcccaggtctcactgaaatgccggcctccaacgcccccaggtcgtgacccgccttatccacctactgagccagaaaattctagggaatttgcagcagctgcaaggacccttcccaggtgagagccggccggcccagagcatgctgggagatgtagtccggcgtccagagcatgctgggagggaagccttctttcctgagggatgctgggaaatggagttccgcgaagaaatcgtgcccctgagggtttcaaaccctaagtaggaccgaggtgcagagcattctggggaatggagttcgtgttcctgagcatactgggaaacgaagtcctcgacccctggcgtgctagttaatgggctcgaaagtaaatcagtggtgctggggagggagtcttaggcggtggacttggcgtagtctgcccgggagtcagggcttgctggggaagtccacggcctggacgttgagagaaagggagtcctagatcagaatatgatggcagggccgtcatggtggctcatgcctgtaatctcagcactttgggaggctgaggcaggaggatcgcttgagcccaggagattgagtttgaaaccagcctgggcaacatagtaggacccccgtctctacaaaaatttcaaacattagctgggcttggtgacacatgcctgtagtctcagccactcaggaggctgaggcgggaggattgattgcttgagcccggaggtcgaggctgcagtgagccgtgatcgtgccactgtactccagccgggacgacagagctagaacctgtttcagaaaaaataaaacagcaaacaaacaaaactccccataccatgatggaaaatagtctgtggatttttgtttaggactctgggcacctcgccttctgaagttacagcttgctgggagatgtagccccctgtttcagcctgtggcttcagtgagctagaacagaatggggcgtgcggtggggttggaggcctgctgaaatgagggcctgagtttctacattgtggtggccagattctgggccagcccagcaacctagataccccttttccctccaggggctctacccaattggccctgagccctagatcccccaaggcgggggcagggcggtagtggcagaaaagacatcattaagaaattacagaggcctggggcggtggctcacgcctgtaatctcagcactttgtgaggctgaggcaggtgaatcacttgaagtcaggggttcgagaccagcctggccaacgtggtgaaactcatctctactaaaagtacaaaaattagtcgggtgtggtggtgggtgcctgtaatcccagctacttggacggctgaggcaggagaatcgcttgaaccggggaggcagaggttgcagtgagccgagcctacgccattgcactccagcctgggcaaccagagcaaaactccatctcaaaaaaaaaaaaaaagaaaaaaaaaaagaaaagaaaaggaaagaaattacagatagagaatacaatatctagaagacaaaagagggtcatgatggcttgtggctgacagagggagggaggaagggagggagaaagaggcttttctaaggacagtgagctgagacttgacaactaagatggggccagacatgaaagagaaaccaggggtgctgcacaggaggctggtggttttgaagcactgaggaggaaagcgatcaaggggagaggtggtgggggttggggggtaagtcacataggggctaggggctgtggacaggcacttgagcttatttagattgttattgttagattggggaggaaggattccaccagtaaggaggcaacaagaggtctaggcaagatatgggagttgacagctggtctaggctgttactggagaaactgggaagcaacagctgggtcaaagtagcttttcttttcttgtctttgtcttttcttttattttctttttaagacagggtctcgctctgtagcccaggctggagtgcagtggcacgatctcggctcactgcaacctctgcctcccgggttcaagtgattctcctgcctcagcctcccaagtagctgggattacaggtgtatgccaccatgcctggctaattgttgtgtatttttagtagagcagtgtttctccatgttggctaggctaaaaatagctttatttctgcctcgttttatgttcaggtcccccattagacagaggaaccaaggccagaatgaggcaggggcactggccaattgatctcccaagcacagtgaatctgaatggttgtagagttgtgtaatggatcccactgaggtgatcagggcccaaagcggagggtagatggccaggttttaacaaaagagggaatagtagttgaggctgagggtccaggaccagagccatggctttctgtatggtagagtcaagactttgggcaactgggggctgcagtctgggagcacaggagcaggaatttcagataaggaggaagaggaagaagaggaggaggagggttcatctctctggacacaggttcgcaccacaaatctcatccattgggttcttagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtcagtggggtgagggtcatgggtgggggctggcggtgggtgggacattagtgagtgagagatgttagggtaggtcatttggggggtggaggggaacagggccacaggggcggggtaatgggtattcttttctgagttaggccccagccctgtggaccatggttcccagcctcccttccccacctacccctaggtccgacgctactccttaacagtgacatcatccgggcacgcctgggggcctccgcactggataggtgtgtgttgcagaagggagtggggagggtggtgggtggggctggagcctcaaattctttcagacctgagctcaagttctcggcttccaaccacggagcctgcgtcttacccataggtcaatggggagattcgcagtggtgtgaatctgcccaccggagcacggacttccatggtggggctttgggtgtctaagttcctcccagcaacggagctatgtggtctcggggagcacactgaccccaggccaaccccaggatgacgctgcccccttcccaccctagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccaggtcggaagcccgtgccccctgatctcacccacctcggcccccgtcctttgccctcccgtgcctgcaccaggccacgtgcaccctcgccataggggtaggcgatcagggacccaggtgtggccaggtggtggtggggcggctggtgacctcagccgtccgtattccgcagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctggtgaggagcgggccggcccccaccttctaggggcgtggctggtgggcgaggcttgggagactggggcggggcctgggagggctgaggacaggctcgaaggtcagggtacccctgggggatccgccggaccccgccctcatgctcctgggtcgcgactatctcccccatcccagcatgagctctacgagaaggttttctccaggcgcgcggaccggcacagcgacttctcccgcttggcgagggtgctcacggggaacaccattgcccttgtgctaggcgggggcggggccaggtgagggcggggcttgctctctgggggcggggcctggatgtccgagggtggagcttcctgggagaaaccgtgggggcggggcctgggtgttcgagggtggagcttcccctccgggagagaccccgtgggtaggggcgggtcctttgttccttagcagtgcgggaggtgggaggaggtaggggcaggggagttcctgcaggtggggcctagcgggtcactggggcccattttcccggcaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaaggtgtgtgttgcgaggagggattgctgcaccccaggagtgccataaaacccgtggttccaacctaacctgatcccatgggggagcctccggggtcagggtgacccttcctgattaaatctatgatccccagctgtccggacttttatagataagcttctaggactctgggtaaccactttgggacctcctgtctactgaccctaacccataacccccaacgagagcacccagggcccttggtgaccaccttgtggatggccttgggtgaccacatcatccctaagtgttcctttttttttttttttttttttttttgagactgagtcttgctctgtcacccaggctggagtgcagtggcacaatctcggctcactgcaacctccacctcccaggttcaagtgatttatccgcctcagcctcatgagtagctgggattacaggcacgccccaccagcccggcaaatttttttgtattttagtagagatggggtttcaccatgttggctaggctgcttttgaactcctggcctcaagtgatctgcccgccttggcctccaaagtgctgggattaccagtgtgagccgctgcacctggcccctaagtgctgcttgctcaccccctattgatgaaccttatctgtgaccccatgtaactcctatttgaccctgtctggccccttgtccctagagcatgacttcggtgctggaacctgtgttggacctcacgtacccagtcacctccatgttcactgggtctgcctttaaccgcagcatccatcgggtcttccaggataagcagattgaggtaggcccacctcatcccctgccctgcctacccctccccggaggagccccctgctcctcccccacctcgatccctgtccccgcaggacctgtggctgccttacttcaacgtgaccacagatatcaccgcctcagccatgcgagtccacaaagatggtgggtgtccccgcccagcctgcagcaaccgctgacgtcacgtggggttggggggatgcttccgggagggccgctgagcttctgggacgttgttaacacgagtgaccgtccaccctggcccgatcaccgaccactaaccgccacccactaatgccccggagaccccaggtacgtccgtccttgggggaggggagcagggagactcgtcggacgccttacccccctcacgccatccccgcaggctgtgtgtggcgttacgtccgggccagcgcctcctactgcccctacctgcccccactgtgcgaccccaaggacgggcacctgctggtggacgggtgctacgttaacaacgtcccaggtcagcgagcccgtcaggccggctgggcctccggcgtgtctgagcgtgtctgtgcgtgtttgtgtctgtgtgtcccaccgcgcaggctccctgtggcggtacgtgcgcgccagcatgacgctgtcgggctacctgcccccgctgtgcgaccccaaggacgggcacctactcatggatggcggctacatcaacaatctgccaggcaagtggccgcccgcaccacccgcacacgcaagcacctcccgcaccacacacacacacacgcgtgggcacacacagacaggctcgatgacgggacacatgcccaagctgcccatgcaggggtgcagacacacatgcgcacacatacgatcacttgcacaaaatgatacatgaatgtgcctgtggacagcgacatgtgcagttgagatctacattctggccaggcgcggtggctcagcctggaatcccagcactttgggaggcctgaggtgggtggatcacctgaggtcaggagtttgagacccgcctggccaacatggtgaaaccccgtctctactaaaaatacaaaaaattaaccgggctggtggggtgcgcctgtaatcccagctactcaggaggctgaggcagataaatcacttgaacctgggaggtggaggttgcagtgagctgagatcatgctactgcactccagcctgggtgacagagcaagactcagtctccaaaaaaaaaaaaaaaaaaaagaaagaaatctacatctacctgctggcgtgctgtgttaagcacaagtggatgtacatacaagagggacaggtgcacacgtccacacacacatcaggggacatgcaggtggaatgcaacactcgtgtgcacaccagctatatacgcaaatgctttctctcaggggcaggtagggcttacacacacgtgtacacacaggcacatgtgcacagatgaacacgtgtgtcagtgaaatagggcatttgccaacgcatgccagtctgtcccgtttgtcctgcacgttccctcaaacacgcagggatgtgcacacacgtagataggatgtggcacctctgaccgagttaagtcatgcctaccacctttatgggtgcaggtgagaagcgggcaggtacacaacttaaaatctcacaccccagaagtgtgcatatatgaacagacatgtacaccaactgcacacatgctcacaatcttgtaggccaggggtgggcaaactatggcccacaggctgagtcctgccctctgtttgattgtataaataaagctttattgagctgggcacagtggctcatgcctgtaatcccagcactttgggaggctgaggcgggtggatcacttgaggtcaggaattcgaggccagcctggccaacatggtgaaacccggtttctactaaaaatacaaaaattagctgggcgtggtggtgtatgcctctaatcccagctactcgagaggctgaggcaagagagttgcttgaacccgggaggtggaggttgcatcgagcccagatcgcgccattgcactccagcctgggcgacagagtgagactctgtctcagaaaataaaacaaaacctcccaacacctgacccccctcctcaacttcagttgcatcatttgcacgcctgtgcatgacagcatggtgtttgcatgtgtgggtattctctctctcttttttttttgcgtgatcatttgcatgatggcatctgtgggactgggttgaacatctctgccccgggcccccaaggggagcagcccgctgacccccctggccccacagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgtgagtgggcaggagtggcatggtgcctgcataggtggtctggctaagctttgctacttaaagcccagagtggtatgagggggaggaatccaggaggaatccaggaatcccatctggaatctctggaaaacagatcagtgatcaattggtgatgtctgcaggggatgtagtaggggtgtggctgtgcatgtgctgtgtaagaactttctccttataggccagctgcacccctggaagcactgtatagtgatttctactgccatttctgcattggtgggaatgagaatagtgatgaagcagaaatgtctgccacagttccaggagagggaggtagcagtgcgtgtgttatgtgctactgaccctgaaaaatgtgccatagcccaagccaattgaaattgatcagggggccaggcatggtggctcatgcttgtaatcccagcaccttgggaagctgaggtgggaggattgcttgaaaccaggagttcaagaccagcctgtgcaacatagcaaaaccccatctctacaaagattaaaaataaaaaattagctgggtgtggttgtgcatgcctgtcaccccagctacttagggggctgaggtgggaggaccgctcgagcccaggagtttgaagctgcagtgagctatgattgcgtcactgcactccagcctgggtgacagagcaaaactctgtctctaagaaaaagaaagggccaggcatggtggctcatgcatttaatcccagcattttgggaggccgaggtgggcagatcacttgaagtcaggagttcaagaccagcctggtcaacatggtgaaacctcatctctactaaatatacaaaaattagctgggtgtggtggcacatgcctatagtcccagctacttgagaggctgcagcaggagaaatcgcttgaacctaggaggcagtggttgcagtgagccaagattgtgccactgcactccagcctgggtgacagagtgagactctgtctcaaaaaataatattaattttaaaaattaaagataaaaataataaaaatttttttaaaaagaaagaaattgatcagtagctgcagcccagaagccctgagtctgagaagagatgtgtgatgtcccttgtgggctcactgggatagcatgccatgagaaattcaagatgtttgctgtgggcttggggatggcgacatccacagatgtactgcctgtttgcagacttcaaaataagctcacacatcaccaccttgtgttatttgctacccagcaccctgcatggggctgtgtgggaaagaacatggagagattgattggtaatgtctgtcaagggcaggacaggggatgtgtaggcgagtgtgctatgtgcagctgactctgaaataggtttagtctcaaatgcaactcccccagagaatcaggcttttgaggggccagagaatgggcagacagagtggggacaagcaaagcagggttgcagacatggacccagcccctcatttcccacaggatgtgggctaccagtacgggaaggcggtgtttggaggctggagccgtggcaacgtcattgagaaaatgctcacagaccggcggtctacagaccttaatgagagccgccgtgcagacgtaagcctgtgatgcccccagggccactctgactccactgattacagaacccaagcccccttaaagtctccccgaaacctcagatgaccccacatgtccctgggttttgctgagctctcagacctctgctgacttcagagagttcccaccctaggatctcctctgagcccccaatgcaccactgggccccccaggggccccaagactctgtgggccccccctaagagcctcaccagtgtcaccccacaggtgcttgccttcccaagctctggcttcactgacttggcagagattgtgtcccggattgagccccccacgagctatgtctctgatggctgtgctgacggtgaggggcccaggggaccccccaagagggaggggagtggctggagatggcaggccagccccaatcccctcacctgtgccctgctccccgattccaggagaggagtcagattgtctgacagagtatgaggaggacgccggacccgactgctcgagggatgaaggggggtcccccgagggcgcaagccccagcactgcctccgagatggtgagagtgggtggcccagggtcccctcacatcccccagagggtcatgagtacagtgtcaggcaggggagccgggggcgtatttgagatcctgtgtgtgctgggtgctggctgacatgtgacgcatcagtgtcccgtgctgggtgacgtgtgtgtgaccttccctcgcaggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaatggc

SEQ ID NO: 7862 - DNA, 11845 bp, Homo sapiens
  misc_feature (2972)..(2972): n equals a,t,g, or c
aggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagtatgacagcccgaagttggagtgtgggtggcactcggaggaccccaacccgtgggagtggccagaaccccatccctcaacctcactcctggaagagcagaagggagcccccagatctggcctcccagcgccggtgtaggacggttttgaggccttcctctttcatcccaagtctgttcctgcaggatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggtgcagctcccaccgcgctgctcaggcccggcctaggggtggggacctgggggtggtcagaccttgctgacctccacgcccactcaggcagggcgaccgctccgactgcacttacatcgtgctcaatgggcggctgcgtagcgtgatccagcgaggcagtggcaagaaggagctggtgggcgagtacggccgcggcgacctcatcggcgtggtgagcgcgacccccacccactgacctctggccttttccaggccagtccctcgacaactcacacacatcatcccgggtaatccagggagtggtgaatgcagctcccgacctctgaggtcacccagtccactccccgcccagacctcatttcgttggaaaaaggggattccgcctgtcgtggatccctgtcctctccctctccccagagctctaatgggtagcgagcgaggcttgcttccctacacccccattgcaggggagccctagatggggcagtacagccccctttccacccatcttcggcctcctcattccccacccaagcagccccaatcatgcacgcggccccccaggtggaggcactgacccggcagccgcgagccacgacggtgcacgcggtgcgcgacacggagctggccaagcttcccgagggcaccttgggtcacatcaaacgccggtacccgcaggtgcggcctgttgtgggcggggcagagaggcggaggcgggactccgggggggtgggggccgggcctagtgtgtgggcggggcttacagaggggcggggtcgagggaggggccgaagcgagagagtgagggcgggggctctcgggggtgggacccaggtaacgggcacccaggagccccggcataggagggagaggtgggacctggacagccgcttcccaggtctcactgaaatgccggcctccaacgcccccaggtcgtgacccgccttatccacctactgagccagaaaattctagggaatttgcagcagctgcaaggacccttcccaggtgagagccggccggcccagagcgtgctgggagatgtagtccggcgtccagagcatgctgggagggaagccttctttcctgagggatgctgggaaatggagttccgcgaagaaatcgtgcccctgagggtttcaaaccctaagtaggacccaggtgcagagcattctggggaatggagttcgtgttcctgagcatgctgggaaacgaagtcctcgacccctggcgtgctagttaatgggctcgaaagtaaatcagtggtgccggggagggagtcttaggcggtggacttggcgtagtctgcccgggagtcagggcttgctggggaagtccacggcctggacgttgagagaaagggagtcctagatcagaatatgatggcagggccgtcatggtggctcatgcctgtaatctcagcactttgggaggctgaggcaggaggatcgcttgagcccaggagattgagtttgaaaccagcctgggcaacatagtaggacccccgtctctacaaaaatttcaaacattagctgggcttggtgacacatgcctgtagtctcagccactcaggaggctgaggcgggaggattgattgcttgagcccggaggtcgaggctgcagtgagccgtgatcgtgccactgtactccagccgggatgacagagctagaacctgtttcagaaaaaataaaacagcaaacaaacaaaactccccataccatgatggaaaatagtctgtggattgttgtttaggactctgggcacctcgccttctgaagttacagcttgctgggagatgtagccccctgtttcagcctgtggcttcagtgagctagaacagaatggggcgtgcggtggggttggaggcctgctgaaatgagggcctgagtttctacattgtggtggccagattctgggccagcccagcaacctagataccccttttccctccaggggttctacccaattggccctgagccctagatcccccaaggcgggggcagggcggtagtggcagaaaagacatcattaagaaattacagaggcctggggcggtggctcacgcctgtaatctcagcactttgtgaggctgaggcaggtgaatcacttgaggtcaggggttcgagaccagcctggccaacgtggtgaaactcatctctactaaaagtacaaaaattagtcgggtgtggtggtgggtgcctgtaatcccagctacttggacggctgaggcaggagaatcgcttgaaccggggaggcagaggttgcagtgagccgagcctacgccattgcactccagcctgggcaaccagagcaaaactccatctcaaaaaaaaaaaaagaaagaaaaaaaaaagaaaagaaaaggaaagaaattacagatagagaatacaatatctagaagacaaaagagggtcatcttgccgtgtggctgaaagagggagggagnaagggagggagaaagaggcttttctaaggacagtgagctgagacttgacaactaagatggggccagacatgaaagagaaaccaggggtgctgcacaggaggctggtggttttgaagcactgaggaggaaagcgatcaaggggagaggtgatgggggttggggggtaagtcacataggggctaggggctgtggacaggcacttgagcttatttagattgttattgttagattggggaggaaggattccaccagtaaggaggcaacaagaggtctaggcaagatatgggagttgacagctggtctaggctgttagtggagaaactgggaagcaacagctgggtcaaaagtagcttttcttttcttgtctttgtcttttcttttattttctttttaagacagggtctcgctctgtagcccaggctggagtgcagtggcacgatctcggctcactgcaacctctgcctcccaggttcaagtgattctcctgcctcagcctcccaagtagctgggattacaggtgtatgccaccatgcctggctaattgttgtgtatttttagtagagcagtgtttctccatgttggctaggctaaaaatagctttatttctgcctcgttttatgttcagttcccccattagacagaggaaccaaggccagaatgaggcaggggcactggccaattgatctcccaagcacagtgaatctgaatggttgtagagttgtgtaatggatcccactgaggtgatcagggcccaaagtggagggtagatggccaggttttaacaaaagagggaatagtagttgaggctgagggtccaggaccagagccatggctttctgtatggtagagtcaagactttgggcaactgggggctgcagtctgggagcacaggagcaagaatttcagataaggaggaagaggaagaagaggaggaggagggttcatctctctggacacaggttcgcaccacaaatctcatccattgggttcttagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtcagtggggtgagggtcatgggtgggggctggcggtgggtgggacattagtgagtgagagatgttagggtaggtcatttggggggtggaggggaacagggccacaggggcggggtaatgggtattcttttctgagttaggccccagccctgtggaccatggttcccagcctcccttccccacctacccctaggtccgacgctactccttaacagtgacatcatccgggcacgcctgggggcctccgcactggataggtgtgtgttgcagaagggagtggggagggtggtgggtggggctggagcctcaaattctttcagacctgagttcaagttctcggcttccaaccacggagcctgcgtcttacccataggtcaatggggagattcgcagtggtgtgaatctgcccaccggagcacggacttccatggtggggctttgggtgtctaagttcctcccagcaacggagctatgtggtctcggggagcacactgaccccaggccaaccccaggatgacgctgcccccttcccaccctagcatccaagagttccggctgtcagggtggctggcccagcaggaggatgcacaccgtatcgtactctaccagacggacgcctcactgacgccctggaccgtgcgctgcctgcgacaggccgactgcatcctcattgtgggcctgggggaccaggagcctaccctcggccaggtcggaagcccgtgccccctgatctcacccacctcggcccccgtcctttgccctcccgtgcctgcaccaggccacgtgcaccctcgccataggggtaggcgatcagggacccaggtgtggccaggtggtggtggggcggctggtgacctccgccgtccgtattccgcagctggagcagatgctggagaacacggctgtgcgcgcccttaagcagctagtcctgctccaccgagaggagggcgcgggcccacgcgcaccgtggagtggctaaatatgcgcagctggtgctcggggcactgcacctgcgctgtccgcgccgcctcttttcgcgccgcagccctgccaagctggtgaggagcgggccggcccccaccttctaggggcgtggctggtgggcgaggcttgggagactggggcggggcctgggagggctgaggacaggctcgaaggtcagggtacccctgggatccgccggaccccgccctcatgctcctgggtcgcggctatctcccccatcccagcatgagctctacgagaaggttttctccaggcgcgcggaccggcacagcgacttctcccgcttggcgagggtgctcacggggaacaccattgcccttgtgctaggcgggggcggggcaaggtgagggcggggcttgctctctgggggcggggcctggatgtccgagggtggagcttcctgggagaaaccgtgggggcggggcctgggtgttcgagggtggagcttcccctccgggagagaccccgtgggtaggggcgggtcctttgttccttagcagtgcgggaggtgggaggaggtaggggcaggggagttcctgcaggtggggcctagcgggtcactggggcccattttcccggcaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaaggtgtgtgttgcgaggagggattgctgcaccccaggagtgccataaaacccgtggttccaacctaacctgatcccatgggggagcctccggggtcagggtgacccttcctgattaaatctatgatccccagctgtccggacttttatagataagcttctaggactctgggtaaccactttgggacctcctgtctactgaccctaacccataacccccaacgagagcacccagggcccttggtgaccaccttgtggatggccttgggtgaccacatcatccctaagtgttcctttttttttttttttttttttttgagactgagtcttgctctgtcacccaggctggagtgcagtggcacaatctcggctcactgcaacctccacctcccaggttcaagtgatttatccgcctcagcctcatgagtagctgggattacaggcacgccccaccagcccggcaaatttttttgtattttagtagagatggggtttcaccatgttggctaggctgcttttgaactcctggcctcaagtgatctgcccgccttggcctccaaagtgctgggattaccagtgtgagctgctgcacctggcccctaagtgctgcttgctcaccccctattgatgaaccttatctgtgaccccatgtaactcctatttgaccctgtctggccccttgtccctagagcatgacttcggtgctggaacctgtgttggacctcacgtacccagtcacctccatgttcactgggtctgcctttaaccgcagcatccatcgggtcttccaggataagcagattgaggtaggcccacctcatcccctgccctgcctacccctccccggaggagccccctgctcctcccccacctcgatccctgtccccgcaggacctgtggctgccttacttcaacgtgaccacagatatcaccgcctcagccatgcgagtccacaaagatggtgggtgtccccgcccagcctgcagcaaccgctgacgccacgtggggttggggggatgcttccgggagggccgctgagcttctgggacgttgttaacacgagtgaccgtccaccctggcccgatcaccgaccactaaccgccacccactaatgccccggagaccccaggtacgtccgtccttgggggaggggagcagggagactcgtcggacgccttacccccctcacgccatccccgcaggctgtgtgtggcgttacgtccgggccagcgcctcctactgcccctacctgcccccactgtgcgaccccaaggacgggcacctgctggtggacgggtgctacgttaacaacgtcccaggtcagcgagcccgtcgggccggctgggcctccggcgtgtctgagcgtgtctgtgcgtgtttgtgtctgtgtgtcccaccgcgcaggctccctgtggcggtacgtgcgcgccagcatgacgctgtcgggctacctgcccccgctgtgcgaccccaaggacgggcacctactcatggatggcggctacatcaacaatctgccaggcaagtggccgcccgcaccacccgcacacgcaagcacctcccgcaccacacacacgcacacgcgtgggcacacacagacaggctcgatgacgggacacatgcccaagctgcccatgcaggggtgcagacacacatgcgcacacatacgatcacttgcacaaaatgatacatgaatgtgcctgtggacagcgacatgtgcagttgagatctacattctggccaggcgcggtggctcagcctggaatcccagcactttgggaggcctgaggtgggtggatcacctgaggtcaggagtttgagacccgcctggccaacatggtgaaaccccgtctctactaaaaatacaaaaaattaaccaggctggtggggtgtgcctgtaatcccagctactcaggaggctgaggcagataaatcacttgaacctgggagttggaggttgcagtgagctgagatcatgctactgcactccagcctgggcgacagagcaagactcagtctcaaaaaaaaaaaaaagaaagaagaaatctacatctacctgctgcgtgctgtgtttagcacaagtgatgtacgtacaagaggacaggtgcacacgtccacacacacatcaggggacatgcaggtgaatgcaacactcgtgtgcacaccagctatatatgcacatgctttctctcaggggcaggtagggcttacacacacgtgtacacacaggcacatgtgcacagatgaacacgtgtgtcagtgaaatagggcatttgccaacgcatgccagtctgtcccgtttgtcctgcacgttccctcaaacacgcagggatgtgcacacacgtagataggatgcggcacctctgaccgagttaagtcatgcctaccacctttatgggtgcaggtgagaagcgggcaggtacacaacttaaaatctcacaccccagaagtgtgcatatatgaacagacatgtacgccaactgcacacatgctcacaatcttgtaggccaggggtgggcaaactatggcccacaggctgagtcctgccctctgtttgattgtataaataaagctttattgagctgggcacagtggctcatgcctgtaatcccagcactttgggaggctgaggcgggtggatcacttgaggtcaggaattcgaggccagcctggccaacatggtgaaacccggtttctactaaaaatacaaaaattagctgggcgtggtggtgtatgcctctaatcccagctacttgagaggctgaggcaagagagttgcttgaacccgggaggtggaggttgcatcgagcccagatcgtgccattgcactccagcctgggcgacagagtgagactctgtctcagaaaataaaacaaaacctcccaacacctgacccccctcctcaacttcagttgcatcatttgcacgtctgtgcatgacagcatggtgtttgcatgtgtgggtattctctctttttttttgcgtgatcatttgcatgatggcatctgtgggactgggttgaacatctctgccccgggcccccgaggggagcagcccgctgacccccctggccccacagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgtgagtgggcaggagtggcatggtgcctgcataggtggtccagctaagctttgctacttaaagcccagagtggtatgagggggaggaatccaggaggaatccaggaatcccatctggaatctctggaaaacagatcagtgatcaattggtgatgtctgcaggggatgtagtaggggtgtggctgtgcatgtgctgtgtaagaactttctccttataggccagctgcacccctggaagcactgtatagtgatttctactgccatttctgcattggtgggaatgagaatagtgatgaagtagaaatgtctgccacagttccaggagagggaggtagcagtgtgtgtgttatgtgccactgaccctgaaaaatgtgccatagcccaagccaattgaaattgatcagggggccaggcatggtggctcatgcctgtaatcccagcaccttgggaagctgaggtgggaggattgcttgaaaccaggagttcaagaccagcctgtgcaacatagcaaaaccccatctctacaaagattaaaaataaaaaattagctgggtgtggttgtgcatgcctgtcaccccagctacttagggggctgaggtgggaggaccgctcgagcccaggagtttgaagctgcagtgagctatgattgcgtcactgcactccagcctgggtgacagagcaaaactctgtctctaagaaaaagaaagggccaggcatggtggctcatgcatttaatcccagcattttgggaggccgaggtgggcagatcacttgaagtcaggagttcaagaccagcctggtcaacatggtgaaacctcatctctactaaatatacaaaaattagctgggtgtggtggcacatgcctatagtcccagctacttgagaggctgcagcaggagaaatcgcttgaacctaggaggcagtggttgcagtgagccaagattgtgccactgcactccagcctgggtgacagagtgagactctgtctcaaaaaataatattaattttaaaaattaaagataaaaatattaaaaatttttttaaaaagaaagaaattgatcagtagctgcagcccagaagccctgagtctgagaagagatgtgtgatgtcccttgtgggctcactgggatagcatgccatgagaaattcaagatgtttgctgtgggcttggggatggcgacatccacagatgtactgcctgtttgcagacttcaaaataagctcacacatcaccaccttgtgttatttgctacccagcaccctgcatggggctgtgtgggaaagaacatggagagattgattggtaatgtctgtcaagggcaggacaggggatgtgtaggcgagtgtgctatgtgcagctgactctgaaataggtttagtctcaaatgcaactcccccagagaatcaggcttttgaggggccagagaatgggcagacagagtggggacaagcaaagcagggttgcagacatggacccagcccctcatttcccacaggatgtgggctaccagtacgggaaggcggtgtttggaggctggagccgtggcaacgtcattgagaaaatgctcacagaccggcggtctacagaccttaatgagagccgccgtgcagacgtaagcctgtgatgcccccaggggcactctgactccactgattacagaacccaagcccccttaaagtctccccgaaacctcagatgaccccacatgtccctgggttttgctgagctctcagacctctgctgacttcagagagttcccaccctaggatctcctctgagcccccaatgcaccactgggccccccaggggccccaagactctgtgggccccccctaagagcctcaccagtgtcaccccacaggtgcttgccttcccaagctctggcttcactgacttggcagagattgtgtcccggattgagccccccacgagctatgtctctgatggctgtgctgacggtgaggggcccaggggacccccaagagggaggggagtggctggagatggcaggccagccccaatcccctcatctgtgccctgctccccgattccaggagaggagtcagattgtctgacagagtatgaggaggacgccggacccgactgctcgagggatgaaggggggtcccccgagggcgcaagccccagcactgcctccgagatggtgagagtgggtggcccagggtcccctcacatcccccagagggtcatgagtacagtgtcaggcaggggagccgggggcgtatttgagatcctgtgtgtgctgggtgctggctgacatgtgacgcatcagtgtcccgtgctgggtgacgtgtgtgtgaccttccctcgcaggaggaggagaagtcgattctccggcaacgacgcttgtctgccccaggagccgcccggtcagccacagatgcctgaggacctcgacaggggtcacccctccctcccacccctggactgggctgggggtggccccgtggggtagctcactccccctcctgctgctatgcctgtgacccccgcggcccacacactggactgacctgccctgagcggggatgcagtgttgcactgatgacttgaccagcccctcccccaataaactcgcctcttggaaatggc

SEQ ID NO: 7863 - DNA, 715 bp, Homo sapiens
atgtaaaaaaatttttctttttcttttttttttttttgagacggagtctcgctcagtcgcccaggctggagtgcagtggcgcgatctcggctcactgcaagctcctcctcccgggttcacgccattctcctgcctcagactcccaagtagctgggactacaggcgcccggcaccacgcccggctaattttttgtacttttagtagagacgtggtttcaccgtgttagccaggatggtctcgatctcctgacctcgtgatccgcctgcctcaggcctcccaaagtgttgggattacaggcatgagccatcgcgcccggctaaaaaaaatttttatatttatttatatttatatatagatggtgcttatatccaaagtctttattctctccttcatgtttctttcttttctttttttttttctgagacagagtctcgctctgtcgcccacgctggagtgcagtggcgcgatctcggctcattgcaagctccgcctcccgggttcacgccattctcctgcctcagcctcccaagtagctgggactacaggcgcccgccaccacacccggctaattttttgtattttcagtagagacggggtttcaccgtattagccaggatggtctcgatctcctgacctcttgatccgcctgcctcggcctcccaaagttctgggattacaggcgtgagccaccgtgcctggccttcttcttcttct

SEQ ID NO: 7864 - DNA, 266 bp, Homo sapiens
tgcgacctccatctcccgggttcaagcgattctcctgcctcagcctcctgagtagctgggattacaggcgcccgccaccacacccagctaaattttgtgggggggttttttggttttgttttgttttttgttttaatttttgagacagtgtctctctctgtcacctaggctggagtgcagtgatgcgatctcagcttattgcagcctccagctcttggattcaagtgattctcatgcctcagccttccaagtagctggggccacag

SEQ ID NO: 7865 - DNA, 311 bp, Homo sapiens
catgtttcttttttttcttttttttttttgagacggagtctcgctctgtcgcccacgctggagtgcagtggcgcgatcttggctcattgcaagctccgcctcccggtttcacgccattctcctgcctcagcctcccaagtagctgggactacaggcgcccgccaccacacccggctaattttttgtattttcagtagagacggggtttcactgtattagccaggatggtctcgatctcctgacctcttgatccgcctgcctcggcctcccaaagttctgggattacaggcgtgagccaccgcgcctggcct

SEQ ID NO: 7866 - DNA, 266 bp, Homo sapiens; identical to SEQ ID NO: 7864

SEQ ID NO: 7867 - DNA, 2162 bp, Homo sapiens
ccgctcccaggtccccatcatcctccagtggaataaaagctctaagaagtttgtcccccatggtgacatccccaacatggaggacgtactggctgtgaagagcttccgaatgcaaaataccctctacctttcccttacccgcttcatcggggactcccgggtcatgaggtggaacagtaagcagtttgtggagatccaagctcttccatcccggggggccatgaccctgcagcccttttcttttaaagataatcactacctggccctggggagtgactatacattctctcagatataccagtgggataaagagaagcagctattcaaaaagtttaaggagatttatgtgcaggcgcctcgttcattcacagctgtctccaccgacaggagagatttcttttttgcatccagtttcaaagggaaaacaaagatttttgaacatataattgttgacttaagtttgtgaaggtgtggtgggtgaaactaagagaaatgtagcattagctctcacaaaagaggaccaagaaaaatcaacaaacaaatcaaagccaggctcagagctctgaaattaaaaagcactgaaatagttagatgttttcaaacttttagaactcacattttaatcagggattgcatttattggctaactgcatgacatgcccattctaccatttaaaaaaaaatcttaaagcctgtaatttctgagaaaagagtacagcatttactcttatcatctagaaatgtaatatgcttccccccctctttttgatgaggaagaagaaaattggataagatgggacagcacttataatgaaataaaaaaaactttgagcccctctcattccactttagcaatctttttggtaagaactcttaaagccaaaagtctgctgaaaagatttgctgattattagtttaaaaatcttgtaacactcagcagtgctattttgagtcatcccagtttcctgaaagtaatgcccagtcttcctgaatcctccttaatagcagaaccttggtgattttgttggctcatatgaatgcttgtcatggatatgttaacaatttagtgtttgacattgcttcctctgccacaaagacaatactctggtgacacatgtctagacccagcacaggctgtaggcccaggagcgactcaaaggagtttttccctctttcttacggttcaaaggtgaccctggtggtggccagagcagtaatgcttgtttgatgctcttcatggctcatctgcttctcggaacccacccgttgagtttgtgggtaaccagcaggcaggccaaagactggtgcttttcatttcatcctttagagggatgaaacagttatttccgtctgatgagcattcggtagaatttttgaagtgagattttatgaagtcaaaggggactttacacagatctcgacctgctttgaaacctagaggtggccctttgatttgtgcgtgtccttgccctctggacaacttaatatttcaagtaatcgaataccaacttccctgccagcccacctgccttctgccccgcttgtgtaacagtcctgttttgttgagttgctgctattgcactgccagtgcagcccacaccaaatcacaacccaagatactcagataggaagactccttcctctcccagtactttaccaaaggaacccccccgcccaggacccacatggggccacgtgttggcagtggaatcagcctgtgcaggctggggatctcaggctgatcagtaggggccagctttggagccagccaagctgaatcccacactccaggtctgtgctcaagagaccagatggtgtatttccaaatgggcctctctggtatgggcaataggcaagctcctggggtctggttatgtggaagattcttagtggatgttccgcctggttagctggttctcttcagagaatataaagtgaatgcctttaggggtagctctgaaagagaaacccaacaacttcattcctagccatgaaagtagcacgatcatattgtactgtattgttattgtaaaatgattatttgccatgtcatgagtaggtagatgttttgccacaaatatgaatgtgtttgttgtttcctgactttaagcaatgaagattgagacaataaatagcactcagagaatgaagcattgatgtta

SEQ ID NO: 7868 - DNA, 277 bp, Homo sapiens
tggcttataagcaacagaaatttatttctcatagttctgggcctgggaagtccaagatcaagacattggcagatttggtatgtggcaagaacccactgcatagctggccacctctttgctgtgtctatgtggtgaaagggcagagggagttggaaggcactaatcccattcctgaggactctgctcccatgacctaatcacctcccaaaggccccaccaccaaataccatcacattggagatgaggtttcatcatatgcatttggagagagcacaaa

SEQ ID NO: 7869 - DNA, 369 bp, Homo sapiens
ttttatacaagactaaagcctgtagtctacagagcgcctgtgctgtggaaggagatatttgttctggccaacttactaaaggagcatagatgttcttggcacggggtggtgatatctttgcttcattaatcttactgctccatcccaagaatccctgaagttttaaacaacttctgcaagaagcattcttccagtagtaatgtaaaacaaaaaaccaaccaagcaacagcaaaaatgcaaagcagagaaatatgtggaccgtccccagtggagatcagcttgaaggagggggtggatctttcttctactttccctcccatcacccactgggtggtcgtctgctcagcttatttcttctttatgaacttt

SEQ ID NO: 7870 - DNA, 2162 bp, Homo sapiens; identical to SEQ ID NO: 7867

SEQ ID NO: 7871 - DNA, 277 bp, Homo sapiens; identical to SEQ ID NO: 7868

SEQ ID NO: 7872 - DNA, 369 bp, Homo sapiens; identical to SEQ ID NO: 7869

SEQ ID NO: 7873 - DNA, 19286 bp, Homo sapiens
gccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaagtgagtcctgtagggaagccctattgaggccgggacggaacagatcccccttccccacacccgtgcggtcgggcgcccgccggccaaccctgaccggccccctgcagaacgcggcccgtgcccccggcccttctcgagtatccccacgcgtccggggtgcggccggctcccctggcccctgctctcactcgtcgtgggcagaaggcgtccctgggtagcgcggaaggttacttctctgtgtcccaactcttcctgttttgtttctcccatcaaagtcaaatttctggaagtcatcaagcccttctgtgtcatcctgccggaaattcagaagccagagaggaaggtaagtaccccaaatcgccaacaaagaaggtttcaggaaactgtctggactctggaagtttacagtatgattaaaaatggcttcagcacggcaatggaaactctcccttctcttcccttggagtgtagttgtgctctgttattccggagagctgtcgaaaggtgacctggttgtgtggaaatttccactgaaatcactgtgctttatttggagcatctttggtggatgttgctccgagaacaaagcctccggttgccctgtcccaaaaatggatccgggccatgaatgaataaggcctcagttaggatagcagattgagttaccctccctttttcacctccaacgggagcagatcacgggttggttttttttcccaggagatgccctttgtatccagctgctaaagggaagggctgtcactttagtatttacaaatgattttgtaccttttatgtaggctgtcacaatagggggaataaaggctattcttttgtgaagtctgctgcttttcacagacggtgtattaaaacaaggaaagattaaatttagagctgtgctgaatcagaaattgtgtggagtgagtgttgccagtgtaactacagctgtcaacgaaaaaaagtttcattaggttcctaggttagagagtggggaataaaatgtttgtgtcctcacattatttttcaaactgttgttaaagcattcacatggacacttgggtgcttggaatccactttcatttttttacgtaaaatagtttcatataaatgcccatgtgctgcttttaatggacgaatttgtaaagctttaccccctcaattccagtgtagcgaaggggcatggctctggaggcaggcaagcctaggtcccaccctttacatagcaccttaatagctatgtgaccttggccttgtaactcagtgtggtagacggaacaagggaaatacgtgcaaggtatagcagtggctcaggaagggattaactctgggagacatgatgtcttatggtggttttgaaggagaaatagaagtctccttgaagggacggaaaggaattccaaataaaaggagtatatagtttgcaaaggcattggtgacaagagtgtagcatgtttggatgggaggttattagatgtagttgctattgatagaacataattgtaggtggggaacattaggagatgaataacaagggccagacatgagaatgtcactttggaagaaaaggagaggactagagttggtttagaggcttttcacatcagaggatgaactgtggtactgagcaagaatggatttaggggctactaagaagcagaggagacaggacttggataaagagcttttggggttttgatgttaaatttgattgtaaccaggagagaggacttggtgattagaaagggagttttgaaaaaattgtctgctctttgtttcccatcaagattcatttcagacaggttactctgaaatggcgttgccttctcttggccactttctaatttcttagtgtggtgggatggtaggtgggaagaggaccattctcaagagaagaagagtcctgtgaatgcccccagctttggatggagtatctgaacactgattcacccactgttgtgtggccgtatgactgtgtcctactttgcctgcatgtatagttagaggactgtgactccagttctggccagagggccaggaatgctgactcagtgcctgcctagaagtgtttttaaagaacacagttttgtcacttaatactgtcagtctctcacaaggtatttcaacctcagaatcttccgtctgtacaataattaatgtttgttaagccctctaaagccattaatgtagtgtaggcagcaggtattagtgaagacactcagtttcagaggcagaaaacctggaagagttcccactctactctttagtgacagaggttttgggtgggaggttttctaatgatacttaatacttaatagtcatctttacagtgattcttgtcacctatgcaacctatgtacctgagaagatgtgaaaatccttaaacaaatgttactagtaggttaaacatgcaactctcctgcccttccccaatatggtttattacactgttttacccttaattcatagaaaatacactattgagcaattccaaattacttgactctagaataacaaggttttgtgactgaaactcaaatgaaaagtggttgctcgtgtgttttacaagtcatgttctattgtgacattctttgttcttgagtcttaactgttaatgctaatggttaaaagcacagtttgggactcaaactcactttagcattggggtttggtacaaattatttagctcttctaaggctcagttgtaaaataaaggtaatgctctgtggtgtgaggtgagctggggtgatgcctgtaggtccttgcattgtgctctgtgcagaggaagttacgcagtacatggtacttatgtttggtacatggtttggcttctctgctgaacagagaaaagagtctggttggagtccatttttagagaaaggggtctgattggagtccatttttattaatttgcttttcaaagtaactccctgcttcaattcattctctcctactctagattcagtttaaggagaaagtgctgtggaccgctatcaccctctttatcttcttagtgtgctgccaggtaagctcaggcttgtatttcgtattggggagggggataagagtggctggaaacaggagtgctgactgttttgctctttgcctgttcccagattcccctgtttgggatcatgtcttcagattcagctgaccctttctattggatgagagtgattctagcctctaacagaggtaggactctggctctgtcttttctctgtagagtgtaggcttacctagcttcacttagttaaattaataggctttggctttatatggaacttagagagtgacttggaaaatagagtgaagaatgttaaagtgctgtgttgaatagccttattaaatgctgagttcagcaccaaggcataccatcatatttggaattgtatttgaatgcagtacaaaacctgtaatgagaagataagtctatgctatagagagaataaaaaacatggaaaaactagaatactttttgaatacctgaaatgatgacatttccattgataacattcttcagaatatgtaatttgtttttcagctgtatctttttcatatctataggttacatatagtgtcaaaaaatatgtaacagtgttttatatcctctaaccagttacttatgggactggggaggattctgaatgtgtaggttgatactgcatttgattaactcatttaaaaaatatagttcaattaaattccaaatcagttggaagtgtagctcattttaacataatgggaagtagaggcttattcacaactagatacaattgtacaggctccttttccagactctggaaattatttgaatgttatcctttttttattaactgatgaagagacgaacatttcttatctctaaaaccagaatgaatctgtttatggtgaatttaaatgcagcagtctgtttagacaccatgtgacttcctaaacagaataagctgttgcctggcaggctgaacagaatgaattgaattatatactaatcgttgatattttggggttctaaattaaacacagctaggaaactgaaacacattggttttatataaggggtacccagtcaaattttgcgtattcatttttaaaataacgtactacgtttccaagctgatattgactgttttgcttccccgtttcctcaaggcacattgatggagctagggatctctcctattgtcacgtctggccttataatgcaactcttggctggcgccaagataattgaagttggtgacaccccaaaagaccgagctctcttcaacggagcccaaaagtgtaagaaagattgtgaataatctgatgtctatagttggaaaatttgaatttgctataagattttggtatcagtttttctttttttatttattttttatttttttttttttttttgagatggagtcttactctgttgcccaggctggagtgcagtgacgcagtcttggctcactgcaacctccacctcccaggttcaagcaattctgcctcagcttcccgagtagctgggattacaggcacgtgccaccacacccagctaatttttgtatttttagtggagacgggatttcactacataggccatgctggtcttgaactcctgatcttgtgatccacccgcctcggcctcccaaagtgctgggattataggcgtgagccaccatgcccagcccaaacagtattttcttttgtgctgcaacctccttggcctgccaaccctgcaggagctccatgccctgtgttagcgtgagagagcacttctggtagagcagaggtggtgggtgctggggatgggctgggcaaggcaggggagagtgtctggagtgcccctgaggccatgtaatggaggagaaggatcagagcttggaggtcttagcacccttggccaccatttcattattgcttaaaaggaagtaatggctacttcagagctgtcataaggattaaataatcactgtcacaatgcctggcacatagtagttatttggcaagtgttttataaaagaatttaactgactggggggcggtggctcacgcctgtaacccccagcactttgggaggctgaggcgggcggatcatctgaggtcaggagtttgagaccaacctggccaacatggtgaaaccccatctctactaaaaaaatacaaaaattagccaggcgtggtgacaaggtgccttaatcccagctacttgagaggcagaggcaggagaattgtttgaacccaggaggcagaggttgcagtgagccgagataaagccattgcactcaaacatgggggacagagcaagacttctctcaaaaaaaaaaaagaatttaactgaagaaaaggtgatcctgtcagtccagctgtataatttaccagctctgtgatctggggaaaagttagatgatagctcttatgtttcactttcttcatctgtaaaaatggggataataatggtatttgcctcatatctaataagtgttactagtaacaattactagtcatcaaaattagccatatttagcctctgtttgctgaaaaacattaattaggaaatgatatttacagtctcctatccagtcatcttttcgcctacaccagcatgttttacaggtcttaaattagtatggtggataattgaatgagaaatacgtctatttttttttttttttttttttttttgagacggagtctcactctgtcgcccaggctggagtgcagtggcgtgatcttggttcactgcaagctccgcttcctgggttcaagccattctcctgcctcagcctcccaagtagctgggactacaggtgcccgccaccacgcccagctaattttttgtatttttagtaaagacggggtttcactgtgttagtcaggatggtctcagtctcgatctcctgacttcgtgatccgcccgcctcaggctcccaaagtgctgggattacaggcgtgagccacagcgcccagccaagaaatacatctatttaaacttgtcagttttagataaaaattaggattctaaaatacacacatgtggctgggagcggtggctcatacttgtatcccagcactttgggaggccaaggcaggatgattgcttgaggccaggagttcgtgactagcctgggtaacacagtgagagagaccccatctctacaaaacaacaacaacaaattagccaagtgtggtgatgcacctgtagttctagctactagggaggctgaggtgggaggatcacttaagcccaggagtttgaggctgctagtgcaccactgcactcctgcccgggcaacagagcctgtctcttaaaacaaaacaaaaaacactaagaaaacaaaaaaagtacaagcacaaattggctgttttctctttggtcttcacaatgttttgaatgttttcctgcattaagaactaattgttgtggagcactttttaaaaagtcaaatagggactgtatttgatggccactttggagtaaaattaattttacatgacagattaaataggaaagctgaaactgaaggtcagactgtacttagaggacccatctagtactgtggaacttgtcaaatgtgtccattcccttgtgcctaacagtgaaatagagtgagttgtaagaaatgaagacaccctacaaaaaggaaagcttttgccaggcgtggctcatgtctgtaatccccgcactttgggaggctgaggtgggtggatcacgaggtcaggagttggagaccatcctggctaacacagtgaaaccctgtctacactaaaaatacaaaaaattagctggctgtggtggcacgtgcctgtaatcctagctactccagaggctgaggcaggaaaatcgcttgaacctgggaggtggaggttgcagtgagccaagatcatgccaccgtactccagcctgggcgacagagactccgtctcaaaaaaaaaaaaaaggaaagcttctattagaccaaaatagcttggtacctaagggaatgggaagagcagccaaatcaatggtacgtggggttttccttttaaaagcacattaaataaaaacttgagaagggatcactttaccccagagctaataattctgtcctctggacccagacctggatggtgagcctagagaggtggcccaaatctgtagttcagctcttgagccatcgagaccccaagtgcctgacattgagtttgggtgctgcaggtgtgacatctccagattgtgtctccggatgctgtcaggagtaggttctactccctgattttctttgaatagaacaaattttccaagtttcacttttactcctcccatgactaaaaagcaagtgaatctaggaaaaggtaaaactaaagaagaagtgtgcttttgttaaaaggcttttgattcatcatgtactttgctgatgtgatggtttagcgcgttctcagccgagccccttggaggtagtatcactgctcttcatctttgttctcccccgtgcctggcgttgaattggtgtttcttaattgtttcttttgttctgtgtagtgacccacttggaaaacacttctttctttcaattctagtatttggcatgatcattactatcggccagtctatcgtgtatgtgatgaccgggatgtatggggacccttctgaaatgggtgctggaatttgcctgctaatcaccattcaggtaattattatgctaacatctccctttgagtagcccctcacacttacctacaattctcacataacgaatctcaagcacacctaaaaggaactcctactgaaaggaagcagaagcctaagactctgggttagccctctgaattcagcagagaaaggctttactgaccgctctctggggctgaggatgtgatctcattccgtcttcagcgtttatatcagagaacccaattactgaaggacggaaccatgtccgtggggagcagtaacacatagtcttgtatttttgaatttttacagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggtaagggccctgtgctcccctggtggcgacagctttcagcaaaaacaattgagcaatgcaaagcagaagacaaaaatccccccattccacagaaaaataatgtcagttttaggtttatctcttctggtgtttgggtccatctgcaaagttttaaaaacacaaataggcttgtaattatgatgatacctaacttgcacttttcatataaaaatatctcctggacgtttggcacgtcagaatacacaatcctgcctcacttttcttagcacagtataagcttatattgcaacgataaagcaacgttaagtcatttccaggtttttttatcgttaacattgaaaccatgactgtcctcatatgttcatctttgtatattttggcagctgctctcagtgaataagtttctaaaaatgaaattcctaaaccaaagcacttggtcatgcaaggggcagctttctgaaaaaggcctgaacttggagcttagcacctgcgttcaaatcctggctgttcctgttagtcatacatacgtggctttgggcagattcctgcaccactgaatcttggttaccaggatgcagtgagaagcaacatgaaattacatgatgcctggctcctggtagatgtgtatcaaacattggcatgctgtgctacatccaccaagtgccgtggaaatcttgtaacagcatgtttttaataaaaagttcaaaacatacaagggaagccttagagagtgtgacttattagggaaaggaaataaacattttttggcactaaatatcttcttcactgaggagcattccaggagaaataatcatgcatatttgagagttttcttttaattgaatgttggaaacagagtccttggcctccagagaccatattatctcattaatgagatggaaaactggtccccaaacaagtgaaggctgcatgtgcctaacaggttacaaaggagagtggagcttgagatagggagccatagagaagagtgggcaagatcacatttgatgcttccttgagtactttgtataaatttaggaaatccaaggtaaattgggagaagcaggtccagaaggcaaagtttgacaggatgtgaaaaggcaagagggggatggcattgtaggagttcaggtatttgtcaagaccatcatggtgactggcttttggggagtgcctgagtgggaaggaagtaaagtcagaggggagcccctggtggcttagcagcccagtagtagccgccagaggctcatgttccattctgcagcagggcattgagtaatgggagccagagtttggaagaagtgatttgctctgcactgaaaggcagagagagcagctaggtgcgtgcagcagtaatccagccccaattaagccatcctacaggagagcactgtgtgagggcatttggaggaagcaagttgagagaggggaccagagaggcactttcaaggtgggggaaaactaagaagcaaaggtggatttgtctggccttgaagtcagtgtgtctacatgtcagttgctcgtgtttgggacctggctgacacgagatgcattcaggaagggctgtgccccatggcctgcatgtgggcagtgagtggtgctagagggagagcctagggaggggcagggagagccacacagagggcacagctgggacggcagctttgcagctgtgcctggagatgttgcagcttggcttgggacaggggaggctgttgaatgagattctacaggcagagacagtaatcactgctgcttccctgggcagcaggaacaatgcagaactgggaattagtcccaaatttgaaaccgtggggaaacaggccagccttgtcacacaggaccaaaaggtggaaaggatgggaattgacgaaagaccgccacagggtgagatgaggacatgatggccagttaggatatggtgtctctttcacagaagccacagcagaggaggtcagtggtcatattggttagatggtctgcctgacatgtcatctcggaatggtccaggaagatgtagcaggtggtcctagctatcacgtgttagaaacttgggaacagtgcttttgagttctttagtttcaccttttcctagattcacttgctttttagtcatgggaggagtaaaagtgaaagttggaagatttgttctatgaaaggaaaatcagggagcagaacctactcctgacagcatccagagacacaatctggagatgtcacacctgcagcaccgaaactcaatgtcaggcacttggggtctggatggctcctgagctgaactacagatttgggccacctctctaggctcaccatccagatctgggtccagaggacagaattattacctttgggttaaagtgatcccttctcaagtttttatttaatgtgcttttaaaaggcaaaccccacataccatcagtttggttactcttcccattccctcagctaccaagttattttggttgaatagaagctttcctttttgtagggtgtcttcatttcttacatctcactctatttcactgttaggcacaagggaatggacacatttgacaagttccacagtactagatgggtcctctaagtacagtctgaccttcagtttcagctttcctatttaatctgtcatgtaaaattaattgtactccaaagtggccatcaaatacagtccctatttgactttttgttgttgttgagacggagtcttgctctgtcacccaggctggagtgcattggcgccatctcggctcactgcaacctccgcctcccgggttcaagcagttctctgcctcagcctcctgagtatgggattacaggcgcccgccaccatgttcggctaatttttttgtattattagtagagacagggtttcaccatcttggccaggctggtcttgaactcctgaccttgtgatccgcccgcgtcagtctcccaaagtgctgggattacaggcgtgagccaccacgcccgactcctatttgacttttttaaaagtgctcctcagagtactgataccatgaccccacactgcccacagagaccctgtctctggaagtaatgccagcttcctgccagtagaagcagcgtgagttgccaggcttccattatgggatggttatgctgtcctggaacggcagaggttatcacttgtttctttttttcgctttttagttttttaacgtaagtaaatttcttgctgatgtctaaaacttaggccttaataatgcaccacactccccgccttcctctcacttgttactctgttgtctggttcttagattgggtccctttcctatatccctcagtccctcagtaagctcactccacccctaggcctgcctccctcaggagcatctcctggcagggtgtcatttggatgggaccacatggtggacgcaagcatatcctctgtacttgtatccttggtgtgagaagcagagagctggagcctccccactcaccagccaagggcagcctgcacttcatagctgttgaatgggtacttgtacttctcaagattgtccaggaaagtagatttgccagctctgagccccctcttcagtggatgacccctttcagctagagttcagcagagtctgcttttatttttataaattatcatcgttccacacctctggtggccactgactcatgtgcctaagaaatgagaccaattaattttaaaaagtggaatagtggttgggtgctgtggctcacacctgtaatcccaacactttgggagggtgaggcgggaggattgcttgaggtcaggagttcgagaccagactgggtaacatagtgagacccccaactgtacaaaaataaaaaataaaaaattagccaggcgtggtagcatgcctatagtcccagctattcggaagtctgagataggatcacttgagcccaggaggagaaggttgaggctgcagtgagctgcaaccacaccactgcactctagcctaggcagccgagagagagggaccctgtctaaaaaaaatcaaaaacaaaccagaatagcccgtttctgtagtttgaattctctacagaagagaagggagggatgagaataatacatgctgtatccctgtggctatgggcaccatgagtctaataacttaagtttgttttcctctttttatttgtctgctaagaaggctagaagcaaattgagttgcctgttcgttccttcatatatgtctcctcctctgccaacaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccaggtgtgtccagatccaaccccagggagtttccatggtctggatttaagtttcagaatgccttgtgtgcagtcccccactctgtggggtgcactgtcatcatattgtgttgaaacgatgagatggtatttgaaggcagcaggtttccagatgagctggacaagcatgttcattgagtcatgggacctgccattaacgaaacaaaattaaggcagttctaacgtaagtgaaatcatgttcttctgggttgggcctatcgacaggtaagatacatttttaagttcttagttcaagagaagcaaaaagtactctagctctgaaacctcattgctctcttatagaaagtttgtatgatatttataggtaacttctgcatctcggaaacggcctatcttcttaagctgtcttacctttaaaagtattccatctcttaaacttgcttctgagtaagagacctgaactgctattgttttcctgtaattggattgatctttgtattttttgatggtccactttgtattttggtgtttatttaaaagaagggacagagatgaaaggcagtttgatgtttgtgaaaggtatttatacgagctacatgcttttcccattccttctgctgagactaagccacattcttgcttaataaaaagctatctctttaggggctttgccagaatttgcagtcagatcattaagaattttttttttttttttttttttgagacggagtcttgctctgttgcccaggctggagtgcagtggcgcgatctcgactcgactcactgcaacctccgcctcccaggttcaagcgattctcctgcctcagcctcccgagtagatgggattacaggtgcctgtcaccacgcccggctaatttttttttatttttagtatagacagggtttcaccgtgttagccaggatggtctcgatctcctgacctcgtgatccgcccgcctccacattacaaagcgctgggattacaggcgtgagccaccgcacccggccttaagtatttaatttttaaatcctctgtattccgagccctgttctaggtactgggagctcataaaaataaaccctttctagtctccaggggtttcagagggagaagttgtattcctagaaaagtttagcttttctgtttatgattaaaaacactgtaaggaactattataaggtgtgaggccactgctgtagtggccctgcctcagagccagtgtaaaagcttaggaaacatcaccagctagagagaagcgcccttgggatttgggtgtgtggcctccaggcttttctccatattccacacagatgtggatgtaatgtgataggctctgtcttttggaaaaaaaaaaagtgggggtggggatcattccaccgtgcttgcttccatgttttgttttgtgtgagacagggtctcgttgtgttgcttaggctggaatgcagtggcatgatctcggctcactgcagcctagacctcccaggctcaagtgattgtcccacctcagcctcctgagtagctgggactacaggcgcgcaccaccacacccggccagttttgtttattttttgtagagacggagtctgactgtgttgcccaggctggtatcgaacttctgggctcaagcaattctcccacctcggcctcccaaagtgctgggattacaggtgtaagtcaccacgcctagccttcagtgtatttttaaaccagcttttctgggccccttctggatgtgccaagtgcaggagtgcagtggtgggtaaggagtgggcacaagctctcggaactgggagccccagaaccagcacacaggatttcctcccttgtggcccactggacagtccccggccgggctgtgtttctgtgcagcaggctgaaatgaggcagtgaaggggatttggttctgtttggcttctcagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggtaagtaggctctttgaagatgagctagcaatgcagctaagttgcagtggtttctatcagtgtcttgctcatgaacagatatttcatccaaagatattttccattgtgccttttacaaattcagcacattaaattatcttttcagtaaaaaaattgtactgtgggcaccgagtaaaattgcattctttcatctgctcagaactatttttgccttgatgctaaagtaaaatgaaggagcactcacatgcgtttggtttcttcttccccaggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgtaagtagaagcaaaactttctggaagggtgatgaaagtgtgactggtataaggggtgtggacttgtcacctcatcataaataatggtctgtgacgtgtgcagatagatcgtcgtcctttagggggcagttcagaagctttaagggctgacagatggagtccagcagtagatcagctgtgggtatgagaatctgaatccacactgtaaagttagactttttcatatgacttccttgcggcagttttaaagttctctgtatgaatattgtcagtgctcgaagaggcgatctgtaactgttcagtaccacttggaatgcctatttccccttcagcctccaattccaacttctcccctgtgggcaccctgcaggttgcaaagcagctgaaggagcagcagatggtgatgagaggccaccgagagacctccatggtccatgaactcaaccggtgagtggtggccccaggtccccaacctcccgtctgtggacatgtgttgtttctttccatgcagggcatcctgataggccctagcacttactgggtcactaaatcttatccttgggttacaggacagaattaaatgttatatatttataaacttgctaagtgctggacactggagacgtaaaaataaacacttacagcccctttcctccagagggagccactgggtaaggagatggaagcatgtggccaggcggataggagacagtgcagtaagggtcctgagagcaacagctgtgactggcagcgggaccctcaccctggctcatgccggtggggtgctgaagagagcgccctggaggagggtcactctgagctcagagcaggcaggtcctggcatctgagcgcattttggggcctgtggtggcattaaggctagagaggctggcagtggctgggcacggaaggggttgatgtgcatctgaagcagggcagaagggatggagcctgcagtctcttaggaaggtcagtgctaatacatgaaaccacgctagagagggagagggggaggccacatacctgccaggctgtggtgagagtttgggccagaggtgatggtgccagatacagctgtacccttggagatggagcagttaggtaaggaagggcaaagtccaggtgaccttagatgctgccacagcactcttcagtctgcacagtcctcagtacaactactcatctcttccatcgtcactcagaagcagccacagacagacaacagacaaatgagcatggccgtgttcctacaaagctggctacaaagtcagctgcagaccaggttgtcctatgggccttacctaaaggaagcaaccacaggaaaagccagaattgcaaacttcagatcattttctaatccctagcagggatggtaggcaatttagttcattctcttaatattaagctgctggatttacagcactgtgcagtagaagtagaattcaagtcacatgtagtttttaaaatttctagaagtcacattaaaaaagtaaaaagaaacaggtgaaattaaatttaatatatttaacctagtatatccaaagtatcatttcaacattataattaatgttaagaaaaaccatgatgaaatattttacatccttgtcttcaaatctccaaaatcttatgtgacatctcagtttggtctagtcacagtcccctggccacgtgtggccagtgtggccactgcctggacagcagcgccttggcctagagcgctagcatgttagtagatgactttctaggagacagcagaggggcctttgaggcattaggtcccaaagtctcaggtgagcctgttggccgcctggctcacggggagctctgtgggtgtccaggagctgactgtgtcccctcccccaggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggtacttga

SEQ ID NO: 7874 - DNA, 744 bp, Homo sapiens
ggctgctggtcctgcctgcaggtacttctgctagggacgtagctggggcaaggaatgaggagtctagggaaacaggccccacccccggagcttccccttgctgcccttggctcaggggcagcacccgcttcaactggcactccgctccatccatggtgctgctttaccactgcctccctggacctgctgatgccctaccccataccccgcccccagcctgctcctgctgaagccaggccagcatgaagtcctcaggaaggctgggatgagcctcccatctcatttctgaggggtctgagccccatggcctggggaagagcaacggattcctgatgagggccaggggatgggcatgtggcactgtccgagagtcagcaaaagccccaacctgagcttcagcacctaccaatgcctggttctggagagccaggtgtgcccctaagtggtagtgcccacctcactcccctgccccaatcccttctagggccacattacccactcctttccactcagcaaacattattgagcctcatggggaaatggaacagaaggtgcctctcctcttaaaagctcatgccccagcagtaagggttctgcagtgtctgtcaaacctgtgggccttgttccctctgctgtctgcctgacaagctcctgttcatccttcaaagcacagctcaataaggctagaaacatctaaatgcccatcggagggggctgaataaattacagcagctcctccctgtg

SEQ ID NO: 7875 - DNA, 435 bp, Homo sapiens
tttgcccacaacagtctcctcaacctgttccctcattccttctcgccagaatctatcaaggctcggcacaaaggtactctcccaggaggccttcctgaattcttctgtgaggcagactacttcccgagctgccccggcccttctccggccaagtctctccagaaactcatcccattcgttctcagatggaaggggacccacacccacgacaagcctccgggtttgcttaatgactcagacagcgagggtgctcggtaagccccaccagcccgcgccctactcagcaggtaatgacggagacctactaggtgacgggcgccgcggtagacgctgggataaggtccctgctccagggagcttacggtctattcactaacgtcaaagagcagtgagtgctgttacgtgtatgggagccaccagggtctccgcctgcct

SEQ ID NO: 7876 - DNA, 6997 bp, Homo sapiens
aaaatattttaattttttccctcttgggctacaaaagcccttaactttatattgtttccatgagagaataagttctcaggtacgtcctagctttcaaaatgttgtgatgaactactgttctatacaatagcatcgataaatctcaaagactgatactgagtgaaagaagccacagagaagaatatattcaactatggttccatgtatatgaaggttaggaatagaaaaaaactaatcttagatgatagaaatcagaatattgggtaacttgaagagagcagtactggcaggaaaggggcacaagggagccttcttgggagtattatgttctatatcctgatctggtagtttgacaatatatactaaaaatatatcaggcttacacttaagctttatgtacttttctgtatgtaaggtatcactttaaaaatatttttaatatataaaaatgggcctacccttttaaaatactgtattctgatttttttttctttttctttttctttttattttttgagatggagtctcactccgtcgcccaggctggagtgctgtggcgggatcttgactcactgcaacctctgcctcccgagttcaagcgattctcctgcctcagcctcccgagtagctgggattacagacgtgcaacaccacacccagctagttttagtaattttagtagagacagggttttggcatgttggccaggctggtctcgaactcctgacctcaggtgatccacccgcctcggcctcccaaagtgctgggattacaggcctcagccacgacacccggcccttctgattttcaaagtaatatttagtgttgggaaaaagcagaattatactaagaataaaattaaatcaaccataattttaccacctaagggttgctactgttagtattttgttgtatctcctttggggtttttcggtgtttttagaggagttgggaggagtcttactctcttggtctgttgcacaggctggagtgcagtggagtgatcatagcccactgcagccttgaactcctgggctcaagtgatcctcttgcctcagcctcctgagtagctgggactacaggcttgagccactgtgtccagctaatattttaaattttttatacagatgggggtcttgctgtgttgcccaacgtggttttagctcctggcctcaagtgatcctctcaccttggcctctgaaagtgctgggattacaggcgtgaggcactgtgctcagccatctatatccatttttaacatgaattagataactacattttgctccactccttttcacttaatcagttgaggttgcctttttaaaactatgatacagtaataaaattggtctaaaaaggcagataacagaaaagggcagttttatttctgtgacgttacatatacctaacactggtttcatacaacttgctccacaatgccttttaagtactaaacatattcagaggtcagggctagaagataacaaaatctatttaagagttagagctgagaagatttcagaagctttataaaggcatgccaggaaatgtctacaatatttcacagcttggaggaagcaggcaaaaagaaaatcaaaacaaagcttccaaatctttactttgcacggaggggaaacctatctcctgtgattgtagttgtattttgttgtataaattgacataagaatattcctgttgaatcgtgattttatccatggcagtgttttttcatgagttattttccttgtgtgtttgttgcagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgagttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgggtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttctagatggtctacttctgttcatataaaaacaaaacttgatttccagctgtgtggtttggttttcatttatttatggaattggaagattacttctgaaaaaaatgtggaatcgcaaactcaaagagttgacaaaaatgggaaatcactgtcaacctatggaaaactggaaaggcaatttcaagaactgtctttgctgagaaactacattaaaaaatagaattatctctgggatcctaaagcggaatcatccttgtgccaaaataggagatgccacgatcctaatcacacctggcttacactagttggatgtgcctaaggccactacagctgaggtcacctgattcctcagggggaccaagctgggctcctcatactggagggtaaatccttgttttagcagcagctggcctcttactaagaaacaaagtattggccaggtgcggtggctcatgcctgtaatcccagcactttgggaggtcaaggcggacggatcacgaagtcaggagatggagaccatcctggctaacgtggtaaaaccccgtctctattaaaaatacaaaaaaattagccgggcgtggtggcgggcgcctgtagtcccagctactcgggaggctgaggcaggagaatggcgtgaacccgggaggaggaggaggaggctgcagtgagccgagatagcgccactgcactccagcctgggcgacagagcaagactccgtctcaaaaaaaaaaaaaaaaaaaaaaaagtattggctgggcgctgtggctcacgcctgtaatcccagcactttgggaggccgaggcgggtggatcacctgaggtcaggagttcaagaccagcctggccaacatgatgaaaccccgtctctactaaaaatactaaaagccgggcgtggtggcgcatacctgtaatcccagctacttgggaggctgaggcaggagaatcacttgaacccaggaggcagaggttgcagtgagccgagatcgcaccacagcactccagcctgggctatagagcaagactccttctcaaaaaaaaaaaaacaaaaaacagtatttcctgcttttgttatacatagcaacagccttgtctttatgtgtagggaaaagaaatgtttgatcctatattcaggctttattagtcaataataaagataaatatttgttgacaagattgtctctgctgaaagtatatgtagagtttttctcagatgcagtgattttaagaatcacatggagtgtttttaatgttctattccttccccccaacatacttgttttgttgggacctacaattctgcctttgctgggtgcagtggctcacgcctataatcccaacactttggaaggccaaggcgggtggatcacctgaggtcaggacttcgagaccagcctggccaacatggtgaaaccctgtctctactaaaaatacaaaaattagccgggcatggtgacacatgcctgtaatcccaactacttgggaggctgaggcaggagaatcgcttgaatccgggaggcagaggttgcagtgagccgaaatcatgccactgcactccagcctgggtgacagaacaagactctgtctcaaaaaaaaaaaaaaaaaaaaaaaaaacaaacaagattggtgtagggaaataggatatggtctccccccttaaatcgatggtctagtttagaaaacaaaagtaattcatcaagttaagcatatacaagagccaaataattgtaatctggattttaattgctgtattaatatatcaagttcagttggtgagaatgggattgcttttggggggaggagggacattaattggttcttcgaaatgtcgattcactggctagggcagatggggaggtcattgtaagaagagaccacagagactagacaatgacaggccctggggagtcatggtaaactcgagagtggcgagagcagtgtgtttgtggaaagcaagtttagatggatttgaataggagaaacaagggttctagaggtcacatgggaagtcgtgttaatcagggtttcaataagaccgggctaaaatggcagagggaaatgcagggttgaaggcaaaggtagtgtgtgaatgggggcgcggtgtatttctggtgagcctgctaggtgcttttttggcactgctctaggtactttgggttaggtcttcaacgtccttgtgaattagtacccaagaagaaacggcctcagattaagtcatttgcttaaggttgcacagccagttggtgctggagtcggattttgaaaccaggccaacaccactgtccctcctgtgttcacttcaccttatcacagttctcaggagggcctggggtaatgaacaggtggcagagacagcaggaagagtctggagtggttgtgtgaccatttagcccaaccttggcaccttctaacaaagagtaataccctcgaagtatacttcatttactactgtttctgctttatattacccctcagcatctcgcgcagaagaaagcaaagggaagcaatggggcatctgattggtctgggagctccagatagccagcaggtacttgaaggctgcaagccagcttgagagcagtggctggaactggaaggggtgtgcacactaccaatagcaagtgagcaagagagacccacaataaactgaaggttattacagtactacagtaggctctaagaaagtcccttctcccactttaagaaacagggctttttttttttttcttttttacttttaaaggaaacaattcatttgctagaaaaacct

SEQ ID NO: 7877 - DNA, 425 bp, Homo sapiens
tgttgtattgggctgtgtgcaggctgcaggttggacaaacttggtctagagttttccccaagtaagcaggcccaaatactaggtagcaattttttttcatacacatccatacacttagatgtggtgaagttgtgagttaaaacagcaaatgtaaacttccttcacattagaattaacttaaaatgaaagcaatttaaaacatcttttaatttaattatttggctacatgattcattctcttgcttcaaacattttaaaaggagaaaaaaaaaggatacagaaatttcccaccttgttccctttaattccctcaatgttaccaattcctcatttcccccttactccccaggtaactgatgtaattaatttatcagttattactctgagtaaatatgaatatatatttttgtcccaccccaccccca

SEQ ID NO: 7878 - DNA, 2098 bp, Homo sapiens
gtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctacctaactcgattccctttggcttggtggtaggcctgcagggcacttttattccaacccctggtcactcagtaatcttttactccaggaaggcacaggatggtacctaaagagaattagagaatgaacctggcgggacggatgtctaatcctgcgcctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattcaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattaagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaatttttttttttttttttttactggttatgggaagggagaaataaaatcatcaaacccaaaa

SEQ ID NO: 7879 - DNA, 2037 bp, Homo sapiens
cagatttcccctttccctttgcatggttgactggctacctggccatcctcgtcggggcaggcatgaccttcatcgtacagagcagctctgtgttcacgtcggccttgacccccctgattggtgagttacaccctggcttctccctctggccaccactgccatttcctgtcatcccatggggctgatatgtttgtgttttgtgtttcccccaggaatcggcgtgataaccattgagagggcttatccactcacgctgggctccaacatcggcaccaccaccaccgccatcctggccgccttagccagccctggcaatgcattgaggagttcactccaggtcaggacttggggcacggggacaggggccctgggagtgggaccacccatggtcttgcaaactggtctctaacaagagccaggcttttctctgtactatccaaaatatggaactaatatgtggaggggaagccacgggtaaagttttcaggaccttgatatgagaacaatcaaaactatcagttctgagagaagcagtaagaccctcataactggtggttgtttcagcaaaagtggggtggccccttgatatagatgtggaaaaggtacttaggaagcacagacaccacctcccatctcctcactgcctcctatggggaactttacaattaggagaactccttggcatggaccatctatgttactttgtgcaagacctttgggatttgaatttatttatttatttttattttatttttttgagacagagtctcgcactgtagcccaggctggagtgcagtgatacaatctccactcactgcaacctccacctcccaggttcaagtgattttcctgcctcagcctcccgagcagctgggattacaggcacctgccaccacacctggctgattttttgtatttttagtagagacggggtttccctatgttggccaggctggtcttgaactctggacctcatgatgtgcttgccttggcctcccaaagtgctgggattacaggcgtgagccactgcacccagccggggatttgaattcttatctcaccatttacatactaagtgacctttggcaagtgatctaacctgagcgtcaattccctcatctgaaagatggaggacataacccctatctcattaggattattataaagatctgatgaggcaaagccatctgtgcaacagaaatagaaattcaggcatctaatataaattaaccgcatatgtcatcctaaaattttttagtagatacatttttaaaagtagaaacaggctgattcattcttcaataatgtatttgatctaaaccattatcactttaatatgtcatctgtcaaaaattgagagtctttgaaatctggtgtgtatttcatacttaaagcacatctcagtgtggacatgcggctagtgtattggacagtgctggtccacagcctgggcatggaaattggcaccttgggaaagtgaccaagcgcctggcctctggagccaggctcccaggatgtgaatttccacctcttccatctcccacctgtgggacttgaggagcctccattttctcatgtcaagaaataatggttgccactctgtagagtgttttttgagaattgagataatgcacagttgagtgctcctggccctcccagacacatagtaggtcctcatggaatccaggtaccctctgggctgagccataaggacaaagaagcctggaaggcccgagactgtgctgcctgtgatgcctgctagcttacctccccctcctcctccctactgccacccgcattgggcaacaggcccctcacctgtccaacctcttgtgttgcagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggct

SEQ ID NO: 7880 - DNA, 282 bp, Homo sapiens
cactgctaggagcaagatgggtcaccagcagctgtactggagccacccaaaaaaattcggccagggttctcgttcttgtcgtgtctattcaaaccagcacggtctgatccggaaatatggcctcaataagtgccgccaatgtttctgtcagtacgcgaaggatatcggtttcattaagttggactaaatgatcttccttcaaaggattatccaagtcatctactcaatgaaaaaccatgatagttctttgtacataaaataaacatttgaaaaaacaaaaca

SEQ ID NO: 7881 - DNA, 2098 bp, Homo sapiens; identical to SEQ ID NO: 7878

SEQ ID NO: 7882 - DNA, 2037 bp, Homo sapiens; identical to SEQ ID NO: 7879

SEQ ID NO: 7883 - DNA, 282 bp, Homo sapiens; identical to SEQ ID NO: 7880

SEQ ID NO: 7884 - DNA, 2852 bp, Homo sapiens
ggcaacaggagtccatggaggcagacacagacctagaggcaggcctggaagaagaggcggtgagtgctcactctcaggctgggtttaagagtgggatggacagcctagctcctctggttctccctggagctctctctgggtggggcactccctgcccctaattgatgggttgtgtcataggttctttctgcaccccagttccatttgtgcacggccacctctgcagaggaggtgggcagctacgggggcccttcctggcaccatgccccgctgggcagtggggaagccggctgcgtgtgttcctcctcggggcccactctgctcccatctgctggctgagcccagcctggctgcttagggtagggcaggagccctactggctgaaatctcccctatctcacaatgtcccacaggtggggggcctggggcctggagcctgggcctgcctccccgggcagggtcttcgctatctggaacacctgtgcctggtgctggagcagatggcaaggctccagcagctctacctgcagctgcggatccagaggcccccaggggtgagtgagattcgagtgggggagggagaggacagatgggaccctgggaaccatggctgccctcagagcagcttcagccctctagccaggccctgatcacctgtctctcctgtgcataggatcccggcgaggaggagtcgacccgagcccctttaccgtccccgttacacaccccaggcaatcgggggcaggggccatgggagctgctaagccagacagagcacacaggtgaggggccatcgtgtctccctttgtcctgcctgcctggggtcccaccagcaggtcctctgagccgaagcttgatggggtgtcttctggccctggccaacctgactgtctttctgaaggagcaaaggctgcttcacccccaaaggtggaggtgcccagtgccaaccctcccaggctgccagaaaccccagtggagccaacgtaccacttgccatcctcccagggacacaaggtaggggacaggtatatgtggggcaggtggtgggctggggtggggggaggggaggtgggggatgcatgggcaccctgggggccagcaactctggggaaatgacaggattgattcctgtttggagcaggcgacttgtcctggctgtggcgacagctgtctctgggagcttggtcgggggtctgagtgtggggagggctctgggtgacccctcatcctctgctcagcgggatatctcccactgggacaaggtcaaggtcctgctcaaccggatctgccggagaagccaccaccaccctgagccccctgcccctcctgatggctctgaccccaggtgagccccgtgcccagcccaggttagggcacggagaggagactgataagccaggatgctgagattgtcatgccagttgtcattattgtccccgcaaaacttgagaggcagtctgggaggggctgctagaagaaacagtagttaaaacaccccatttacagataaggaggcagggttctgggtggggttgggggtagttgcttttccaaagccgcacggtgagtcagtgacagctaggaccagaatgtgggaaatctgcctaccctagctcagcaacccctcaccctcaatgctgacatttaggccaccttccaggttcgtggggagagcaaggtggagcacaaaggatttcacagtgggtgaaggccatcatgcttcggggcttgtattgaatcgttctccaggaggaagaaataccaagtcatttaacagccccgggctgcgcccacacccagctacccaccagcagataaaccacgttctctcaactctagggccattgttagttttatttcccccttctagcctaatgtcttcttttcattccacaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgtaaa

SEQ ID NO: 7885 - DNA, 2852 bp, Homo sapiens
ggcaacaggagtccatggaggcagacacagacctagaggcaggcctggaagaagaggcggtgagtgctcactctcaggctgggtttaagagtgggatggacagcctagctcctctggttctccctggagctctctctgggtggggcactccctgcccctaattgatgggttgtgtcataggttctttctgcaccccagttccatttgtgcacggccacctctgcagaggaggtgggcagctacgggggcccttcctggcactatgccccgctgggcagtggggaagccggctgcgtgtgttcctcctcggggcccactctgctcccatctgctggctgagcccagcctggctgcttagggtagggcaggagccctactggctgaaatctcccctatctcacaatgtcccacaggtggggggcctggggcctggagcctgggcctgcctccccgggcagggtcttcgctatctggaacacctgtgcctggtgctggagcagatggcaaggctccagcagctctacctgcagctgcggatccagaggcccccaggggtgagtgagattcgagtgggggagggagaggacagatgggaccctgggaaccatggctgccctcagagcagcttcagccctctagccaggccctgatcacctgtctctcctgtgcataggatcccggcgaggaggagtcgacccgagcccctttaccgtccccgttacacaccccaggcaatcgggggcaggggccatgggagctgctaagccagacagagcacacaggtgaggggccatcgtgtctccctttgtcctgcctgcctggggtcccaccagcaggtcctctgagccgaagcttgatggggtgtcttctggccctggccaacctgactgtctttctgaaggagcaaaggctgcttcacccccaaaggtggaggtgcccagtgccaaccctcccaggctgccagaaaccccagtggagccaacgtaccacttgccatcctcccagggacacaaggtaggggacaggtatatgtggggcaggtggtgggctggggtggggggaggggaggtgggggatgcatgggcaccctgggggccagcaactctggggaaatgacaggattgattcctgtttggagcaggcgacttgtcctggctgtggcgacagctgtctctgggagcttggtcgggggtctgagtgtggggagggctctgggtgacccctcatcctctgctcagcgggatatctcccactgggacaaggtcaaggtcctgctcaaccggatctgccggagaagccaccaccaccctgagccccctgcccctcctgatggctctgaccccaggtgagccccgtgcccagcccaggttagggcacggagaggagactgataagccaggatgctgagattgtcatgccagttgtcattattgtccccgcaaaacttgagaggcagtctgggaggggctgctagaagaaacagtagttaaaacaccccatttacagataaggaggcagggttctgggtggggttgggggtagttgcttttccaaagccgcacggtgagtcagtgacagctaggaccagaatgtgggaaatctgcctaccctagctcagcaacccctcaccctcaatgctgacatttaggccaccttccaggttcgtggggagagcaaggtggagcacaaaggatttcacagtgggtgaaggccatcatgcttcggggcttgtattgaatcgttctccaggaggaagaaataccaagtcatttaacagccccgggctgcgcccacacccagctacccaccagcagataaaccacgttctctcaactctagggccattgttagttttatttcccccttctagcctaatgtcttcttttcattccacaggatcgagtccagggacctccctgaaaggcctcagtgccgcccccaccggaagacctttatgccatcattagtggttaagaagcaacgagcaaaaaacctttctgtaggctgagacctctcggtgcacctggtgaccctgggtggaggggacttgctgtgaagtcttcctcgccctctgccctcttgctgcttctccacattgccaggaaaagctgctgacgcctgccctcctctcttgagtcgagggctgaatctttctcctctaagcagtctggtcaggaaccttggtttcttgagaggcccccaagatgccgcagctccagggctcttcctcctcaccagaaatccctgggcttccacaatgtgaactcactcattgtcaggtgtccgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgaagactgcacaaggaatgaggaagatcagggacaacctgggaactgaataactttcaaagccagtgctcagcttctctgctccgtactagcgtttacaggtcttaattcaaaccagatgcctgtactagtttttagaccccaagtcaacctttctgagccacagcttcccgctgggaataatgatgcctgccctatctacctcacagacttgttatgaggataaagtgagattaaactgcctcaaagtgctttgtaaa

SEQ ID NO: 7886 - DNA, 590 bp, Homo sapiens
ggcgcaggccgtctaagggattgatggatgtggcctgccagggctttgcctaccacacagctcagagcacgggttccctgtcgctaacaaccgttgcgaagggaatcccatccacacatctcccagacagctggggccatatccgggctgcccgtggctgtccagtgaccgcccttcctcactgctccgggacacttctccctggggcagtgctgccagccttcaggaatgctgggggtgttgggggtggcctgcccagcctgacgctgactctccatgcagatggggctggcgagggcctggcacggggctgcatagtgcctggagtcaccagcacctacagacggatccccgacgctgcccacgggtgctcatcctgggagagaggtgacaagttcagaggtgtcggcagggaggcactctttctcaaactggcctcccgggactcaggagtggagatggcagttggggacagccccctggccgccttaccgggcctttctcaggactccctggactttgaatcctcagggagttctgagccccccgcccaggtaggccgactcctggccagccagaagctgggggag

SEQ ID NO: 7887 - DNA, 159 bp, Homo sapiens
atggggaggtcggaggataagggggggctgggattgctaatggggactaaaatggccagtctcctggcaagattttgagcaggtcatttcattgaggcctcttagatttcatatttgagaattagggcactgattcctgactggctaggcatggtggtc

SEQ ID NO: 7888 - DNA, 590 bp, Homo sapiens; identical to SEQ ID NO: 7886

SEQ ID NO: 7889 - DNA, 159 bp, Homo sapiens; identical to SEQ ID NO: 7887

SEQ ID NO: 7890 - DNA, 9689 bp, Homo sapiens
ttttttcagggtgaagaaaatcttaaaacaagcatttgtacgtttttagcagttttatcacatttagacattattactcaaaatattccagaaaaggtaagtttgtttgtaagaatttaaacttgactgtaaaaaaagaattgtatgtatttgtaccaattttttatatgtagagcattcctgtgaatgtttgcaatttttccctttcctttccactgccctgctaatgtgcacatgtattagacacaaatacccagtaaatgggaattacccatttacatgcatacacactgaggtgtgcttgagtacataccaaatttatagacaaactactgggtaagtttttgttgatacttgtataaaattaataattatttataattcttaggattaggattacttaggattctttaaacaggacttcccttaccttctttgactgaatggtagttatttaacaaatgctcgtgcaaagaaacttatggccagactattaaaagctgttgggtaattgaaggtgatataaaatgactgtcatcatttggagtgtgcagtacagttacttcatgttcctcaggtttagaacaatttcccctgtaagttctcacacagataggcagaaatcataactaattttggttaatcactatggcagccgttgaagaatttaagagaacctgccagtaagatttggaataagattctatattattgcatccacagaaaagaatgtactgatatactataaactctaggagaaaacttaattgaaatagtgttattaagtgttgaaagtaccataaaaatataagggaaaataagctttcctagaatttttcagtgttctagtttttaaacagtgatgttttttattaacctatttcatccattcaaagacaggcctttctccacaccacattttcctctaaaatcatgataacacttttaaattgatggtgtcttccagtgtgtatcagccagatggcagtgtgttacagttccaggaaaactcgttcacatcttccgtaagatcaagaaggctctggcatcagataagatcaaatgttgtctttctgttttaaatatgtgccgcaaagagatttgcttacaatctattgagaaagctaaaacagagcagacattgtcctgttgcggggtagatgaatagcctaagaatagtttagacaaattctgaaaacgaatttaccttagaagatgttcatgttagatctggtaaaagtaacatgttatttttctgtcaagccctttttgtacttgccgtttattacatattttagatttattttttattttcgaaacatccaaaaaggaatgctaattagtgaaatggaagaatttccatttcaacaccttaggaaaaaaaaaactgacttgacatacctaagaaaaggccaagttgatttactttgtcagtctcttcatttgtgatacgtaaagtccgttgttacctagataaatgtaggtttgatttcttggaagcaatcacttaagactttccattttcttcaaagcatcttacttaacctgcatgtgggatctgtactgagcaattagagattcaaaacaactgtcacacacgacagaggtggtaaccgcccaacaggttcacctcttccgccgcctacacagagccgatttatcaagacaggaattgcaatagaggaagagtacacagagctgcttgtgcaggagactggagtcttattagtactcaaatcgatctccctgagcattcggggatcagagtttttaaggataatttggtgggagggggaaggccagtgagtcaagggtgttgattggttgggtcggagatgaaatcataaggaattgaggtgtccttttgtgctaagtcagttccagggtgggggccacgagatcagatgagccagttaatcgatctgggtggtgccagctgatccgtcgagtgcaggtctgcaaaatatctcgagcaccgacataggagcagtttagggagggtcagaatcttgtagcttccagctacatgactcctgaaccataatttctaatcttgaggctaatttgttagtcctacaaaggaaatctagtccccagacaagaagggggtttgtcttgggaaagggctgttatcatctttgttttaaactataaactaaactaagtttctcccaaagttagttgagcctacacccaggaatgaacaaggacagcttggaggttagaagcaagatggagttggttaggtcagatctctttccccacctcagttacaattttgcaaaggcggtttcagaatcagagcacgaagtgttcctataaaaggaaaaaaaaaaaaaacctttcttaattatgctcatagttgtgtattgtcctgtcagcttgctcattgtgtaaaatgagcggacatgagaattcacgagcagagctttttacactgatatgtatgaaagcatcatttacgtcctgaaagccccagccgagcgatcactggcagtgccaacatttttgagtgtgggctccataggaagcactgttttccctattgagaattatagtgggtttttttcatttacgagtaatgtatacctagctccaagatcttggttgctaacaccattctccaataaaacgaaccagggatcgctggagaaatagctgattctaaaactagggcagaaagtatacaagatgagcctggagcatcttgtagagtcagagagcaaggcagaactttatacatacagtgatgtgagatgggcatgcagagggaagatgttcccagtggctgaagctgaaacagtgtgagcaacaaaataaagcagtgttggatcacaacccaaagaataaaataaatatcctcgagccccacaccgatataaataaatgattgaatcaataaatgagtccaggcactgtggctcatgcctgtaatcctgcactttgggaggccaaggcgggtggatcacttgaggtcaggagttcgagaccagcctggccaacatggtgaaaccccgtctctactaaaaatacaaaaattagccaggcatggtggtacatgcctataatcccagctactcaggaggtgaggcaggagaatcacttgaacccgggaggcagaaattgcaatgagccaagattgcaggactgcactccagcctaggcgacagagtgagactccatctcaaaaaaaaaaaaaaggatggacaagacaaatctcttgtaaaaaaaattacaagtaatttttatagaagctctgccctgagggagggggagcgtgacttctcactccttcagtgtgggctgcacaagtgacttccttccatatgggatcgttataacaaaagactgtaacaagggctatgggagttataagacaggaattgtggacaaaaaccagtgtatatcataacatcacaccttgtaatgttggcagtacagtcactgacctttgataaatgttgatgacatgttgagtaaaggaatgagagaaagaggattgtttatctctgtttttatccttctcagagaaacttagagtaacaagtgtgttatcagccatgctgatgcctttggtaaactattgtgtgaatatggttgttttgaattggtcagtagaaactgggctgccaggcgcagccggtaagcatttccatgtgagccttaggggagaagtgcatttggtaggagcatcaaaatagcttctgatatttcattaaaagtttgggtccgtctggttccttcattagtatatgtcacttcctttgaccttcagtgtctgttgaaccatgtgattttagaaagcaagggattgcttgacatctccaggctgtgaagactaaagttcacaggaaaagactacaaggaaatttaaacagttttattattttccccctcatttcttaattttcctgccactactcagtactgtgtgggtccaggatcaccattagggaagacagagtagctcagaaatcagtagtgaggaggaggacagcactttgtgtggtatcttgctctaggagcattttcaagccatcagaagtgggactcttgaagactatttctgactttctcagcacaaattaagataataggagatggaggctccatttgaaaaacattttggttgtataatggttagcataaaacatacttttttcaagttaactcaggtactagagtatggggggcggggggaaatgtactgcagcattaatgaaaactagagctgggagaatgtgtttttccttgagtaaattgcaaatgcctgtgcaccgcatttgaccaggagggaagaatgagaggccctggtagcaaagccagtggaagaagttttactaggagcagttgtatcattcgtgtactttttttgtgtcatacaagtgagagtaaaatggtccatgtctgtgttttgaggaattttttgcctttcttttcagaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggtaaggagccctcgtcaacctcatcgccctcactctcctccagcagggcccacagggagggggcagtgcccatactgtgtcagcttctccttccacatcctcatgctgccgtcctggagcatcgagggcttggactgggccaggcctaagcagctcactttggggtgtagttaattacagttcattgtcagctccaccttgacctcttattgcccttttatcctcaatcctttattgtacaaataatcttctacatacttgtacctgtttctcttcagtatagctaaatgtcatcctttgttgtttgagaactgcttagaagtggcacgacctgactttaaagacatacttttaatctctcagctatactagttatagctaaaggcttttttcttttctaagagaactctcctattccgcagacaaaatcatacatggaagctcagtatcaagcaagtgacgtggatggggtgagggagcggtgcaggacccagtgtctgtgaagcccccacggtggttcccatgtctgcctctctttccccgcacctgtcacggtgcagaagcaggctgcagtgtcataagcatctccaggtctctgcgcttgtttccttatctctgaggtggtgctgttttgcctttttattattatcatagattattgccatccaggaattctggattttttttttaaattttagagacacaggcaatatcaaccaacataaaagatttttcatcttaaaagctgaaaaagcacccactaatttatatacacaaatggttaagtgttggaagcagcataataggcaaatgaaatagcatttggaaaaccagtaacatgtagaagtcttggtcgtgaccattaagttatttgtacatggtacaaataagactgagtcattgtgtagcttcatatggggctggggcgagggtacctccctggcccgcaatgtacctttctacctcccttcacttttgatgcatttgttgaaaagaggcatttgggcattaagtgggtaagggaggttttaggggcttgggagaaagatatttgataaatacaaataaatactaaaatggagaaaaaagtaaatagcatgaaataaaacaggggagtagcaggagaaaaagagagttagctgtggggagatgggttccagaggagggacagagagcagaggcgggaatggattcctggtacatcgtgcacagttctgtatactggagaatgaccttcctgtgcctggcccagcaaaggctggtcatcaaaattagtcattcactgtagcattgccagggacccctacaattccaactgtcctctgaaaactaaaaatcttgatcttttcaagggaccttaaatgtcttatttctccttggtgtatggtgtatttcctattatttggtgaatacatggctgagtttacatgtgtagatttgaacattaatatttctcaggatcgcatttgcattatcatgcagtaatccaaactcaagctaccaaagttgctgctaatcatattttattatgtaatttaatgaacttacgtgctgtttgtgtttgatggttagagataggtaaccaggggacagagggtatagttaccccatagactttcagcccttccttaatggaagggagtttgagggaattgccataatttaacacgcagataggcatttgtcagcttgtagctgtctctgtgattcgatggtgagtgattatttggtattgagacatttcgatcctggttgttgatcctattctaaatttgttggtagctgtgttttgatttctaaaagcaattggctccagtcatattttttattaagcaataaaacgcacttttaaaaaataactttaaaaatctcagtaccaggtaggagataaatagccaatcaaaataaggcatccggctgggtgcagtggctcatgcctataatcccagcactttgggaggccaaggtaggtggatcgcctgaggtcaggagttcgagaccagcctgaccaacatggtgaaaccctgtctgtctctactaaaaatacaaaaattagctgggtgtggtggcaggcgcctgtaatctcagctactcgggaggctgaggcaggagaatctcttgaacccgggaggtggaggttgcagtgagccaagattgcgccactgcactccagcctcggcaacagagcaagactctgtctcaaaaataaataaacaaataaataaggcaccctgggcattaagccacctctgttctgtgattgcatacctccttgggatcggcttgtgacaggcacaaggccaggtgctggggcttagccaggtagatgagcctctttcttcatgtgactcacagtcaaatgggaatagacatcaagtaatcagagcaattttttaaagttttaaaataaatcacagaaaagtaaatgtgatgaggaaagttttaaaataaatcacagaaaagtaaatgtggtgatgaggaaatacagactgttcagtctgggtggtttagggaaagcctttctaagtaacatgatgtttacattaaaatctaaagcatgaataggagctaggtcaatgaagactgaaggaaagagatttctgtgcagaagacactgtgtttgggaacggccagccccacttgatttgcccagagctttaactaaagcaagcttggtctggctgagggaagcaacagagcagtcccaagatggagggagccagggccaggcttgggttgatgttgagtgaatggggaagccagcaaaaagttaaacttgagaatgacgtcatccagttttcttttgcattaaagtgtgaagagcagatcggaggtgagcaagagagagtgggaggaaaattgtgatttagattagtatgagattagtagagggacagagaaatggacaggctttgaggtaaggtaaacaagggcctaaagtactgactggatttatcaagagccattcgatagcataattaggggattgaaaccaaattaaaataggtacaagagggggccagctgcagtggctctcgcctgtaatcccagcactttgcgaggccgaggtgagtggattgcttgagcccaggagttcaagatcagcctgggcaacatggcaaaaccccgttctctataaaaataataataataaaaaaaagttagcggggtatggtggcatgcacctgtagtcccagcacctcgggaggctgaggtgagagaatcacctgagcccaagaagttgaggctgcagtgagcggagattgcaccactgcactccagcctggcaaccgagtgagaccctgtctcaaaaaaaaaacaaacaaacaaagtccaaatgtggataggatgatacattaacatatattacatcagagtggtaggtttactggtgtctataattttctttacctgaatattcggaatatttaaaatatttcatgtctttaacttttcaaaaaatgggtgatgaaggtgagacagagtcaacttatttagaaaattctctcaaaaaatagtatattagaaagttcaacagctagtggtgggggtgctgtcaaaagagggcttctgtttcatttttggtaacattagttgtttttaagtgatactcatagtcaggaagttgaacagtgcagaaaggcatcgaatgaaaacgagacagtctccttccttctcccaccaaaggtgaaactccagtaaacttgcttttcttttaacagctacctaatattccatttgccttaggatatcgcttgagtccattactgatggacactttaataaggttttgttttgttttttaagactagatacaaaagcccttttgaaaaggctgaaggaaaggctagaatagagaagaggggagatgcggaagttgggggagatagggcaaaacccaggggaatgggatctgttgcggggcagggtattgccctttgaagagagactcttgacagtgaaggagaaaagaggacaggtgggtaaggaggtggcaggaagaagaaagatctctcactcctgtctcctgtgatgtgtgaggcatggctgtctgctgatagtgagagggttggggagggcataggaactccagggagtgaagaagacacactggtcagggcaggagcgtgatcttgccagaaaaatgtcttgaaattgctgcttagtttatgggttgatgatcatgaattttatctgaaacctgcctgccatattgtataacttttatccctaccttttttgccttttaaaacataaacttgacaacagatgttttaaaaatttaaacgctgctcatagtaaatttgtttggtttgtgaaagtaggtacaacttggctgcatggtatgagtctttggagtagaaaaggtgacttttatgtaatggttttctctcctggaaaaaagagttttctgccagacataggtttaaggttccatttcaaaatgtgaaatttattaagtgtcagtttttaaagtatgtattgatcttggagaggtgtgtataaatcttaggataaagttcataaaattttctgttccttctcaactctgcagccaccctttaagatactgaattgattctcccctcaccagagttgtttcatttgtctgtggctcataccatatttttaatccttaggaatgccaagaagaattggcaacgcattcaggagcatttcttttttgcaacatttcacccactcaaggattattgtctagaggtgagtagagaatatcatttgtaaattctctattgtatctttaatcctgatgcttcctttctgcttttgttgaagggttgtgattagggtaaagtttttttcttgcttacaaacatcaccttaacattttaaagttctaagtttaactttgtcactttatgcagatgacttgctttcatttcactcttaagcagtgaaaattggctagtcattttcactttctatttctcaggcagtgtctggcttgtaaacaatggaagggaatatttaactctaaacagaaatctgttctgacattaaaaggaaatgagtgagaacatttgtgcag

SEQ ID NO: 7891 - DNA, 623 bp, Homo sapiens
ttgttttttttttgtttttattttattattattatactttaagttttaggttacatgtgcacaatgtgcaggttagttacatatgtataaatgtgccatggtcgtgtgctgcacccaccaactcgtcatctagcattaggtatatctcctaaagctatccctccccccctccccccaccccacaacagtccccagagtgtaatgttccccttcctgtgtccgtgtgttctcattgttcagtttccacctatgagtgagaatatgcggtgtttggtttttcgttcttgcgatagtttactgagaatgatgatttccaatttcatccatgtccctacaaaggacatgaactcatcattttttatggcctcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtccttgtgtatatacccagtaatgggatggctgggtcaaatggtatttctagttctagatccctgaggaatcgccacactgacttccacaatggttgaactagttta

SEQ ID NO: 7892 - DNA, 1591 bp, Homo sapiens
  misc_feature (534)..(534): n equals a,t,g, or c
tttttgacacagccctcaggagatcctgagaatatgtgcttgattgaagacttttgaacagagcagtgggtgtctggggaagaacactctggtggtgtggtacaagacagtgttaagaggaggcgtctggagcagaaggatgagctgggaggctggcagggccctacatttatgtggtcaaaacctagggtgtggtagcagcaaagatgaggaaaggaagggatggtgggccaggtggctctctagatgggaggtgtccgggaacttgcaggtctcaagcctgggtgactaggaggatggtgcgcaaaacaggaaaggcaggacgcggctgctgggttcctttctcgagtgcacgcagggctgaaaggaggggagctgagatgagaacggcccttttccccactgaatgctgcctgcccatgtgtgtcgtcttagctgttttctatttgcccatcgtgtttagtagaataattgaatctgcagacagttttgactagtccattttgcctctcactccaccccgctgcctctcgngctttctctctctcttccttacctgcctgctgccagctccttgcctcccctctgattactgcgcccccgcaataactcactgtttgatcttccacatacgggaacctcgaaacccagctactgtctgcccagcagggttgaagtggccagggtgacccaggccatgtcctgcactgattgtaatcctcctctgcgcctaacacagagccttacgtgtataccgagtagaggagaaggaaggatgtcaaacatgtcactaccaccccccagtgcatgttggtctccctcacgctggactgtggcaggagtcttccaaaactgctctcagtgccccatcccctctgtgtgcaatcatatcgttgcttacttaaccaaccattcatctcttagggcctgagttctgttacccagcctcctcagaatcttcagcagttcctcatttccataggggaaagccagctgtttatttcctttacttatgcaacgaataagtcagtgtcagatagtatttttgttgataaagccacagcggcgagcaaaacttttggtcctgcttcctgtgagctgactttctgcaagggagagagatgataaatgcacatataatatagttgagagtgatcagtgctgcaaggaaaagcagagctgaggaaggagcaaatggtggagagggaggagagggagtggtgctggcctagacggtcaaaggttgctgtggtaaggggacactggagtttttatctgagtgaggctgggtgcggtggctcactcctgtaatcccagcactttgggaggatgaggtgggctgactgcttgaggtcaggagttcaagaccagctcgggcaacatggctaatccccatctctacaaaaagtacaaaaatcagctgagcatggtggtgcatgcctgtaattccagctactgaggagactgagaggcaggaggagcacttaagcccgggaggggaaggttgcagtgagctgtcatcacaccactgcactccagcctgggcaacagagtgagactctgtcacaaaataaaatataaataaataaaa

SEQ ID NO: 7893 - DNA, 1906 bp, Homo sapiens
ggggcaaatgccattgaaaccgctagtcttatttcctttctacttttctttggcactcttactgcctgtaaggagtagaactgttagggcacactgttgctatacagtttaactcccattttcatgttttgtctttcttttcccatttctggggcttacctcctgatacctgcttactttctggaagtagtgggcaagtaagatttggctcttggtttctaatttttaaatttctgaatactgccctagtctgaacttggcctttatagattaatctttgcttcacatttttagtgttgtatttaaactattttataatttaaaaatagattctaatctgaagatacttttcaagaaatattattaactgatgtcatcctcatcccagcagctcatctgttaggaatgaagttgagatgcttctattccatgtttttgtatttgggaaggattcaaagttgaaggtttattgtcgttgggtttttcagatggtgacatgtaaactcaggatagcaaaccctaatgttcacacagtgctctgcctctgcatctcagttgggatagttgctccttttgagtgttttaatcatcgtataactaatcatagtgccaagaagttcataatgtgttatgtagctaatgtcactgaaaaacagtcctaccattttaggtaagaccaaacagagtctctaacccaaggacttgttacacctgacaacctatagtatatttgctttttctcacaaaatgaaaccaattttgccgaaagctagctgggataataggatcatcacaagttgcagtttctataactaaaattagattgaaatctcttctgacctagaacattttacttcaggcattcagcagatttcagaaagaattaccttattttaagttagtttctttgttagtttactgtgtgtctcttattcaataaacaagcagaatttgtgtcctgccctatccatgtcttaaagatgagaagttggatccactgagttagtttcattggggcgggggaaagaactgtaattaaacttgtttaatccttattttgtattgtagctattttttgtaaaagcaacttaaaatcttttaaaaattttatagtgacattagagacaatggtcatacaaattatcacataaacatggacttgaaaaattaggcttttcataaaacacatcacatgtcattgactgctttttagaaatacacttccaaggcagtacatctgtattgctactgaaaagtgccatttcacagaacacagacttcttcttgctctctgacatcttgaaaacatctgtttttcttttgtaatacaaaactttgtgctcaagacaaatcttacatgaaactctcataaaccatgaaaatgtagctggccttcgggccttaggcatgaaataagcatgaggaacatattcccctaacttctacccccagcccagcaagttatcctttaagaaatctcctaggaattctggagtttgaaaacaattgctctatgttattcctgcttccagtctctaagtaacaagggcatttaaaagcatagtctcttaaggtccactatagtggttctttatttaaggaataactcagctgggtgcagtggctcacgcctgttatcccagcactttgagaggctgaggcaagcagatcacttgaggccaggagttcgagagtctggccaacatggtggaaacccatctctacaaaaaatacaaaaattagccaggtgtggtggcgtgcacctatggtcccagctatttgggaggctgaggcaggagaattgcttgaacctgggaggtggaggttgcagtgagccaagattgtgccgctgcactccagcctgggtgacagagtgagactctgtctcaaaaaaaaaaaaaaaagg

SEQ ID NO: 7894 - DNA, 1237 bp, Homo sapiens
gtagaatgccatggagttaatagcttctgtgatcctacatgttccaagataactgcagcagtccaaaaagccagtttcctttctggtgtttgtgggcatacactttgttctgctcctgagtaagtcacactttgtcttccaggtcctctaggatccctgcaatgttccatttgttgcctgggcattggagtaatagcagtgcttggtgctacagaaatagatggatggaagttgtggttactgtgacaccaaaaacttgtcccctgagctccctactcctctttctcctatattttttggtaattggctctgtcattcacctcactgcaggattcagaatcctggtactgggtcttgtatttctctttttcccttaccctccttatccaaattgtcaccaagttctgcttcatgctctcatgatttctcacctgagttaccctagtagcttccaaatagggccctctgatttcaaccttggacactcccactatcttttatattatggaaagatctaatcatgttaccccccatttaaaatccctcagagagcactgcagatacaattcaagccagttagcttagtgttaaggttttacatgcatttctgcagccatctgcccctattcttgcaccctaataatgccaaacttcttttaggccttaatttcatcatctgcaaaatgaggataataaatagtacctacttcatatgattgtaataaggcccctcaaaactgtttcatgcctcttttgcccactgcattaggctgttctcacattgctataaagaaatgcctgaggctgcgtaatttataaagaaaagaagtttaattgactcacatttctacaggctatacaggaagcatgatggtggcatctgcttggctgctggggagggctcagaaaacttacagtcagccgggcacagtggctcactcctgtaatcccagcacttggggaggccgaggtgggcagatcacctaaggtcagaagttcgagaccagcctgtccaacatggtgaaacctcatccctactaaaaatacaaaaattagccgggtgtggtggggcggcacctgtaactccagctactcagaaggctgaggcaggagaatcacttgaacccaggaggtggaggttgcagtgagccaagattgcgccactgcactccagcctggacaacagagtgggactctgtctcaaaaaaaaaaaaaaaaaaaaaaggaagcaagaaaa

SEQ ID NO: 7895 - DNA, 2853 bp, Homo sapiens
cttggccgcaaggtccccctttgcccagtcggcggggaggaggccgtatttctgctggccagagacgtcgcgtccctggctgggcattcagtcacccccaggaaaggaggcaagtccacgctgggagttagaaggcatcgcctctaatccaggtttcgccatctcctctgctaagtgacgtccagcaagtcacttcactttcaggacctcaaatctcctccccagtagtaaaataggggtaataaaaacagctacagcggaagactgttgtgaggcacagagaaagggcttggtcattggaagcgggttccaggttctcaaccttcatttccttcacggttgaaggacgccaaagaaagcggaaagggtgaattttcttgaaatctcagttttggggaatcttagcgacgagtcgcggacctcagcttgtccggcgctccaaaacttccggcaggcggaccggaagcactgaggcgggaagggtggtagaggcccctcctgccggaacccggggggcggggctcgtggctgttgcggatggggcgtaggtgggcggtgcgcccacagctgcctgggtaaggcccaagatggctgtcttcgccttagtactcgtgtgaagttggcggggacggttcctgtcatcttcttgggcttatttggtgtgctgttgaaggggggagactagagaaatggcagggaacctcttatccggggcaggtaggcgcctgtgggactgggtgcctctggcgtgcagaagcttctctcttggtaagtggctgatgtaggcaccccgataactgcttcgtagtataataggcggctcagattaattccctcccttccccatccccaggtgtgcctagattgatcggtataaggctcactctcccgccccccaaagtggttgatcgttggaacgagaaaagggccatgttcggagtgtatgacaacatcgggatcctgggtaagacttgaccttcgacgtggtacacaatttcagaatggcaattaggctgtaacgactatcttttcctcctgtgtagagagtggtactgtgctcaatagtaagagcaaacacttatgtagctgtttacattgtgtttggcactgttctgagtcccctcgtataatttttacttcataagtaaaaataaacagtttttccaaagttaataaatggcagcatcagaattttaaccccaagcagtctggctccagagtctgtgctattgttctgtactgtaatgttccttgtctataggtgctgctcagcaagatgcaaccgtgggttgaaagcttagctggtgtaggatgagttctcttgtcttggatctaatgtgttctctcacattacacaggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaatttgatagccacatacttttgttttcctctagatgctgcctctactcatgtagactatgaagtcttgactcatcctagatcttaggatcttaggtttgggcttcacaccacttgccttttacagtctagctatacctaattcctttaaaaagaaaagttggtgagaatgttattggcgctttttgacataatgctgttatgttaatagtgtttctaaagagccttccacactgaaatgaaatataagagaaaaatggagtcatacttctgtactactctcataaaatatttattaggcatattctctgagtaggaactataggaaaaacaaaaaagtgtgaggtgtcctttccatttaaatatgaaacattaagtaccatatgaatggtagagatggcggatactaagcctgactggtcatcagttttctgggtgttttaacatttcaaaagcctagtcctaacccctaaagattgatcagtagagctgagttgagtctagggcatctatgtgttttgttcttttttaataataatttttaagaattacagctgggcagaatggtgcccacatgtaatcccagcattttgggaggctgaggtgggaggattgcttggagacaggaatttgagactggtctgggcgacatggtgaaactccgtctctactaaaaataaagtggctgggtgcggtggctcctgcctgtaatcccagcaccttgggaggcggaggggggcggaccacgagctcaggagatcgagactatcctggctaacacagccctgtctctactgaaaatacaaaaacaaacaaacaaaaaaattagccaggagtggtggcggacacctgtagtcccagctactcaggtgtctgaggcaggagaatcacttgaacctgggaggtggagcttgcagtgagccgagatcgtgccactgcactccagcctgagcaacagagcaagactctgtctcaaaaaaaaaaaaaaaacaacttagctgggcatggttctgcatgcctgtagttccagctactcatggttctgcgtgcctgcagtcccagctacacaagaggctgaggtgggaagatcacctgagcccaggagtttgaggctgcagtgagctgagatcatgccactgcattccagcctgagcaactggggtgagactgtctcaaaaaa

SEQ ID NO: 7896 - DNA, 105 bp, Homo sapiens
aggctgaggcaggagaatcgcttgaactcgggaggtggaggttgcagtgagccaagatcgtgccattgtactccagcctgggcaccaagagcgaaactctgtctc

SEQ ID NO: 7897 - DNA, 787 bp, Homo sapiens
ctcatccagagatgcactgggcacagggaaagctttttttttcaagtagcagctgctattcattgaaatgttacaattttcctgccttagtatttcacacgtccttatactcctcataacattttttgcttgtgtagttttagccccatttcagaaatgaggaacccaggttcagaaggtttagaagcttgctcaagaccccccagctattaggtgccagagctgcaactggaatgcagctttgactccattgtgggtttctgttccattatcaagagtagcctgacagttggcaataacaatgactgaatgaatgaataaatgaattctccaaagaaaatagttcatgtttccctagtatgagggaatacttgagatagttgttttgagaagggggccacagaccaggagacaccaataagtctttctcatttctggtaaatcgctttataatgaccgttattataaagtgtaaaaacaacaacaacaaaaaataataggcgcagtggttcacacctataatcctagcactttgggaggcagaggcgggcggatcatttgaggtcaggagtttgagaccagcctggccaacatgatgaaaccctgtctttactaaaaacacaaaaattagccgggcggtagtggcacgtgcctgtgtagtctcagctactcgggaggctgaggcaggagaatcacttgaacccgggaggtgaaggttgcagtgagccgagattgtgcccctgcactccagcctgggagacagagccagactccatttcaaaaaaaa

SEQ ID NO: 7898 - DNA, 787 bp, Homo sapiens; identical to SEQ ID NO: 6804

SEQ ID NO: 7899 - DNA, 222 bp, Homo sapiens
cacagctgcctctatccgagtggtctgtgcagggcgccagcagccaccctgatggagggcaggtctctaaaagcagcatcctttgccaggcacctgagaattttaaagtgaggatgcatctgtggcatcatcttcctaaaccaaatgatgtgtaattgcatagttgttgaactgtgtggttggtctatttctagcagagtagctacctgagaggaaatgaga

SEQ ID NO: 7900 - DNA, 222 bp, Homo sapiens; identical to SEQ ID NO: 7899

SEQ ID NO: 7901 - DNA, 4454 bp, Homo sapiens; identical to SEQ ID NO: 6802

SEQ ID NO: 7902 - DNA, 428 bp, Homo sapiens
cagaagacataccagtcaatgggttcttgaaatagtcaaggaatgtggcaattcacgctggatgtggaaggtggaaggaaagacaagtgttagcaaatgcagacctgtctgctgtggaacttgaagaccttgctagtagtcaggctgcttcctggcattccaggcctgagaggcttctattttgactcaaagcaaaaacaaatgctatgttaatgtcttcctatgtgtccccttcataagattttggtgaaatcatattaaaagtgcatttctcagtatcactctcagttatttagagatttcagttccccagtaccctggcaagggatttgacgaacgtagcaagaacgtcgtgaactttgagctaatttatatcattgttcatttgtctgtttaataaataaaagcaagaaaaccagagcaacaaa

SEQ ID NO: 7903 - DNA, 428 bp, Homo sapiens; identical to SEQ ID NO: 7902

SEQ ID NO: 7904 - DNA, 428 bp, Homo sapiens; identical to SEQ ID NO: 7902

SEQ ID NO: 7905 - DNA, 7337 bp, Homo sapiens
gtgtgcctggatgattgatagcttcggaaatgaggaacagaggcacaaattttgcccaccgctctgtaccatggagaagtttgcttcctactgcctcactgaaccaggtgaatttgccacactgcactgagatatagcagggagagatgcttcctgctcagatggcattaccgagcactccttccagcctcttgacatgtcgagccactgtttatctagctgtttggttgaggagtaatagagtcctgtgacctgatgtcacaaggaccaagaagctatctggtgtgttgggaggtaggcagtggcctgactggtatgagcagtttccaccaagtacagagagttcctttggccacttgggttttgcagtgacacactctgagcagggtctgtttagagaagatttcctagaagatagaattgtgctgggctccctcgacctcactgactttctcaccttctctctgctgccttttgatccctcctcaggaagtgggagtgatgctgcctctcttctgacctccgctaagaaacagggagatcattacatcctcaatggctccaaggtactagcgtgcgtcctcccagagcactttggagattgttcccagcttcctcctgacatcctctggttccttcacatccgcgggttaatactcccataggatttttatgtgttgggaagagaacctctgacccatttctctttctttattctcactgtttgtatctctcctaatctgattccagatcatttcgttgacttttgtctatcctttttatactctcttggactgcctctctgatctgcagtcactgcagcgaccttttacctcacctcagtctctgtgccattggaccttattgtcagtctctgtgccattggaccttattgtcagtctctgtgccattggaccttattgtcagtctctgtgccattggaccttattgtcagtctctgtgccattggaccttattgtcagtctctgtgccattggaccttattgtcaggaggacccagtggtgttcccagacgctgtgagaactcaagcattccctggtccttttgcaccccttttacccccacaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtgagtggctgttggacaggaaacaattcaggttatgagactctgccacctgccagcccaactcctgctctatttcagaaaacaggtttgcatacttgctaacctacctttgaagcagttgcttctattaggattttcaacaggagcatatgaaatacaacagggcattattaaacactaggcctctggggaaagtgacaatgtttgccagtaaattcttcaagccacctgtgagtgttctgacctctcctgcctctgcttttggcctgtgttccttatccagctgcttacgttggtgcactttgttgctccaggaagagacgcttagagaagacctggtgttggccacaagtctcagtaatggaaggcgtgtggtcccttttgcttctttgattaaaaataaagtaaaactcattggagatgattgtgggtatttcagcaacccaagaaggacacttaggtactgtaagtaatttgaaaagtaagatacttctaggattaagagccgccatggccagggcatgaacaggagacctgtgatcatgtaaccgtaattggtaataagggctcaagacccattcagattttttagaccagatgctcaaagcagtcatctctctctagtttgtactgttatggggggactttgtgagagaaggcaggtaatgaaatgacccctaagtgtacctctttctcacagctcctcgggtttctgtattttcctacaggatccttcctgatcctctgtaactgtaaggcattatgcattttagcatccccttctctttggtaacacagcaaccatttcctaggcttctactgtgtgtgaagcccatgctaactcctgggcaggaagaccttcagtaaaaggcttagaaatggagtttatcctatcaacaaaagagagcaaggaaatgatgtaaaggcagtctattttcagagccagagaggaactgggagattgtagatagtttgtggttttcaattagaggcactgaaattgggggcagttggtgtcacaatcctaaaagaagttgtgagaagtgtttgtaggttagtcaggtagagtagacattagtagattctcttaataagttagaaaatgtttagctgaaacaggtatctttctgagtgctgacaggcctttaaacctgaactttttctttttcctcattttaagttcttgtgggtctaagtcttgggtgctgaaacccatacctcacaggctcccgtccccagggaaggccgccctacctgctggattgttgggcaaccacgcagtccctgatttttgccaggtggggtggaactcccagccaacacgagctgtgatcttcgaagactgtgctgtccctgtggccaacagaattgggagcgaggggcagggcttcctcattgccgtgagaggactgaacggagggaggatcaatattggtgagatacgcaggggtgtggcagggaggtagcggtccgggacaggcactgctgttttccagcttggttggaacgtcggcgctcttcccctctagcttcctgctccctgggggctgcccacgcctctgtcatcctcacccgagaccacctcaatgtccggaagcagtttggagagcctctggccagtaaccaggtaacctctgccttgcctccacatggctttgcactatttgcagcccgggacctgctctagggcccacatttccaggagagaagccaggaaattcctctgtcagtcccaccactgtcctagccagagcttgtgctttatttctgtccatcttttcttgggatatctttaacgatattaaagtgtcgggtgagtgaagtggacttagcacttaaaagcaataaatttcctctatagaaaaagcaagagactttgaagctttggatcacttagaaaaggcgcctccgagatgtcttaccgaggctcctgcaccaggtgctggtctaagcccctcagtcttgtctggttctctgctccctgtgctgcagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccgtaagtgattcctctggctctcctgggatggacagggaacagctgctaggcccaggggtcttgagagacatgagtcagatttggaacccagccctcctggaatcccacaaggatcaccttaagcttaaggatataaatgaactcatgagcggcctatgtgggagctctcatcgctggcttttaggcctgctgcatgccattatacacttcattatgtcactgttgtttggttgtgttctaggcgagaaaccacctttggaaggttcacagcagccccaatttagcactctgccatgtttacattgtcaggctgcattgccactagggggaaccatagctttttatcatcccagccagggtggctgtgggcagcttctgcctggcaggtaataagggagaggggcagagggctttgagtcgcctgtctggggggaactgacaagtttagtaggtgaacttcccttgtctctaaccatacagaatgtggaggccctctttgagcttggctgtttgtggttctttcatgggtttatggcgggctgccagatcgtgggctggggtaggaagggaagctgcttgctccacagtcttcccagagtccaagacgtctagtccctgtctccctgcagatctgcaaccaggccttgcagatgcacgggggctacggctacctgaaggattacgctgttcagcagtacgtgcgggactccagggtccaccagattctagaaggtaaaaattgccagaggttattctcttcccttcagaacggggacgggatcgctgctttccccactctctgtccccatgcctcctgggcctcagggtgcagtcaagccctgtctgtctcgaggcttcctcctccctcccgttccacagagctgttctggcaggggcctggagtccagagccgcagcttcgtccctttcggggggcctcagatcgctctgctgctgcccttttcctctggagatctgcgagaagggtgaactgagataatggatgagaaagcatgttgaaaaccacagccggggcttttctctaaggttatcgagtacgtggttctcagggatccaagaacagtgatggacaaggcaaatgtgagccagtatggtcatcagtagctctatattgattatcagccagatggcctaaaagatacctgtctcaatattactagtgtatttttcaataaaataaaccatcactatatgggtatcttcttggtagtcacagacattctatcgaggaaacatggaagccgttggggtcgggctcggagcctggctgtctccactctctacagccagtgcggaagtcttgaaatgacacgactcttggaaaagcaggaggggcagaggcttctttgagtgacttcggtgaagcaacgtgaggctgccttgctggaaacattatataatggggcttccctgcccctttcacagcacccttctcaaacctcagcctgtgctggaatcgcctggagggcatgggagcgcagattgcgggcctcaaccccagagcttctgctccagagggtctagtgtgggcctgggaatttgtatctgcaacaagtcttcaagtgaggctgccacagcttgtctgagaaccacactttgagacccaccgctctggtgttaatgtcagagtcacaggctaccacaggttagaccgctgctttcttctgcaaacctcattccagaaagatgtttatgggctcagtcgccagtgttcaaactgaattcccgagagtcgttttccttccattactcttggaattgctttctcactgagctttatgtgcgtaggaaacttcgccttcattctaactctctctccaccctgcaataataagcaggaaaacatttattgtaggccacaccatcacccacttacagaagaattggggcactcatcactgtatcactttgtttcatcatggactttactgttggataaatctacagtttatgctttatttgagacgatgtgactactgattcctcgagggggtttatatttctttttgcattaaaggccactgctaaaaatgaagcaaataattgataccctcctttcagggaaaatgttttcattcttttgtaagtcagttttctgattaccaaagaaatgtgtatttattgttgaaaccttataaaattaggaaaagtaggctgggtgcggtagcttatgtctataatcgccgcactttgggaggctgaggcgggtggatcgcgtgaggccaggagttcgagaccagcttggccaacccggtgaagccccgactgtctaaaattataaaaagttagctgggcgtggtggtgcatgcctggaatcccagctactcgagaggctgaggcaggaagatcgcttgaacccaggaggtggaggttgcagtgagctgagattgcaccatcgcactccagcctgggtgacagtgagactccatctaaaaacaatacaaaaaattagccgggcctggtggggcctggtggcacatgcttgtggtcccagctactcaggaggctgaggcaagagaattgcttgaacctggggggcggaggttgcagtgagccaagatcacaccactgcactccagcctgggcgacagcaagactgtctcaaaagaaaagtaaaagaaaaaaaatcactcatgtttctacatccagaatgttattttggtacatctccttttaggcattttactctgcctttgttggtacatttttaattttaattagaattatcctgtatatactgtttttattctgcctttttaaactttatataagcatttttaccatcagaagaagtttttaaaaaagtattatttcctgacatttttcagtactttgtagagaagtctctgataatctcatctctcccaggctaaaagcaatgattgtagtttaaatctgcagctactctgaactaggcctggagcagcctggtcagagctttactaaactctcagactttgctgctgtgaaattcttcctccttcctccctcttacaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaa

SEQ ID NO: 7906 - DNA, 7366 bp, Homo sapiens
gtgtgcctggatgattgatagcttcggaaatgaggaacagaggcacaaattttgcccaccgctctgtaccatggagaagtttgcttcctactgcctcactgaaccaggtgaatttgccacactgcactgagatatagcagggagagatgcttcctgctcagatggcattaccgagcactccttccagcctcttgacatgtcgagccactgtttatctagctgtttggttgaggagtaatagagtcctgtgacctgatgtcacaaggaccaagaagcctatctggtgtgttgggaggtaggcagtggcctgactggtatgagcagtttccaccaagtacagagagttcctttggccacttgggttttgcagtgacacactctgagcagggtctgtttagagaagatttcctagaagatagaattgtgctgggctccctcgacctcactgactttctcaccttctctctgctgccttttgatccctcctcaggaagtgggagtgatgctgcctctcttctgacctccgctaagaaacagggagatcattacatcctcaatggctccaaggtactagcgtgcgtcctcccagagcactttggagattgttcccagcttcctcctgacatcctctggttccttcacatccgcgggttaatactcccataggatttttatgtgttgggaagagaacctctgacccatttctctttctttattctcactgtttgtatctctcctaatctgattccagatcatttcgttgacttttgtctatcctttttatactctcttggactgcctctctgatctgcagtcactgcagcgaccttttacctcacctcagtctctgtgccattggaccttattgtcagtctctgtgccattggaccttattgtcagtctctgtgccattggaccttattgtcagtctctgtgccattggaccttattgtcagtctctgtgccattggaccttattgtcagtctctgtgccattggaccttattgtcagtctctgtgccattggaccttattgtcaggaggacccagtggtgttcccagacgctgtgagaactcaagcattccctggtccttttgcaccccttttacccccacaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtgagtggctgttggacaggaaacaattcaggttatgagactctgccacctgccagcccaactcctgctctatttcagaaaacaggtttgcatacttgctaacctacctttgaagcagttgcttctattaggattttcaacaggagcatatgaaatacaacagggcattattaaacactaggcctctggggaaagtgacaatgtttgccagtaaattcttcaagccacctgtgagtgttctgacctctcctgcctctgcttttggcctgtgttccttatccagctgcttacgttggtgcactttgttgctccaggaagagacgcttagagaagacctggtgttggccacaagtctcagtaatggaaggcgtgtggtcccttttgcttctttgattaaaaataaagtaaaactcattggagatgattgtgggtatttcagcaacccaagaaggacacttaggtactgtaagtaatttgaaaagtaagatacttctaggattaagagccgccatggccagggcatgaacaggagacttgtgatcatgtaaccgtaattggtaataagggctcaagacccattcagattttttagaccagatgctcaaagcagtcatctctctctagtttgtactgttatggggggactttgtgagagaaggcaggtaatgaaatgacccctaagtgtacctctttctcacagctcctcgggtttctgtattttcctacaggatccttcctgatcctctgtaactgtaaggcattatgcattttagcatccccttctctttggtaacacagcaaccatttcctaggcttctactgtgtgtgaagcccatgctaactcctgggcaggaagaccttcagtaaaaggcttagaaatggagtttatcctatcaacaaaagagagcaaggaaatgatgtaaaggcagtctattttcagagccagagaggaactgggagattgtagatagtttgtggttttcaattagaggcactgaaattgggggcagttggtgtcacaatcctaaaagaagttgtgagaagtgtttgtaggttagtcaggtagagtagacattagtagattctcttaataagttagaaaatgtttagctgaaacaggtatctttctgagtgctgacaggcctttaaacctgaactttttctttttcctcattttaagttcttgtgggtctaagtcttgggtgctgaaacccatacctcacaggctcccgtccccagggaaggccgccctacctgctggattgttgggcaaccacgcagtccctgatttttgccaggtggggtggaactcccagccaacacgagctgtgatcttcgaagactgtgctgtccctgtggccaacagaattgggagcgaggggcagggcttcctcattgccgtgagaggactgaacggagggaggatcaatattggtgagatacgcaggggtgtggcagggaggtagcggtccgggacaggcactgctgttttccagcttggttggaacgtcggcgctcttcccctctagcttcctgctccctgggggctgcccacgcctctgtcatcctcacccgagaccacctcaatgtccggaagcagtttggagagcctctggccagtaaccaggtaacctctgccttgcctccacatggctttgcactatttgcagcccgggacctgctctagggcccacatttccaggagagaagccaggaaattcctctgtcagtcccaccactgtcctagccagagcttgtgctttatttctgtccatcttttcttgggatatctttaacgatattaaagtgtcgggtgagtgaagtggacttagcacttaaaagcaataaatttcctctatagaaaaagcaagagactttgaagctttggatcacttagaaaaggcgcctccgagatgtcttaccgaggctcctgcaccaggtgctggtctaagcccctcagtcttgtctggttctctgctccctgtgctgcagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccgtaagtgattcctctggctctcctgggatggacagggaacagctgctaggcccaggggtcttgagagacatgagtcagatttggaacccagccctcctggaatcccacaaggatcaccttaagcttaaggatataaatgaactcatgagcggcctatgtgggagctctcatcgctggcttttaggcctgctgcatgccattatacacttcattatgtcactgttgtttggttgtgttctaggcgagaaaccacctttggaaggttcacagcagccccaatttagcactctgccatgtttacattgtcaggctgcattgccactagggggaaccatagctttttatcatcccagccagggtggctgtgggcagcttctgcctggcaggtaataagggagaggggcagagggctttgagtcgcctgtctggggggaactgacaagtttagtaggtgaacttcccttgtctctaaccatacagaatgtggaggccctctttgagcttggctgtttgtggttctttcatgggtttatggcgggctgccagatcgtgggctggggtaggaagggaagctgcttgctccacagtcttcccagagtccaagacgtctagtccctgtctccctgcagatctgcaaccaggccttgcagatgcacgggggctacggctacctgaaggattacgctgttcagcagtacgtgcgggactccagggtccaccagattctagaaggtaaaaattgccagaggttattctcttcccttcagaacgggggcgggatcgctgctttccccactctctgtccccatgcctcctgggcctcagggtgcagtcaagccctgtctgtctcgaggcttcctcctccctcccgttccgcagagctgttctggcaggggcctggagtccagagccgcagcttcgtccctttcggggggcctcagatcgctctgctgctgcccttttcctctggagatctgcgagaagggtgaactgagataatggatgagaaagcatgttgaaaaccacagccggggcttttctctaaggttatcgagtacgtggttctcagggatccaagaacagtgatggacaaggcaaatgtgagccagtatggtcatcagtagctctatattgattatcagccagatggcctaaaagatacctgtctcaatattactagtgtatttttcaataaaataaaccatcactatatgggtatcttcttggtagtcacagacattctatcgaggaaacatggaagccgttggggtcgggctcggagcctggctgtctccactctctacagccagtgcggaagtcttgaaatgacacgactcttggaaaagcaggaggggcagaggcttctttgagtgacttcggtgaagcaacgtgaggctgccttgctggaaacattatataatggggcttccctgcccctttcacagcacccttctcaaacctcagcctgtgctggaatcgcctggagggcatgggagcgcagattgcgggcctcaaccccagagcttctgctccagagggtctagtgtgggcctgggaatttgtatctgcaacaagtcttcaagtgaggctgccacagcttgtctgagaaccacactttgagacccaccgctctggtgttaatgtcagagtcacaggctaccacaggttagaccgctgctttcttctgcaaacctcattccagaaagatgtttatgggctcagtcgccagtgttcaaactgaattcccgagagtcgttttccttccattactcttggaattgctttctcactgagctttatgtgcgtaggaaacttcgccttcattctaactctctctccaccctgcaataataagcaggaaaacatttattgtaggccacaccatcacccacttacagaagaattggggcactcatcactgtatcactttgtttcatcatggactttactgttggataaatctacagtttatgctttatttgagacgatgtgactactgattcctcgagggggtttatatttctttttgcattaaaggccactgctaaaaatgaagcaaataattgataccctcctttcagggaaaatgttttcattcttttgtaagtcagttttctgattaccaaagaaatgtgtatttattgttgaaaccttataaaattaggaaaagtaggctgggtgcggtagcttatgtctataatcgccgcactttgggaggctgaggcgggtggatcgcgtgaggccaggagttcgagaccagcttggccaacccggtgaagccccgactgtctaaaattataaaaagttagctgggcgtggtggtgcatgcctggaatcccagctactcgagaggctgaggcaggaagatcgcttgaacccaggaggtggaggttgcagtgagctgagattgcaccatcgcactccagcctgggtgacagtgagactccatctaaaaacaatacaaaaaattagccgggcctggtggggcctggtggcacatgcttgtggtcccagctactcaggaggctgaggcaagagaattgcttgaacctggggggcggaggttgcagtgagccaagatcacaccactgcactccagcctgggcgacagcaagactgtctcaaaagaaaagtaaaagaaaaaaaatcactcatgtttctacatccagaatgttattttggtacatctccttttaggcattttactctgcctttgttggtacatttttaattttaattagaattatcctgtatatactgtttttattctgcctttttaaactttatataagcatttttaccatcagaagaagtttttaaaaaagtattatttcctgacatttttcagtactttgtagagaagtctctgataatctcatctctcccaggctaaaagcaatgattgtagtttaaatctgcagctactctgaactaggcctggagcagcctggtcagagctttactaaactctcagactttgctgctgtgaaattcttcctccttcctccctcttacaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaa

SEQ ID NO: 7907 - DNA, 9308 bp, Homo sapiens
cttccatgggacttaatgaagagcagaaagaatttcaaaaagtggcctttgactttgctgcccgagagatggctccaaatatggcagagtgggaccagaaggtaggcgtttttcttgtgcttagacgttctaacaacagatgtctcaggcagacctttatctttgtctcccgataatgtaattgttaaatgtctcctccacttaccaactcttactgcaagtgagaataccggtagtggatgatttttcctagaaggcatcctgatcatcttgtacataactttttttttgttagttgaataaagatttggatataaaactaaggcagttctatagataataaaaagaaacttcttaatgccagaacaagtttttacaggacccatgttaactgataaccactgtaagatgacaaacaggcatattaagagaattcatacgctgtcgcatgtgcaagcctcctaatccctcactgtgccctctaaaaggaaggccgtctctgaatcagctgctgatcaccctgctctcttttgtacgtaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaagtgagtgcccaagcttggaaggcacaatgaagtgctcactcgggctgactgtgagagttcagattcgtaggaaaaagattgatcttttgaagctgagtgtcctcaaggaactggacttaaaagtacactctaggggccgggcgcagtggctcgtgcctgtaatcccagcactttgggaggccaaggcaggcagatcacgaggtcaggagtttgagaccagcctggccaacgtggtgaaaccccgtccctgctaaaaatacaaaaaattagccgggtgtggtggctggcgcctgtagtcccagctactcgggaggctgaggcaggaggatggtgtgaacccgggaggcggagcttgcagtgagccgagatggaccactgcactccagcctgggcgacagagcgagactccatctcaaaaaaaataaataaataaaataagtacacgctaggtctgttgctgcctgttggacttgattctgtcatcctgtgtattgcttagggaatcaggtcagccagctttctcagaaatcttattttgagctggtaccaggagacttctccaatagagtgatcagggtcctctcacccttttatttatttatttatttttaagacagagtctcgctctgttgcccaggctagggtgcagtggcatgacctcggctcactgcaacctccgtctccccggttcaagtgattctcctgcctcagcctcctgagtagctgggattacaggcacgtgccaccacacctggctaattttttttcatatttagtagagatggggtttcaccatgttagtcaggctggtctcaaactcctgaccttgtgttctgcctgcctcggcctcccatagtgctgggattacagatgtgagccaccgcacccggcccctctcacccttttcctcaatccaaagatggaactgccagtgatttgaggaagtaatagaaactactaatagaaagcacatataactctgatttttagaggctcgtgtaacctaactagaagtagtacaaacgtgctggtgagaagtacctcagcctggttatctctgggtagtccttattccaggaatatgttttaatccaccgtttgcctttaaagagtcttcccaattgtgactctccccttcccactcttctgctttactccactgccctgccctttgttctctttccccttctcccccatttttttttcttttccatctttatttctgtcattgtcttttcttcttggtgtacctatcagcatgtgtgcctggatgattgatagcttcggaaatgaggaacagaggcacaaattttgcccaccgctctgtaccatggagaagtttgcttcctactgcctcactgaaccaggtgaatttgccacactgcactgagatatagcagggagagatgcttcctgctcagatggcattaccgagcactccttccagcctcttgacatgtcgagccactgtttatctagctgtttggttgaggagtaatagagtcctgtgacctgatgtcacaaggaccaagaagctatctggtgtgttgggaggtaggcagtggcctgactggtatgagcagtttccaccaagtacagagagttcctttggccacttgggttttgcagtgacacactctgagcagggtctgtttagagaagatttcctagaagatagaattgtgctgggctccctcgacctcactgactttctcaccttctctctgctgccttttgatccctcctcaggaagtgggagtgatgctgcctctcttctgacctccgctaagaaacagggagatcattacatcctcaatggctccaaggtactagcgtgcgtcctcccagagcactttggagattgttcccagcttcctcctgacatcctctggttccttcacatccgcgggttaatactcccataggatttttatgtgttgggaagagaacctctgacccatttctctttctttattctcactgtttgtatctctcctaatctgattccagatcatttcgttgacttttgtctatcctttttatactctcttggactgcctctctgatctgcagtcactgcagcgaccttttacctcacctcagtctctgtgccattggaccttattgtcagtctctgtgccattggaccttattgtcagtctctgtgccattggaccttattgtcagtctctgtgccattggaccttattgtcagtctctgtgccattggaccttattgtcagtctctgtgccattggaccttattgtcaggaggacccagtggtgttcccagacgctgtgagaactcaagcattccctggtccttttgcaccccttttacccccacaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtgagtggctgttggacaggaaacaattcaggttatgagactctgccacctgccagcccaactcctgctctatttcagaaaacaggtttgcatacttgctaacctacctttgaagcagttgcttctattaggattttcaacaggagcatatgaaatacaacagggcattattaaacactaggcctctggggaaagtgacaatgtttgccagtaaattcttcaagccacctgtgagtgttctgacctctcctgcctctgcttttggcctgtgttccttatccagctgcttacgttggtgcactttgttgctccaggaagagacgcttagagaagacctggtgttggccacaagtctcagtaatggaaggcgtgtggtcccttttgcttctttgattaaaaataaagtaaaactcattggagatgattgtgggtatttcagcaacccaagaaggacacttaggtactgtaagtaatttgaaaagtaagatacttctaggattaagagccgccatggccagggcatgaacaggagacctgtgatcatgtaaccgtaattggtaataagggctcaagacccattcagattttttagaccagatgctcaaagcagtcatctctctctagtttgtactgttatggggggactttgtgagagaaggcaggtaatgaaatgacccctaagtgtacctctttctcacagctcctcgggtttctgtattttcctacaggatccttcctgatcctctgtaactgtaaggcattatgcattttagcatccccttctctttggtaacacagcaaccatttcctaggcttctactgtgtgtgaagcccatgctaactcctgggcaggaagaccttcagtaaaaggcttagaaatggagtttatcctatcaacaaaagagagcaaggaaatgatgtaaaggcagtctattttcagagccagagaggaactgggagattgtagatagtttgtggttttcaattagaggcactgaaattgggggcagttggtgtcacaatcctaaaagaagttgtgagaagtgtttgtaggttagtcaggtagagtagacattagtagattctcttaataagttagaaaatgtttagctgaaacaggtatctttctgagtgctgacaggcctttaaacctgaactttttctttttcctcattttaagttcttgtgggtctaagtcttgggtgctgaaacccatacctcacaggctcccgtccccagggaaggccgccctacctgctggattgttgggcaaccacgcagtccctgatttttgccaggtggggtggaactcccagccaacacgagctgtgatcttcgaagactgtgctgtccctgtggccaacagaattgggagcgaggggcagggcttcctcattgccgtgagaggactgaacggagggaggatcaatattggtgagatacgcaggggtgtggcagggaggtagcggtccgggacaggcactgctgttttccagcttggttggaacgtcggcgctcttcccctctagcttcctgctccctgggggctgcccacgcctctgtcatcctcacccgagaccacctcaatgtccggaagcagtttggagagcctctggccagtaaccaggtaacctctgccttgcctccacatggctttgcactatttgcagcccgggacctgctctagggcccacatttccaggagagaagccaggaaattcctctgtcagtcccaccactgtcctagccagagcttgtgctttatttctgtccatcttttcttgggatatctttaacgatattaaagtgtcgggtgagtgaagtggacttagcacttaaaagcaataaatttcctctatagaaaaagcaagagactttgaagctttggatcacttagaaaaggcgcctccgagatgtcttaccgaggctcctgcaccaggtgctggtctaagcccctcagtcttgtctggttctctgctccctgtgctgcagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccgtaagtgattcctctggctctcctgggatggacagggaacagctgctaggcccagcgggtcttgagagacatgagtcagatttggaacccagccctcctggaatcccacaaggatcaccttaagcttaaggatataaatgaactcatgagcggcctatgtgggagctctcatcgctggcttttaggcctgctgcatgccattatacacttcattatgtcactgttgtttggttgtgttctaggcgagaaaccacctttggaaggttcacagcagccccaatttagcactctgccatgtttacattgtcaggctgcattgccactagggggaaccatagctttttatcatcccagccagggtggctgtgggcagcttctgcctggcaggtaataagggagaggggcagagggctttgagtcgcctgtctggggggaactgacaagtttagtaggtgaacttcccttgtctctaaccatacagaatgtggaggccctctttgagcttggctgtttgtggttctttcatgggtttatggcgggctgccagatcgtgggctggggtaggaagggaagctgcttgctccacagtcttcccagagtccaagacgtctagtccctgtctccctgcagatctgcaaccaggccttgcagatgcacgggggctacggctacctgaaggattacgctgttcagcagtacgtgcgggactccagggtccaccagattctagaaggtaaaaattgccagaggttattctcttcccttcagaacggggacgggatcgctgctttccccactctctgtccccatgcctcctgggcctcagggtgcagtcaagccctgtctgtctcgaggcttcctcctccctcccgttccacagagctgttctggcaggggcctggagtccagagccgcagcttcgtccctttcggggggcctcagatcgctctgctgctgcccttttcctctggagatctgcgagaagggtgaactgagataatggatgagaaagcatgttgaaaaccacagccggggcttttctctaaggttatcgagtacgtggttctcagggatccaagaacagtgatggacaaggcaaatgtgagccagtatggtcatcagtagctctatattgattatcagccagatggcctaaaagatacctgtctcaatattactagtgtatttttcaataaaataaaccatcactatatgggtatcttcttggtagtcacagacattctatcgaggaaacatggaagccgttggggtcgggctcggagcctggctgtctccactctctacagccagtgcggaagtcttgaaatgacacgactcttggaaaagcaggaggggcagaggcttctttgagtgacttcggtgaagcaacgtgaggctgccttgctggaaacattatataatggggcttccctgcccctttcacagcacccttctcaaacctcagcctgtgctggaatcgcctggagggcatgggagcgcagattgcgggcctcaaccccagagcttctgctccagagggtctagtgtgggcctgggaatttgtatctgcaacaagtcttcaagtgaggctgccacagcttgtctgagaaccacactttgagacccaccgctctggtgttaatgtcagagtcacaggctaccacaggttagaccgctgctttcttctgcaaacctcattccagaaagatgtttatgggctcagtcgccagtgttcaaactgaattcccgagagtcgttttccttccattactcttggaattgctttctcactgagctttatgtgcgtaggaaacttcgccttcattctaactctctctccaccctgcaataataagcaggaaaacatttattgtaggccacaccatcacccacttacagaagaattggggcactcatcactgtatcactttgtttcatcatggactttactgttggataaatctacagtttatgctttatttgagacgatgtgactactgattcctcgagggggtttatatttctttttgcattaaaggccactgctaaaaatgaagcaaataattgataccctcctttcagggaaaatgttttcattcttttgtaagtcagttttctgattaccaaagaaatgtgtatttattgttgaaaccttataaaattaggaaaagtaggctgggtgcggtagcttatgtctataatcgccgcactttgggaggctgaggcgggtggatcgcgtgaggccaggagttcgagaccagcttggccaacccggtgaagccccgactgtctaaaattataaaaagttagctgggcgtggtggtgcatgcctggaatcccagctactcgagaggctgaggcaggaagatcgcttgaacccaggaggtggaggttgcagtgagctgagattgcaccatcgcactccagcctgggtgacagtgagactccatctaaaaacaatacaaaaaattagccgggcctggtggggcctggtggcacatgcttgtggtcccagctactcaggaggctgaggcaagagaattgcttgaacctggggggcggaggttgcagtgagccaagatcacaccactgcactccagcctgggcgacagcaagactgtctcaaaagaaaagtaaaagaaaaaaaatcactcatgtttctacatccagaatgttattttggtacatctccttttaggcattttactctgcctttgttggtacatttttaattttaattagaattatcctgtatatactgtttttattctgcctttttaaactttatataagcatttttaccatcagaagaagtttttaaaaaagtattatttcctgacatttttcagtactttgtagagaagtctctgataatctcatctctcccaggctaaaagcaatgattgtagtttaaatctgcagctactctgaactaggcctggagcagcctggtcagagctttactaaactctcagactttgctgctgtgaaattcttcctccttcctccctcttacaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaa

SEQ ID NO: 7908 - DNA, 989 bp, Homo sapiens
tttttcttctatgccggacgtggtggctcacgcctgtaatcccaccactttgggaggccaaagcgggtggatcacaaggtcaggagtttgagaccaccctggccaacatggcaaaaccctgtctctactaaaaatagaataattagccacgtgtgggggggggcgcctataatcccacctactcaggaggctgaggcaggagaatcacttgaaactgagagacacaggtttcagtgagcccagatggtgccattgcactccagcctgggcgacacgagcaagattccgtctctcaaaaaaaagaaaagaaaagaaaaaagagaagagaaaagaagaaagaaagaaaggagattttgtctaatagttgaatttactccatttatatgtattgggataacaaacattttggagcctacatcttaccatatttcatgtggtatttgtattgtaatacttttttattatatgggctgtgctatactttctttttctatactccctttctgggaagactctgggatctcttttttatttttcctttttttcctacgggaatggcaaatagtgttctcacacgtttatgagcggtggagtataatctaagaaactgtgatgaaagtacatcgaaccactgcacgtgcacaaattgacaactgcaccttatggtgtgtagagagatttacaacgctcttaactctttatgtggatactttgctctatgtgaaagactttctttttgttctcttaaatagccttcacacataatttaaacctgtggctctgggctgtggatcctctttcatcataatcctgaaacatcatttgtcttttttactgatggggcacaaagcactgatggatgataaaactgatgatgcctcaccatgagtcaaggcggcggcaccacactgtgatagtaaatgtagtaatagacgcatgtgctttagtaagaaccacacactccactaaaaaaaaaaaaaaaaaaaaaa

SEQ ID NO: 7909 - DNA, 985 bp, Homo sapiens
tttttcttctaggccggacgtggtggctcacgcctgtaatcccagcactttgggaggccaaagcgggtggatcacaaggtcaggagtttgagaccagcctggccaacatggcaaaaccctgtctctactaaaaatagaataattagccaggtgtggtggtgggcgcctataatcccagctactcaggaggctgaggcaggagaatcacttgaaactgagagacagaggtttcagtgagccgagatggtgccattgcactccagcctgggcgacgcgagcaagattccgtctcacaaaaaaaagaaaagaaaagaaaaaagagaagagaaaagaagaaagaaagaaaggaaattttgtctaatagttgaatttactccatttatatgtattggtataacaaacattttggagcctacatcttaccatatttcatgttgtatttgtattgtaattcttttttattatatggtctgttctattctttctttttctattctccctttctgggaagactttggtatctcttttttatttttcctttttttcctaagggaatggcaaatagtgttctcacaggtttaggagcggtggagtagaatctaagaaactgagatgaaagtacatgaaccatgcaggttcagaaattgacaatgcagcttatggtgtagagagagatttacaacgctattaactttttatgtggattctttgctttatgttaaagtctttctttttgttctcttaaattgccttcacagataatttaagcctgtggctctggtctgtggatcctctttcatcataatcctgaaacatatttgtcttttttactgatggtacagaaagcaatgatggatgataaaactgatgatgccttaccatgagtcaaggcagcggcaccaaactgtaatagtaaatgtagtaatagtcgtatgttctttagtaagaaccaagcacttcagtaaaaaaaaaaaaaaaaaaaaaa

SEQ ID NO: 7910 - DNA, 988 bp, Homo sapiens
tttttcttctaggccggacgtggtggctcacgcctgtaatcccagcactttgggaggccaaagcgggtggatcacaaggtcaggagtttgagaccagcctggccaacatggcaaaaccctgtctctactaaaaatagaataattagccaggtgtggtggtgggcgcctataatcccagctactcaggaggctgaggcaggagaatcacttgaaactgagagacagaggtttcagtgagccgagatggtgccattgcactccagcctgggcgacgcgagcaagattctgtctcacaaaaaaaagaaaagaaaagaaaaaagagaagagaaaagaagaaagaaagaaaggaaattgttgtctaatagttgaatttactccatttatatgtattggtataacacaacattttggagcctacatctcaccatatttcatgttgtatgtgtagtgtaattcttttttattatatggtgtgttatattctttctttttatattctccctttctgggaagactggggtatctcttttttatttctcctttttttcataagggaatggcaaatagtgttctcacaggtttaggagcggtggagtagaatctaagaaactgagatgaaagtacatgacccatgcaggttcagaaattgacaatgcagcttatggtgtagagagagatttacaacgctattaactttttatgtggattctttgctttatgttaaagtctttctttttgttctcttaaattgccttcacagataatttaagcctgtggctctggtctgtggatcctctttcatcataatcctgaaacatcatttgtcttttttactgatggtacagaaagcaatgatggatgataaaactgatgatgccttaccatgagtcaaggcagcggcaccaaactgtaatagtaaatgtagtaatagtcgtatgttctttagtaagaaccaagcacttcagtaaaaaaaaaaaaaaaaaaaaaa

SEQ ID NO: 7911 - DNA, 8252 bp, Homo sapiens
cagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggtgggtgggacaatgttcaggcccttaggaaccctattccgcactttgcaagttggtgggagggcaggtgctccaacttacacaagaaaaagtgagagcttgctcacctgacccttatgtgctctggttcaagcatgatggtggattagagcctgtgggttacaaacccaggctttaggctccagcagacaggcttcaagacctggcttcagtgcctgacataactgcacaaccttggcaagttactttctctgagtcttactttcttcacatacaaaaaggagctaatacaatatttgagctcacagatgattaaatacagtgacaaatgagcagcacttggctggcacctagaccactgagcaagtagtcactattacctaggaaccttgaggatgaaacttttcctttcctgagggtcacgagaaaccaatttccctctcggggttctgggtattttctctctctctctattttttttttttttttgagaagggctcgctctgtcgcccaggctggagtgcagtggtgcgatcacagctcactgcagcctcagtctcctaggctcaggtgatcctcttacctcagcctcctgagtagctgggaccaaggtacatatcactacgcctggcttttttttaatatttttggtagagatggggttttgccatgttgcccaggctggtcttgaactcatgggctcaagcactcctcccatcttggcctctcaaagtgctgggattacaggcgtgagccactgcacctggctccctgagttgctaagtcagactttctcgctgcatcttcctaaaggaattggagataaagctctcgatataatagaatagcatagaattttgtagaaatctcatattctgtcattttcatgaaatgtttcctactctatatccagaagttctcccattgcacatggcagctctacctgcctcacattctgttataaaatgttacagtacccagcactttgggaagaggcgagtggatcgcttgaggccaggagttcagggctgctgtgatcacaccactacactccagcctgggtaacagagcaagaccctgtctcaaaaaaattaaaatggggctgggtgcagtggctcacatctgtaatttcagcactttgggaggccaaagtgcgaggttcccttgagcccaggattcatgaccagcctgggcaacatacagagaaaccgtctctataaaaaataaaaattaattagctgggcatggtggtacatgcctgcgatcccagctacttgggaggctaaggcgggaagattgcttgagccctggagatcgaggctgcagtgagcgtaatcatgccactgcactctagcctgggcaacagagtgaaaccccgtctcaaaaaaaaaaaaaatttaaatgttgcagtaaaagtgtgtcatatcaatacttaaattaagaaaaataaaacccatcttcctgtaggttggaggctgccgtgtctgatggtggatacttctgctattcaaaagggaactctcccatgactcccaagcaccactgatgcaaaattttcatttcatgctacacactatatagttttattatgtcatttaatctctgtgttataaattaacacactacaggcctctcagttgctcacgcagtcactgccacagttctgccaggcttctccaacccacccgcacggcccagaagggagctcggaaagcagctggaactatcagggtgattaaaggagaaaccaggggacagagaggaagaggcactccacccaaaacatttaaagagacagcttgctttttttaaaattgccaattagccaggtgcaaaacaaaaacccatcatttagaaggtgatacctctattttcacttttctatttgcaaagaactggaagttcaacaaataaatgctcaaatcaaaactaatcaaaaattaaaactgttttaggaactgcatagacttctccgagccccaggccgatcctgctgtgtttaaccagcatgtactgacttgctgttttgcatgaggggactgacaaatttgtttatgctgcacattcattatgcagaagctgcagattttgctttacatcatgtttcctaaaaacatttttagactctgctgtcattctgcaagctgatgtgggttgggggtgcgtacagagtgcttgatggtttttggtgaagctcaattttgatccctacccatagtgtttgctttctggtgaaaataacttgatgatgcccaatcaccaatgcagggccaccctgatgatggggggagaggaagggcctgtagttaagagtacacagtatgctgggtgcctgacagacactcttcttcccgcccttcaagggtgaggaaatcaaggctcagcgaggttaagttactggccaaggtcaaccattttacaaagaaccgctgctctttttttccattcagtccattctttcaattaaaacccagtttctttctttaaggggaaaaataaagtgaggcgagtgaagaccatttatgactgccaggcagacaacgatgacgagctcacattcatcgagggagaagtgattatcgtcacaggggaagaggaccaggagtggtgggtacgtacgaatatccatccacttcatccgtacattcatacagcatgcctgggcaggcaccacattggagcctacagacagtgcagtaaaagagggctcttgagcacaaggaccctgtcagctgcatcactcacccaacagccattgcatttggtgtcttttctatgtcacacactattacatgctagaaaaacagccgtggagctggccgggcacagtggctcacgcctgtaatcccagcactttgggaggctgaggcggatggatctcgaggtcgggagttcgagaccagcctggccagcatggtgaaaccccgtgtctactaaaaatacaaaaaattaactgggcatggtggcacgcacctgtagtcccagctactcaggaggccaaggcaggagaatcgcttgaacccgggaggcacaggttgcagtgagatgagatcacaccactacactccagcctgggcaacagagcgagactccatctgaaaaaaaagaaaaacagccatggggctttgaagacaggtcaagagaattaacatttgtatgtactttacccatggtatcatgtaaccttgtgagttgtaggcattttctgatttttcatataaatactaaagcggaagaaagttgagcatgttgcctgtggtccctcagccagtaagcaggctaagtcaagattccagatcggccctgaccccagagcctatgtgctttgctcaccattccacactgtccccaggctgggaatcagaatgcccaagttcctgctcaggctgagcagttgacaagtcctcagactcaattcttaatccagtctgcagttctttctttgtcaaataggccaagacaccttctccacgtaattttaggaaaagattaaatgaaaatatctatgaaaactccttttacattaaaacctgcagctcaggcatcaggagggaaagacatcagcatcctcataggccctgctaggtacccaggctgtgagtgacctgcgagggcagtccacacatctattggttttcacgttgccagggagtaagtctcccgatgggaactgccaggccaaggtacagtgaataagccacctcttctgctctccttgttgatcatttcctgacatcagggtgaaaattccccttccttggcagcctgagccccgtcctgccaagagggactcagttctgtctgccaggaagggacctgaggctcgcagttgagccagcagtacctaagaatacccagaaatacatatgtatatacatgtgtgcacacacacataggcatgggcacacattcacctttgacttttcttccttcaggcctagacagtgacctcagattcttaatcacagctgtagggattttgtttggactcaactggggcaattttgccctccagggacatttacaatatctggaaatattgattgtcaggacctaggaagggggttgctaccaacaactagtagatggaagtttagtggccagggatgccactaaacatcctccagtactcagggagcccccacaagcaaggatgccagtagcaccatggttgagaaactggactgaagggatcagcctggggaggcccaggggtacctccagcctctgtcagcagagtggggccagccctggcatgaagcctgtcagagagtccacttcatctcatgacgaggaggtgggctctgaagcccccccacgtgaatcagttactagctctatgggccttggataaagcatgtcccttctgtaagcctcactttcctctgaaaaataggacatgattaatcgtttctcacaaggatgttgaggaactcactttgtaatctgttaatattattataatcaagcagtgatcatgttctttgctaagcaactgatgactacagcagagatacctgcggggaatgggaagctgtcattggtgtccctagcatcattcctaggggacattgtgtgtgccaccattacgtgcctcgccagatgtaaagatggtgccacacacacatgctaactgtgatgtgaaattcacaaagacctcacacatgcatgatgccaactaagaccacacgcggtgggtgggcaagccttcaggagagctgggcaggcctggttgactctgttccactcttaaaaccaccttcctctctatcgatttggcattggaagccaatatgcacgattttgttttttctattgaaggcccattacatgattctctttagtgcaatcaatactaatctaattgaggtaattagaaaatttttacaggtaactggcttacaggccaatgcagcagacaataaaattgccattcgccaccatcagtctcaaactttcacagtattcttcctccacggtaaccagaaaacaagtgatagtacatagcagccttttttttttttttttactggctagaacaacactttactcacaaagagaagagacagaacaagattagctttgatttgagtatggtaccccgcagtgggtcttgccaggcagctgacacagcttaatggtctgtatgcatcctacctgggctgtgggcaaagaaaccccttccttcccaactaggaataggtaatagtactgggattggccaggtgccatagcagccttttcatttgcttttttttttttttttcttttttaaatgtatcacacaagcctggagagaagggattttctttagccccacttaacagagaaaaggcttagcaaggtttgtgtgaggtcacccagctgtaaaggcagccaggcgccctggttcagagcaaggactctagagccccacgcctgtgggagagcatgtcacctctctgggccactgtcccttcatctgtaaaatgaagattgtaaactgtataagaaatatccacctcagggggttgctgtgtgggtacagcaagatccatgtagaatgctgagcatattggaagttctgtcgtttgctctttccttatgtagtttatgaccgttaagctctctgtagttcactaaagggtgggaagaagggtaagcctgggattccaccgccaggtctgtgggcagactaggctgggctcttacccactgggtttgtcgtggggccactgcctgctgcctccatcctgaccactctcttttctccctgcagattggccacatcgaaggacagcctgaaaggaagggggtctttccagtgtcctttgttcatatcctgtctgactagcaaaacgcagaaccttaagattgtccacatccttcatgcaagactgctgccttcatgtaaccctgggcacagtgtgtatatagctgctgttacagagtaagaaactcatggaagggccacctcaggagggggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgccattaaagcagaaattataaggttgcaacaatatttgtttctaatcactggctttctcaagagtatggattgacatattgtgttatgaatgcacatctctcagatgtgttgaagcatccattgcatccattttttattattttcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcccagccatgtttatcagatccttaagaacattgtatttcagtcttttacatcagtctgaattttggaaaagaatgcaatagttgtactccacagtcagtggaactgttccctgagtccgaggctcatgtgtcattctggcactacatttgcttaaattgctattttggcaacagcacagaaaactaatatttttaagcagagaatcttggcaatgagtgagagatgttaatttcacagaagcacaactcccaacccaacccttaggaaaagccctcttccatcgttacagtgctcagtgaatattaatttagttctgcttaagtggttgctatacaaactttgaatagccacctaataaataaaccttgcatgacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcggtactgaagccacaccagtgtccggatggaagtctgcatctgaggttgctcagtgtcccggtcattcatttacacattttaacttgcattaaagagctgttcttttctgtggcctagactcttttcactgatctcaaaataaactggtttttttcaaaaaaaaaaaaaaaaacaaaaa

SEQ ID NO: 7912 - DNA, 14425 bp, Homo sapiens
caggctcagccgtgctgctcttcctggccatgccaatgctcaccattgggggaatcctgtttctcatcaccaacctgcaggtgggagccttccctaatcccaggcactcggcagggtggcgggaaggtggagggaaggagagacccttttctataattggctgcctcagatggggttggcccaagctgaggtgggagctctagcggtggagggtgagtttgggtataaggagggtctgccacatgctgggtgctcaggaagtatctgtttcatgaataaataagtgatccaggctagtcctatcatccccagattgggaacctatttggccaacaccgttcgaccatcatcactctgtacaatggagcatttgactcttcctcggcagtcttccttattattaaggtaaatatagcaacagcctacattcactgggcacttgtatatgccagacacttgtcttgtgaacctgcattatttgtctccatcaactcggtgaggtaggtactgtgttacccccattttacagatgaagcatttgagtctctgaggttaaaaagcttgttgaaggttctgcagctagtagccatgatactggaacttgaacccaggcttgtcggttctagagcctgagcttgtaaccgctaagccccttcttcagacttgcccaagcttttgtggcagtggtcataatgtgcttgggccagtgttgggtagaggctgggggacctttagagtggggcgtttgctgctgtgagcttctagtttggacaagaaggtggcaagtggctagtgggtacagcaggggcagacacagaggcttgtccagctgtcccagtggctgatgttggggtatcaggggatgaactgttgccaaggctattagaggtcaatcaacaaccattctgtcttattcattgcgaacagttttatctgggcagtgacccgcttagcccaggggatgaatcctgattgattaaagccaaccatggcaatccatttacccgttgctagtgataggtggaggtcagcatatgatccagtcctttttaatgagataaagggagtgtatatagtggaagattcaaggggacttttcttccctgacgcaaggtgaaagcagagtaaaaacaaagtcttcctcattgaatgttgtggtgtgaggatgtgatagctggagttgtggcaaccatgcttcaattatgaggcagcaagctggaggactaaagccagcacaccacagatggctgagtgaaaggaagggaagagtgtggatctcaagccatccaacctgggacttctctctgggcttagtgttaggtcacaggcagttggcactgcctgcaggttatgggggcagagaagaggatctctggcagtcaccacccagacatgagtctagcttagtcccataagctttggaggtttggagggttatgcagagactgagcccctgaggcactcaagcctttctactcctggcataagagtcactttctgggttctccctccttcccctggagaacccagatggctgcctcatctttctttcctctctcttttttttttttttttattattgagttggagtctcactttgtctcccaggctggagtgcattggtgggatcttggctcactgcaatctctgcctagtgggtttaagcaattctcctgcctcagcctcctgagtagctgggactataggcgtgccaccacagtcagcttatttttgtatttttagtagagatggggtttcgccatgttggccaggctggtcttgaactcttgacctcaagtaatccgccttccttgacctcccaaagtgctgaaattacaggcatgagccaccatgcccagcctctctcctgtctctctagagttggaaggggaaagggagcaggaacaggaattcttagtttaatctgactttgctgctgcttactctgtcaatttattgagcaattcactgcacctctctggacctcaacgtcactctctgtaaaatgggaggaggttgggctaggtcggtggttttcaaactgagctgttgaggaacttagggattctctttgatgtcataccagtcaccaaggagaataaagagggagatgactggcaagctccccattggtgtgttttgtaagatgaatttttgtgtaaaattttctttgaacaaaaggcctttgctgtcgttgggggaaaaaaggcactgggctagaagatctctggggagccacacgaggaggctccaccggctgtggggatgggtcgtatgaggactcctctactgccgggtgtgtcttggggtgggtgggggcatgtgtgtaccaggtgtccctaatcagcttacaggatagtaggtgatggcttgtactaggactccttagaaaacagggttccagcccctgcctcttctgctgatgtttttgtatgcaataaaatatacataacataaaatttactatcttaacctttttttttttttgagacagagtctcgctctgttgcccaggctggagtgcggtggcaggatcttggctcactgcaacctccgcctcccgggttcaagcgattctcctgccttaaccacccgagtagctgggattacaggtgcgtgccaccatgccccactaatttttgtattttcagtagagacggggtttcaccatgttggccaggctggtctggaactcctggcctcaggtgatctgcttgcctcagcctcccaaagtactgggattacaggcatgtaatcatgtaatcatatcctctcacctcagcctcccaagtagctggaattacaggcgtgcaccatcacgcccagctgatttatttatttatttttagtagagatgaggtcttgctgtttcccaggctggtctcaagctcctggactcaagcaatcctcctgtcttggtcttctaaagcactagaattacaggcaggaaccactgagcttggccctgcatagtgctcttaaagttcatccatgttgcagcatgtgtcagaatttctttcctttccttttttttttttatttggaggcaaggtcatgtttcattgtccaggctggggtgcagtggcccagtcatgactcactgcagcctcaaacttctgggctcaagaaatcctcccactcagcctcctgagtagctggcactacaggtgtatgccaccacacccagctaattaaataaaaattttctagagaaggggtgagggtctcactatgttgtcaaggctggtcttgaactgggctcaggtgatcctcgtgcgtcccaaagtgctgggattgtaggtgtgagccagcatggttgcctctttccttttttaaggctgaataatattccattgtgtgtatagatcacattatgtttagctgttcatctgctgatggacccttagtttgcttccatcctttggctattgtgaatagtgctgctatgaacgtgggtgtgacactgactttttccttctccttctgcagcttctttatgaaaaaggcatcagcctcagggcctccttcatcttcatctctgtctgcagtacctggcatgtagcacgcactttcctcctgatgccccgggggcacatcccatacccactgccccccaactacagctatgggtaaggactatctggtgattgtgggccagagcccctcattggccctagggtgggatggacagggtaaagcaaacctatcacaggagaggaggaggactggagcagtgcatctgttagctattgctgcataacaaactatctcaaaactcagcagcctaaaatgttaagcatttattatttttcacaagtctgtgggtagctggctagttccgctgatcagggccagatgtagatgattttgacagggctcattcatacatctgatcatttggaggattacatgggggctggctatgctaggatggcctcactcacataggtttggagtgacagggatgcctgggtcacgtggctgtcatcctccagcaagccagcgtgggctcattcacaccgtgatttcagggttctgaaagagtgcagaaatgcacaagcgttcttgagatttaagcttggaattggcacagccacttctgctgcattcttttggctgaagcagttcacaaggctggcccagattcagggcatggggaaatagagctgcagtctcattcaaattgggggaaatacagaggaggtgaagaaatgtgatcatttttgcagtcatttgccacaaggagtagaggaagggcattcctttgctgctcacttactaattgtcagaccccatgtgctctctgatttcatcctcacaataatcctctgagatatccttatctccattttctaaatgcaaaaaatgaggctcagaagggttaagtctgagccatctttctgttgctaggaagaggcagagctgggatttgaacctgggcctgccctactcttttcatgcttcctaaactttgctgcttattagaatcactagattcacatagagatcttagaaaaggaagcctggctctcacctccagacattctgatttaactggtctggtctgcaacctgggcatcagagtggctaaaaggtgattccaaagtgcggtggaatgtgggattcaccatgctattccctccagtctgagtctcaggttcggctcacagtccttggccttgctggtggggcttttgtttccatagcctgtgccctgggaatggcaccacaaaggaagagaaggaaacagctgagcatgaaaacagggagctacagtcaaaggagttcctttcagcgaaggaaggtgagccctgctggctaacccatctctcctccagacccaagcctctccttgtgcctttcctggcccctcacctccagagctcccccagggacccagaatcaggaaaggcaggacagaaaaagggccttaggcatcttcccaaccctctcacttaatggagggtccagggctttcgtctcttttctgtccctcttttctctatttcgcatcctatcacttccccaccccttgaagcccgcctgccatgggttgccttcccttccccccactcctcggttctgccctcttctgtgatgccattgcactaagtctggtacagtgcccccatttctccaggtctcctgggtccgccctctcttattgtcccaactctatcactgcttcctttccttcctctctgttctgcgtctttggttacacacatcacaaaccgcagctagctacagtagaaataagaacggggtgggagaggagatgggagatgcaggtcgaaggacaaaaaggagcagatgagcaggatgaacaggcctagagatctaatgcacagcacgaagactgtaggtcatcaaactgcattgtgtttgggactttcctaaacaagtagattttaactgctcttgtcacaaaacaggtagaaatgtgagatgatggatatgttaatttgcttaactgtagtaaccatcttagtagctatatgtatcctatgacctcatattgtatatcttaaatatacagaataaaattgatttttttgtttttatttttaccatctgacaattggatccaaaacatgtatttatttatttattttaaagaaagaagaatagggttctgggaagcttccaaaatcaagggaggacattgaacttgccagggtgtaggacctattttagattaagtccatcctaatctaaactcatggccggtctgccttgttaggaggaaccatctcattggttaaccttgagagaggaacagaacactgaattcatggtcccatctggaccatgaagattagggtagaggaagatttcccaaagaaactcaggatactggtatcaaaagaaagggaggtgctgaggagcaggttagaacagagtatccacactcattctcctctcccttctgactttctcctctccttgtcgttcctttcacctttctcgctgagaaagatcaggaaggtattactgcaagaagtgtcattgaccaggctgtgagagacagatcggatttcaatagagaagaacacagagggtcatccaaggtggtagggccagcatgacaaagcagggaggtggggatgtgtgagtccgaggcaggtgcagagcacgccgggtgagttctgggagccaagggtagaaggtgggcccggatctgaaatgttccattgaagcctccacactccccatcctacctgtccactttcctcgtaattcacgcccagatcctcctctccccattagagaccccaggggcaggggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgaggtatgtggtagggctgggaggtagcccatctgcatgtcccagctgggaacacagagcctcccagcagggctgtacacaccagaggagggtctgatggtgtggggaggagggacatgcagacaagggtaaggtgggagagtccctgcctggaagggagttttggaaacttctcatcaaccaacctctctcttccttctgcagtcagcacctacacaaatgcctttgccttcactcagttcggagtgctgtgtgccccctggaatggcctgctcatggaccggcttaaacagaagtaccagaaggaagcaagaaagacaggtgagatgcgggggagggcaggggctggtcagggaaccaggaagggaggtcttcatttaccccatgacatcttctctcgctcttttttttttttttttttttttttttgtgatagagtcttactctgttgcccaggctggagtgcagtggtgtgatctcagatcattgcagcctgcacctcctgggttcaagagattctcctgcctcagcctcccaagtagctgggattacaggcgtgtgccaccatcccccactaatttttgtctttttagtagagacggggtttcaccatgtcaggctggtcttgaactcctgacctcgggtgatctgcccgcctcagcctcccaaaatgctgggataacaggcgtgaagcaccatgcctggtcttctcttttgttcttaaccctgtctagttgcactcattcattcattaaaacactagtcactgagtgatagttatgtgtcagccatggtgccagacaccagggattcaatgacagacaagatagatgtgttctttttctcaaggtgttctcagtctagagggtggagaaaggcaggtagtcaggcagttataatccgtgaagcaaacccacagggggccatggggggcacaaagaagcgcacataatctgttctaggtgaggatgggattggtgtcagggaaggcttcctggagggaatggcacctaagccaagacctgaaggatgagtaaggagggaggagatgaagaggcggggccttggagagtggcccaggagcacagtggggtcaaaatggtgaatgagagagtgaaacattgaggaatctgggcagatgagtcgggctggctagggcacagagcactggggaatcttagggaagtggctggagagagagaggtaagaaggggtcaggctgtttaccacatcagggagttttggcctgatccttggacctggttggaggagtagaggtatgctgaggtattttaacctgctgggtcaggagggacaaaagtagactaacattttgcatacttatttcatctatcccttcccccacccatgcacctgcttctcccacacctgctagagttttcaaagcaaatctcagacatcgtatcatttcatccgtaaatatttctctatacccgtacatgtatctctaacaaataaggcctcttttacttaaacatcaccataaaatcatgatcacacctaaaaaataacaataatttcttcatatcatctactgtgcagtcactgttcaaattcctccaatcatttcaaatacatccttttacagttggtttgttccaattaggatccatgcctggtccatgcagtgtatttggttgctgtgtcttctatagcttttaaaatctagaacagtcctcccccctaccttttcttgtttatttgttgaagaaactgggtcatttccccatattttggatttggcgttgttttaatgtgtcatttaaaagtattcctttccttgggtatttcctgtaaacaacaggattagaagcttggaggaaacgcagtttaatttttttttttttttttttgccgtgaataactcagtggtagagctatgggtttcctctgttctcctgtcagcagcccctggtgtctgttgtcttgttacgatgttaagattgatcaactggtttagacattgcgagtctgatccatccactataaagtttcccatcaaccatatacttagtgattttaggagccattaatgatcaatgcctaggcccattatttcattaggatcgcaaaaggatgattttcttttctttctttttttttttttgagacagagtctcactgtgttgcctaggctggagtgcagtggcgtaatctcagcctactgcgacctccgcctcccaggttcaagcgattctcctgcctcagcatcccgagtagctggcattacaggcacccactacctggctaatttttgtatttttagtagagatggggtttcaccatgttggccaggctggtctcaaactcctgatctccagtgatccacctgccttggcctcccaaagttctgggattacagccactgcccctggccaaaaggatgattttctatttctatcttctacttttaatcactagaattcttctagaaagaaaaacattccttactattttgttacccagaaataaatgcttggcttacacatttatttaccagtctcaaatatgagttggtgccctagtgaccttcagggatggctactaattgtttcttttataatatttcattttaaaatatatttgacatgttttaatctgttctgtcatgattcttcttgatgctcaaattgtctcacctttggccattgaaaactttaccagcccagaatctgtgtcttttagatgaaatcacattatttctagagagtttccttactttctaacacaattaaatgttcaggtccatttcactaggtgtgtttcttgccctagacatgaaattgtcatttttcccaactagccctgggtttctttaattggaaatggtagagactacagtctggatgctgaggttttttattgctcctgggttgtcactgcttttgggttttggatagagttaacatatatataatttttttataagaaaaatatcataaatacttaatactgatatttttattcaaatttttatttccttgattttacatttgtagccctttctcttcctctgataaacttggttcctaacatatgcatatgtaaatgtacatacacatatatagtattttaaatataattactggttttaccaatattgatgttacttgataacaatacaattgctaaatactgttgctacttctttgtttccttttttctgtccttccttattcctttctcatccttaggatatatcccattagagatgtacagtcaaattgccatattttcttctttatttttagggatgaggtctcactctgttgcccaagctggagtacagtggtacgatcacggctcactgcagcctcaacctcctgggctcaagtgatcctctcccttcagcctcccaagtagcttggactacaggcatgcactaccatgtctggctaatttaaaataatttttttttttttttttttttttttttttttttggaaaaggaagggtctttgttgcccaggctgatgtctaactcctgagctcaagcaatcctcttgccctggcctcccaaagtgttgggattgtgggtgtgagccaccacactgggccaaattactgattttaagggtcactaatttggtatagagttatgttcattgatttcattttattttgtttctgatttttaaagattgttttacttgttttcttcctattattattttattttatttgtaaaacatttacatatcagacatttacattttcccaaaggtaaaactgtgaaacaagatatattcaaagaagtttactttccctctctgtttcttgtaccccttttcctcttctttaggtaaccatttttatttttttaaatataaacattgtgtaggtgtatatacatgtattagtctgttttcatgctgctgataaagacctatctgagactgggaagaaaaagaggtttaattggacttacagttccacatggctggcaaggcctcagaatcatggcaggaggtgaaaggcacttcttacacggtggtggcaagagaaaaatgaggaagaatcaaaagtggaaacccctgataaacccatcagatctcgtgagatttattcactatcacaagaatagcgtgggaaagactggcccccatgattcagttaccctcccccactgggtcccacccacaatacgtgggaattctgggagatataattcaacgtgagatttgggtggggacacagccaaaccatatcaatacatttccctctcttttagataaaaggtagtatactgtatacactattctgcagagttttttttttttttgatgtaactctatcctgagggtgctctgtagcagggacctctcatgccttttaaccactgcctgggtctccattacatggctgcagcatagttgccacagcattcctgtactgatgactatttggattgtttccagtcttttgctattaccagtagtgttacaaagaggatctggctacatgttcagggtggggaggggcagatgtgtagcctgtcaggagggtattgcagtaatccatgactgagttaatggtagtttaaagctaggatgagtcagtggggttggagagaagtgggcacatttgaatgatatgtaggaggtgaatgatcagcattattgatgagtttgaggtggggcatgtggggaaaggattcgaggatgactcccaggtttctgttgggacagtggatggatagtggctcctcccctttttccaatcttccttggcccttcgctgacttctgttgggttggcctacagagagcttctttttcctctctgttcgcccaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgcgtaagtggccttggggcgggctctgtggagacggacacactggggcaaagagaagctggaggtaaagaaattgggaggcaaggcggggcctggaggcagtcaggtgcgggagactgggtttgggggcaggtgtggagggggtgagaccagaggtggtgggaaggatagaacattcatgcacttgagcctttacatctgcggtgccctctccctctgttttctacctggtgaactcgtattcatcctctgaggcccacttctgtttcagttctccagggaagaaatggaaaagtgtcttcccttctttgtgcccttagtactctagtcttacttcctttgctagtgcgtgcattgtctggcatgccatccatttacatgcctgtcttttctttcctggtgcagcctgcatgagggtcctgtctgtttttccagggccccgcatgtgccttcttctgggttctgtgggtcaaatgtctgagcagagctgaagagggaaaggccagacaggtgtggttggagggcaggcctaggacaggggagctggggacaagcggccgacagcccccagaggccaggcttctgcttggagggagggtccctgaagctcactggaacccctctggtttctctccccagtttcccttcagagcactttggcaagctctttgggctggtgatggccttgtcggctgtggtgtctctgctccagttccccatcttcaccctcatcaaaggctcccttcagaatgacccattttacgtgagtactgggaggatggggatccctggcaggaggcctgggccttaggccttggctgccccaaatctggctgtgatggcctgggtatgtagcatggtgcagcttcccaaagggtctgtgttattcaagtatttggggcaaaagtatttgtgtgtgtggggaaacagacattctggagtagggtggggaattctcacgaaacttcaagcaaaatcctgagacctcaaaggtgtttcctgcttgtggtgagtgcaggcccaccctggcctctcccctaggcccacacagggtttccacagttggccccagggacaggacctctgtgctttcacctctgtgtccttacacctggagggatgctctgaggtcctgctctaggaggtggtcgtgagtctcctgctctttgcagaaactgaggctcaaagaggttacttacgtgttcagaggcaccagctaaggagcaaaagtcaactttgaattctgtgttttgactactgcacagctctatttgcctcattttttatttttaaagcagcaaatcttagaataggagtttaaatccatcacttggagaaaagaaagactaaatgttttttgtttttgttttggagacacgatcttgctttgtcacccaggctggagtgcagtggcacaatctcggctcactgcagcctcgatctcctggactcaagcgatcctctcatctcagcctcctgagtagctgacactacaggcatgtgccaccatgccaagcttattttattttatttttttgatagacactggggtttcgctatgttgcctgggctggttttgaattcctggcctcaagcgatccacccgtctctgccttccaaaatgctgtgattacaggcgtgaaccactgtgcatggccaaaagagtaaacttgaaatctgaggcgaatgacttgattgtgacatcaggtgacctagtaatcagctgtgtattctagctggtgcctctaccagcttcccatgtgaccttgaacatgtcattgaatgctcgctaggcctctgtttctttatctgtgaaatgggcttgatattcctcctctaccccaaccgatagtgcagaatgaaaagtaactgaaagtccttcctccagggcaccatagtgtctgggtgaaaagtagaatataaactcggtagacttctggtcccttcattggtcatggaatggaccagtgcttgcttcattgagcaacagttctgttgttcagaattcctggatttcacctcacttctgctctccctgcaggtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctggggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 7913 - DNA, 3141 bp, Homo sapiens
gctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgcgtaagtggccttggggcgggctctgtggagacggacacactggggcaaagagaagctggaggtaaagaaattgggaggcaaggcggggcctggaggcagtcaggtgcgggagactgggtttgggggcaggtgtggagggggtgagaccagaggtggtgggaaggatagaacattcatgcacttgagcctttacatctgcggtgccctctccctctgttttctacctggtgaactcgtattcatcctctgaggcccacttctgtttcagttctccagggaagaaatggaaaagtgtcttcccttctttgtgcccttagtactctagtcttacttcctttgctagtgcgtgcattgtctggcatgccatccatttacatgcctgtcttttctttcctggtgcagcctgcatgagggtcctgtctgtttttccagggccccgcatgtgccttcttctgggttctgtgggtcaaatgtctgagcagagctgaagagggaaaggccagacaggtgtggttggagggcaggcctaggacaggggagctggggacaagcggccgacagcccccagaggccaggcttctgcttggagggagggtccctgaagctcactggaacccctctggtttctctccccagtttcccttcagagcactttggcaagctctttgggctggtgatggccttgtcggctgtggtgtctctgctccagttccccatcttcaccctcatcaaaggctcccttcagaatgacccattttacgtgagtactgggaggatggggatccctggcaggaggcctgggccttaggccttggctgccccaaatctggctgtgatggcctgggtatgtagcatggtgcagcttcccaaagggtctgtgttattcaagtatttggggcaaaagtatttgtgtgtgtggggaaacagacattctggagtagggtggggaattctcacgaaacttcaagcaaaatcctgagacctcaaaggtgtttcctgcttgtggtgagtgcaggcccaccctggcctctcccctaggcccacacagggtttccacagttggccccagggacaggacctctgtgctttcacctctgtgtccttacacctggagggatgctctgaggtcctgctctaggaggtggtcgtgagtctcctgctctttgcagaaactgaggctcaaagaggttacttacgtgttcagaggcaccagctaaggagcaaaagtcaactttgaattctgtgttttgactactgcacagctctatttgcctcattttttatttttaaagcagcaaatcttagaataggagtttaaatccatcacttggagaaaagaaagactaaatgttttttgtttttgttttggagacacgatcttgctttgtcacccaggctggagtgcagtggcacaatctcggctcactgcagcctcgatctcctggactcaagcgatcctctcatctcagcctcctgagtagctgacactacaggcatgtgccaccatgccaagcttattttattttatttttttgatagacactggggtttcgctatgttgcctgggctggttttgaattcctggcctcaagcgatccacccgtctctgccttccaaaatgctgtgattacaggcgtgaaccactgtgcatggccaaaagagtaaacttgaaatctgaggcgaatgacttgattgtgacatcaggtgacctagtaatcagctgtgtattctagctggtgcctctaccagcttcccatgtgaccttgaacatgtcattgaatgctcgctaggcctctgtttctttatctgtgaaatgggcttgatattcctcctctaccccaaccgatagtgcagaatgaaaagtaactgaaagtccttcctccagggcaccatagtgtctgggtgaaaagtagaatataaactcggtagacttctggtcccttcattggtcatggaatggaccagtgcttgcttcattgagcaacagttctgttgttcagaattcctggatttcacctcacttctgctctccctgcaggtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 7914 - DNA, 576 bp, Homo sapiens
aaaagtgagtcaacttaaaacattttagcaaataataggacaggcataggttgtggccagaataatggtgggcagaagtctggtttggggaggaagaatttgtcaagggttcccctagcccagctcttgagcttttttgctgtggtctcacacttaccagacctgttataaccatttgtttgcatgtcagtctatttaagggcaaggactatctgattcatcttgcatttccagtgccaagcacaatgcctggcaccaaagaagtgctcagagtttagtgaacaaagaaaagaccatggtccttttctcactcagttctcatagcacctgagacaggaagagcaggaactgttgttcccattaaacagatgattgaagctcaaggccaataccatgaattagggaatgggctagagggttgagccagggacctgagtccagggtcttcttttccaggagtgtcaaggatgaaagggagaggcagcttgtggtttactgagggaagagagaggtggcttcacttagagctctgcctctgtctgtagacttcctggcctgccacagactgaggaccaa

SEQ ID NO: 7915 - DNA, 379 bp, Homo sapiens
gtgaaatccatctggtctgctgggatcctgctcaaaatgtcatcttctccaaaaatcattactcaggctttccagcatgtctgagtccctggcacttggtcacacccttcctggtgactggcatttgcctccacatcatgaccctcccaccccttgcctgggcagcatactccaggaggcaaggtctgttctcgcctggctctaattaatctgtgcttaccatccacatggtaccagctaattcttgttgaatgaatgatcgttgaatgagtggattcttgttttggcctcagaaccaattagaaggagccagaaaaacacatgggggtgggggaggtgcagtgtggtgcagtggaaaaaaacccttctggaaatctca

SEQ ID NO: 7916 - DNA, 379 bp, Homo sapiens; identical to SEQ ID NO: 7915

SEQ ID NO: 7917 - DNA, 1297 bp, Homo sapiens
tttgaaaaacagagacaaaattagtgaactcaagtttgtgaactcaagataaatgctaaatttgacaccatggtaaatactactgttgagtttaaagttgtcccagaatccagcatattaattaaaagttactgatttctagtcctttattcatatttttatagcttttaaaaattattctttagattttgaaatgcttaaaactacagacttagaaaataatattcaaatatgtgtgatcaaccatctagaataaataaatgctaatctttgtcatttttgcatcagctattttaaaataattaaaatattagaaatacagttaaaatcacctttgttctgcttctagtccaacttatacctttattaaaatttggtgtgtgtatccatccaatctctgttttcagattgttttattatgtgctttaagtccacataaatgatctcatactgtatgtatcactgtagaattttttcttcaaaattgtatttttgaactttctgtatatatatatttctttaattttaaccattttatgaattctaaagtttatatatttccccaccttaatacattatttccaatttttcaattacaagcaatgtaatctaaaatgtacactttcgtatggttttcttctgtatatgtgcaatattttgtctaggatatatacctaaaagtggaattgctattatagagtgtgtgctttttcagctttaccacatattgctaaattgctgtctgaagcaaatgtggcagttcacactgctgtctagaattttctcatatccttattagattttgaattgtcagaccctgtgatttttactcttatgatggctgtgatatgcttttttgttttaatttgttcttcccttattatttatgggaataaatatattaccatgtttaaacagcatttggatttttttcttctatcaacaacatatataaatctttgtcaccaaatcagcttttttgaggtatgacttacacgtaataaaatgtgccaattttgagtgtaccattctctgaattttgacaaatgtatgaagctatgtatccatcaccacaattgagttacaaaacattttcagaatgccaaaaaaatgctccattgtggtaactgtcttttcccccattgaattaattttctcggtacattcgttgaaaattgattgaccacactatgtgtgaatctgtttctggactctattattctcttgatctataattatgccagtaccacagtcttgattactgtagctttacaataaatcttgactgtagatagtt

SEQ ID NO: 7918 - DNA, 8941 bp, Homo sapiens
caacggctagtcaacggctgcggggacaagtccgttgaggctgccaggcgagtcaggcctttctggacctcgcctgactcggatgggctgtgcctgaaattgacccagctccactagggattatgaagaaacaaggagtaaacccaaagccgctgcaatcttcccgccccagcccgtctaagcggccgtacggggcctcccccgcccgggagctggaggtggaaaagtcggccctaggcggcgggaaactgccagggggcgccaggaggtcctccccggggaggatcccaaatctgaaaaagcgaaaaggcttggagctaaaggtggtggccaagacccttctcgaccccttccagttcgtccgtaattccctggcgcagctccgggaagaggtgcacgaactgcaggcgcggtggttccccagcagaaccactctcagcatcggtaaggagagggcaggagagccctaggagggagccgcatggcgcttttcttgagtcttgaaggagatcagtttaacaagcaagggtttgtgggtgcctagtaggaaataatagcaaggtctgagtagaaagaagttggccaaaaatcttgtcattgaaccagaggagagagagagatagggagtatattggtttgaagggctgtcagatcgcagagagtgttttaaggtctaggagttttaaaggctgggggcaaggatcaagggaagaggatgagattaagattccaagagaggaaataattagtggagcaagtcttggaatatttggaggggtagagttaagggcacaaatttgataagctaactgtggaaaagaggagagagacttccttttctgagatggcagggagtagaaaagcgagaattactatatggagaaatgttaaagtggagataaaagaagttgggagtgctggcgtctaatggtctttgtttcagtgaagtatgaggctgggtcaccttcagaggtgagattgataggatgccggggtccgggggacatgcttctgtcacagcttggaaagggcatgtgataagcccttcaagcatttagaatactggcatcgttacaccatatcatttttttcagatgtggtatgtgggttaagggagggagtgagagacacagaaagattttgagcatctttggaaagctagatgaatttggtactatatttgaccttttccttatatatcatctgaagagttttttcagtgtatataattgttaggagaattagaaataggatacaaatatagttgaacaggatagtctctgtatattttaaaattaatgaagcctaataaacagttatgagcatctttacaaccatttaaagttttcaaccttttaaaaattatagcaaccgtgcttgcagacagtccaaaaatacaccatgggccatactttgcttatcctggtataaaacaagtaaatcttccgggaagtgtttaagataagcccaggacagttagtaatataggaaaagatctgggtaagcatggttgagaatttcaacattgcaattttttaatttttaaaaatttaatttcttcaataattattgaattaatttgcatttattttgttagccaagtgaagtaatttttgaatttttaagaggctattattggtggtttataagatgacttgccaagtatatttgggataaccataagaaatactattataaaatctcagaagggaggtaggacttctggaatagccaagaaaatgcactcctccatgacgacaatgaaaatacttggaaaattatcaaaatcattttcttcaaactttggaaattaaccaaaggtttacaacaatctaaagggcattaattcaagaaaagctgctgaacctctataagaacagcagagtttgtggtgttttaacttgttctattccccactcttctctctccaggggaattgaaaacaagcaattccccaaccaaacaggggcacaggctgcgtttgcagctcctgtaaaagctccatacccagagcagtgtctcccagctcccaggtgaagtcttatgtatacatggggcgttggcccacgtgactccagactagtctcctaggccatctagtagcttctaggtctgggctcttgcaaagagcttgcaattcatcaagggttgagctgcacattggggcttttagatgtgctgctgaggaagtgatttcctgcgtttaatcatcttctgatgaatggtagagaaactgatctagagtggctcctcttggttagaactagctgaagcatactgtatatacttacttcttttaaaaatttcttataaaggaatagaaaataatactgaaaaaaaaacaaaaaaggtcacaatcttccataattccatcactcttaccaattacctgaagtaaaaaaaccctctcaagtttctccctttacttgtcgagccctgctgcagagaggtaagctctgttcagaatttgctttgtgtcctggattttttcctatgctcatagagacaggattagctggctgtcttgctttgtgtgctatctttctagacatgtaaaataatacatttgaaatacttgttttaatggtattttataataaagcagctattaataactttccttttttttttattccagccatctttgtggcaattctacattggtaagatttagtttcagtttgaaatatttaaaaacttttgaattaaaaatcgccatcactctttgcatacagtaaaacaataacttctggctatatttgtagaacatctttatgtgcaccaatttatacatgtattttgcttttttacaaacctcatatgtgaaacagcatttacaaaatagatgcattaggggaatagtaacttacgaattaaaatatttttgctttaccaaataattcaccacacgtttctttaaatatctggcttctctagtgtattttgcatgtgtagttcatttaaaaccttcctttattttatggtaattatatgttgctagtgaaataacttttttttttttttttgagacagagtcttgctctgtctccgaggctggagtgcagtggcgtgatcttgactcactgcaacctctgcctcacaggcaccagtgatcctcgtgcctcagccttccaagtagctgggattacaggtgtgcaccaccacacccagccaatttgttgtatttttggtggagacaaggtttcaccatgttggccaggctggtgtcaaactcctggcctcaaatgatccacctgcctcggcctctcaaagtgttgggattacaggcatgagccaccacactcagccagtgaaataactttggtgataaagttttagtaacacctgccaattggaaatcaggtaaaaaagaagataaagattctgcagtggttatatggttaaatggctctgagtctttcagtgtgcaagtctgtgtacattattttacaaaaatgtttataaaaatttgtaaaataatacttccttctggaatattttctttttacctgtgctcagtgatttctacccttggaaggtatgagatctgctcctatgttctgttgacacagtgctgctctagacatttagtctgcagggagcttttgatgttagaactgaggctgcaatggtagggaatattcctgcagtttttggtaacctggcatatagcctacatgtaaagaagggttagtggaaaacagggttaatatatggaactttgctttattttcaacttcactggaaagtactgactacataagttagctatagcataattgttggccacagctaattttgtttatcacatatgctcctttcttcactgccgacagctgttgagtttcactactaaaaggtcttcaagtacacacctgtattctttggcacttgaaagttgatcccttatgtgatattatacttattgtaagtctgctttgatctaaggtaattttatttaaaattatattctgaacccttttcaacagttacggaggtatttcccaaggctggtacattagaatcacttgaaacttaaaaaacaaacactaacctgcctctgttctgatttagaggcctgggatggaaggaagggtgaaaaaagccacaagaattttagatatacaattaaggtgttttttttgtttgtttgtttttttgagatagagtcctctatctgactcccaggctggagtgcaatggcatgatctctgctcactgcaacctccacctcctgggttcaagaaattcttctgcctcagcctccctagcagccaggattacagacatgcactaccatggctggctaatttttgtgtttttagtagagacggggtttcaccatgttggcaaggctggtctcgaactcctcacctcaagtgatctgcccgcctcgggctcgggctcctaaagtgctggaattacaggcatgagccaacgcacccggccacaattaagcttaaaaaccactgagttaaggagtttcaggtgtgtgccatactggattataaatgcctaaaaacatacaagttagtaggcaaattataaaattaatattataataatttattgttttcttttttatggctttcttattgcttattttactgttagttttgaaacttgttcttattgtaatatgatacttaatttttttctaggttacatttagtaacactttttgaaaatgatcgtcatttctctcacctctcatctttggaatgggagatgacttttcgcactaaaatggttagatttcttcttctaacgaattaatttgtggtttaagaatagcgagactatgaggtagaaatgtattaggaattgaaatgaacttttggtgaattgcactgtttcataagctataacccaggtttattatttaaatagtaaagtgtttgagattatttttcttttacttcattatctctcaccctttcctaatgcagacttctttttaagataataaagatgaattataatagctgaggaaggaggacaaagaaagcactgaagaagtgataaaggggaatgaaatgagatgttatcagaaattgctttctctttggctacagttaggagatcccatgttttacctgggccttttaatgatgacgattattatttggctctcttttgatttcaagataatctcttctaagagataacttttgatataatttttaaataattttctgtttttcaatacttaatctttaaaatggagttttctgccgtacatatctcacataattattgtgaggagtaagtgggatagcaaatgccaaaattgcgcaattttacatttagaagacaccacaaccgtccatcttccagatctgctcacagctggtcgggcgcctagtgaagcattgaaactggctctcctcagtctagccattgctttttgtttaaattatggtaaaacttagatttaaatttgtaataaaaaatttcaatgtttatcctttaagcatacaattcagtgagattaagtacatttatgttgtcttgcaactattaccactgtccacatccggaactttttgctatcccaaacagaaactctacccactaaacactaatcacacccagctctattttctgtctctatgattttgcctatgccaggcccctcagtcactgctttttaattttcatccctatattgcccctataaagtttcaaagcattggatacattaacatatgtatgacatttgaacattttaaaggtatttccaaagacagaatataaaatattattaaataaagagcgtaactgtggcagagtctggactttggtgacagatcgctggattctaatagcagttctgtgctttattgtatgatggctagtcaggtcacctctcagattctcagtaatctcgtctgctcaatagaaataatgccaaccttagaggggtttagggaaaatgaagggagataatgaatggcaacacatagcagaatacttaacacaaaacaatagctgttattagtaacttatttatatatttaatatttccctaaatatagtcttttgcatattagatatcctttaattgttgtattgctttgttatcctcctaagcagaaaggaaaattctttatgaattcatattttgccaatcaactatgaggtaatggcctttcagacatcagctaaaacagacctgtaatttagtagttactcgtgttggatgaggcagatatgattatagcatatagcattttttagggagaatgcattttaaacaatgtggcccttttttgcttttagattttaggagtgaaagcaagaaattgttggggaaataagacacaacatgctgttgttaatccatgaattttaactcaacagcacttttactatcccaatgaagcctttattttatatgctgaagtataagacactaaaataagctgctttttagtacatagcatttgtgagcaacaatagtcaattgacattgagctttcactttgcacagaggattagatggagctatgaattaagctagaagcactggattccttgctcgtgatgcttatggtcattatattttatttcctaagagcatgggaaaaaaagtaattttctatatgcaaagttgtacagaggcatgaaggcatccctgtttatgatagaattaatcagatatcaaccttcaagcatctcaaatgtgggggataaaaccagatttgggaaaatcaaacatatactgtctacacattttaagacattattagagaaactctttaaattgtttgaccatccctccaactctttagtttgaaagcctatagaaaatttgaaagaatagtacagtgatcacctgaaaatacgtgttctttaaagtccaagaatgcaaaatagcgaggagtgattaagaagtcttattattaactttttttttcagaaaaaaagttctaaagaagtgataaaaataaatattttaaagttttaattccattgacaatatgtgccttttttttttttaaaaagggactttattattcctacttcaagaccatcattgaagcaccttcatttttggaaggactgtggatgattatgaatgacaggcttactgaatatcctcttgtaattaatacagtaaaacgcttccatctttatccagaggtgagtcataatttgagacaaataatatttgtagagtgatcctctttgtcagataaaaatagtaagcacaatcttgttaagaaagggaggggacgtttcaggtttactaattgtatgtatccttatagttgagtagagtatcataagttcctctcttaaaatttaaagaccccagaaactgttctctcatgaactcaaagaatgaaacttagtgtgtaaataatggccagggtaatagacaagccaaatggaaaagagagtcatgggagccaaaaagttctaaatagggatgggcttttggctttggacacctcatgggtgagcacgatgaccacgtgaagggacagtgagagtgatgagcttgaatagtgatcttggagttacgttagtaaagtaagatttatttagtcacacagccagaaatctattactattttccaacacttagcctaaaagagtatggttgttatagtagtctataaatgctagaaatttgaaaaacggagacaaaattagtgaactcagtttgtgaactcaagataaatgctaaatttgacaccatagtaaatactactgttgagtttaaagttgtctcagaatccagcatattaatgaaaagttactgctttctagtcctttattcatatttttatagcttttaaaaattattattctttagattttgaaatgcttaaagctacagacttagaaaataatattcaaatatgtgtgatcaaccatttaaaataaataaatgctaatctttgtcatttttgcatcagctattttaaaataattaaaatattataaatacagttaaaatcacctttgttctgctcctagtccaacttatacctttattaaaatttggtgtgtgtatccatccaatctctgttttcagagattgttttattatatgcttttaagtccacataaatgatctcatactgaatgtgtcactgtaggatttttttcttcaaaattgcatttttgaactttctgtatatatatatttctttaattttaaccgttttatgaattgtaaagtttatgtatttccccatcttaatatattatttccaaatttttgattacaagcaatgtaatctaaaatgtacatttttgtatggttttcttctgtatatgtgcaatattttgtctaggatatatacctagaaatggaattgttgttatacagtgtgtgctttttcagctttaccagatattggtaaattgctgtctgaagcaaatgtggcagttcacactgctgtctagaattttctcatatccttattagattttgagttgtcagaccctgtgatttttactcttatgatggctgtgatatgcttttttgttttaatttgtacctcccttattatttatggggataaatatatttccatgtttaataaacatttggatttgttcttctagcaacaacatatataaatctttgtcaccaaatcagcttttttgaggtatgacttacatgtaataaaatgtgccaattttgagtgtaccattctctgagttttgacaaatgtatgaagctatatatccatgaccacaattgagttacaaaacattttcggaatgccaaaaaatgctccattgtggtaactgtcttttcccccattgaattaattgtctcggtacaatcgttgaaaattggttgaccacattatatgtgaatctgtttctggactctgttattctcttgatctataattatgccaataccacactgtcttgattactgtaactttagaataaatcttgaaagtagatagtt

SEQ ID NO: 7919 - DNA, 8941 bp, Homo sapiens; identical to SEQ ID NO: 7918

SEQ ID NO: 7920 - DNA, 1486 bp, Homo sapiens
ggacacctcgtgggtgagcacgatgaccacgtgaagggacagtggagtgatgagcttgaatagtgatcttggagttatgttagtaaagtaagatttatttagtcacacagccagaaatctattactattttccaacacttagcctaaaagagtatggttgttatagtagtctataaatgctagaaatttgaaaaacggagacaaaattagtgaactcagtttgtgaactcaagataaatgcttaatttgacaccatggtaaatactactgttgagtttaaagttgtctcagaatccagcatattaatgaaaagttactgctttctagtcctttattcatatttttatagcttttaaaaattattattctttagattttgaaatgcttaaaactacagacttagaaaataatattcaaatatgtgtgatcaaccatctaaaataaataaatgctaacctttgtcatttttgcatcagctattttaaaataattaaaatattataaatacagttaaaatcacctttgttctgctcctagtccaacttatacctttattaaaatttggtgtgcgtatccatccaatctctgttttcagagattgttttattatatgctttaagtccacataaatgatctcatactgaatgtgtcactgtaggattttttcttcaaaattgtatttttgaactttctgtatatatatatttctttaattttaaccattttatgaattgtaaagtttatgtatttccccatcttaatatattatttccagttttttgattacaagcaatgtaatctaaaatgtacatttttgtatggttttcttctgtatatgtgcaatattttgtctaggatatatacctagaagtggaattgttgttatagagtgtgtgctttttcagctttaccagatattggtaaattgctgtctgaagcaaatgtagcagttcacactgctgtctagaattttctcatatccttattagattttgaattgtcagaccctgcgatttttactcttatgatggctgtgatatgctttttgttttaatttgtacttcctttattatttatggggataaatatatttccatgtttaataagcatttggatttgttcttctgtcaacaacatatataaatctttgtcaccaaatcagcttttttgaggtatgacttacatgtaataaaatgtgccaattttgattgtaccattctctgagttttgacaaatgtatgaaactatatatccatcaccacaattgagttacaaaacattttcagaatgccaaaaaatgctccattgtggtaactgtcttttcccccattgaattaattgtcttggtacaatcgttgaaaattggttgaccacattatatgtgaatgtgtttctggattctattattctcttgatctataattatgccaataccacactgtcttgattactgtaactttagaataaatcttgaaagtagatagtt

SEQ ID NO: 7921 - DNA, 3290 bp, Homo sapiens
actttttgaaaatgatcgtcatttctctcacctctcatctttggaacgggagatgacttagatgacttctcccactgaaatggttagatttcttcttctaacgaattaatctgtggtttaagaatagtgagactatgaggtagaaatgtattaggaattgaaaccagcttttggtgaactgcactgtttcgtaagctataacccaggtttattatttaaatagtaaagtgtttgagattatttttctgttacttatttcattgtctctcaccctttcctaatgcagacttctttttaagataataaagatgaattataatagctgaggaaggaggacaaagaaagcactgaagaagtgataaaggggaatgaaataagatgttatcagaaattgctttttctttggctacagttgggagatcccatgttttactgggtcttttactgatgatgattattatttggctctcttttgatttcaagataatctcttttaagagataacttttgatataatttttaaataattttctgtttttcgatacttaatctttaaaatggagttctctgccgtacacatctcacataattattgtggggagtaagtgggatagcaaatgccaaaattgcagttttacatttagaagacaccacaaccgtccatcttccagatctgctcgcagctggtcgggggcctagtgaagcactgaaactgactctcctcactctaaccattgctttttgtttaaattatggtaaaatttagatttaaatttctaataaaaaatttcaatacgtttatcatttaagcatacaatttagtgacattaagtacattcgtgttgtcttgcaactattaccactgtccacatccagaactttttttgctatcccaaacggaaactccacccactaaacactaatcacacccagctctattttctgtctctatgattttgcctatgccaggcccctcagtcactgctttttaattttcatccctatattgcccctataaagtttcaaagcattggatacattaacatatgtatgacatctgaacattttaaaggtatttccaaagacagaatataaaatagtattaaataaagagtgtaactgtggcagagtctggactttggtgacagactgctggattctaatagcagttctgtgctttattgtatcatggctagtcaggtcacctctcagattctcagtaatctcatctgctcaatagaaataatgccaaccttagagaggtttagggaaaatgaagggagataatgaatggcaacacatagcaggatacttaacacaaaacaatagctgttattagtaacttatttatatatttaatatttccttacatatagacttttgcatattagatatcctttaattattgtattgctttgttatcctcctaagcagaaaggaaaattctttatgaactcatattttgccaatcaactatgaggtaatggcctttccgacaccagctaaaacaaacctttaatttagtagttactcgtgttggatgaggcagatatgattatagcatatagcattttttagggagagtgcattttaaacaatgtggcccttttttgcttttagattttaggagtgaaaacaagaaattgatgggaaaataagacacaacatgctgttgttaatccacgaattttttttttaattatacttttaagttctagggtgcatatgcacaacacgcaggtttgttacatatgtatacatgtgccatgttggtgtgctgcatccattaactcatcatttacattaggtatatctcctaatgctatccctcccccctccccccaccccatgacaggccccggtgtgtgatgttccccttcctgtgtccaagtgttctcattgttcaattcccacatatgagtgagaacatgcggtgtttggttttctgtccttgcgatagtttactgagaatgatggtttccagcttcctccatgtccttacaaaggacatgaactcatccttttttatggctgcatagtattccatggtgtatatgtgccacattttctcaatccagtctatcattgatggacatatgggttggttccaagtctttgctactgtgactagtgacgcaataaacatacgtgtacatgtgtctttatagcagcatgatttataatcctttgggtatatacccagtaatgggatggctgggtcaaatggtatttctagttctagatccttgagattaatccatgaattttaactcaacagcatttctactatcctaatgaagactttattttatatgctgaagtgtaagacactaaaataatctgctttttagtacatagcatttgtaagcaacaatagtcaatcgacattgagctttcactttgtacagaggattagatggagctatgaagtaagctagaagcattggattccttgcccatgatgcttatggtcattatattttatttcctaagagcatgggaaaaaaagtaattttctatatgcaaagttgtacagaggcatgaaggcatccctgtttatgacagaattaatcagaggtcaaccttcaagcatctcaaatgtgggggataaaacccagatttgataaaattaaacatgtactgtctacacactttaagacaatattagataaactctttaaattgttggaccatacctccaactctttagtttgaaaacctatagacaatttgaaagaatagtacggtgatcacctgaaaatacgtgctttttaaagtccaagaatgcaaaatagcaaggagtaattaggaagtcttattattgaccttttttttttcagaaaaaaaatgtactaaagaattgataaaaataaatattttaaagttttaattacattgacaatatgtgcctttaaaaaaaaaagggactttattattcctacttcaagaacaatattgaagcatcttcatttttggaaggactgtggatgattatgaatgacaggcttactgaatatcctcttgtaattaatacagtaaaacgcttccatctttatccagaggtgagtcataatttgagacaaataatatttgtagagtgatcctttttatcagatataaatagtaagcacaatcttgttaaaaagaaagggaggggacctttcaggtttattaattgtgtgtatccttataggtgagcagaatatcataagttcttctcttaaaatttaaagaccccagaaactgttctcgcatgaactcaaagaatgaaccttagtgtgtaaataatg

SEQ ID NO: 7922 - DNA, 818 bp, Homo sapiens
ttttttgttgctcttgtatagaaatatagttgattttgaatattaactttgtacctgcatcttgatgcagtcagtggttctagtagcttgtttgtagaatcctttggatttttctatgcacgtgatgatagagtctataattaaaaagttttactttccagtagatataccctaaatgtttttaaacagctttattgaggtataattgacatatgatagctggtcatatagatgaagtgtaaagtttgattagttttggcccacctgtaaaaccatcaccagtcaagataatgagcatatccctcatcccgaagtttccctgtcctccttggtaatccctccttccttcgtctctctttgcccacatcccatccctaggaaaccactaatattctctgtcattatggtttagtttgcattttctagaattttatagaaatagaaacagagttgttctgtgcctaggtcttaatttatgcggttgactgagtgatgacacagatcagtgccactgaaagaagaatttatgactaatacttccttggagaagaggacaagtcacatcacacagagccacaggagagatacagtttggtcaggcagaagcaggactgagggtaaagcctaggccatcgcttttattggggtttctatgggaaagggaaaaccaggcagagtttaaaaaagaaaataaataaacaaaatcgaaagacagttgatacactgggagaagatatttgtttggtttctttttgtttgtttattttgagacagagtctcacttcattgcccaggctgaagtgcagtggcgtgatctc

SEQ ID NO: 7923 - DNA, 679 bp, Homo sapiens
ttttttgttgcttttgaatagaaatatagttgattttgaatattaactttgtacctgcatctcgatgaagtcagtggttctagtagcttttttgtagaatcctttggatttttctatgcacgtgatgatatattctgtaattaaaagcagttttactttccagtagatataccctaaatgtttttaaacagctttattgaggtataattgacatatgatagctggtcatatagatgaagtgtaaagtttgattagttttggcccacctgtaacaccatcaccagtcaagacaatgagcatatccctcatcccaaagtttccctgtgctccttggtaatccctccttccttcatctctctttgcccacatcccatccctaggaaaccactaatattctttttgtcattatggtttagtttgcattttctagaattttatagaaatagaaacagagttgttctgtgcctaggtcttaatgtatgcagttgactgagtgatgacacagatagatcagtgccgctaaagaagaatttatgagtaataatttcttggagaagaggacaagtcacatcacacagagccacaggagaaagacagtttggtcaggcagaagcaggactgagggtaaagcctagaccatcacttttattggggtttctatgggaaaggcaaaaccggg

SEQ ID NO: 7924 - DNA, 679 bp, Homo sapiens; identical to SEQ ID NO: 7923

SEQ ID NO: 7925 - DNA, 6217 bp, Homo sapiens
ttttctttattccagccgtctttgtggcaattctacattggtaagatgtagtttcagtttgaaatatttaaaaacatttgaattaaaaattgccatcactctttgcatacagtaaaacaataacttctggctatatttgtagaacatctttatgtgcaccaatttatacatgtattttgcttttttacaaacctcatatgtgaaacagcatttacaaaatagatgcattaggggaatagtaacttatgaattaaaatatttttgctttaccaaataattcaccacacgtttctttaaatatctagcttttctagtgtgttttgcatgtgtagttcatttaaaaccttcctttactttatggtaattatatgttgctagtgaaataacttttttttttttttgagacagagtcttgctctgtctcccaggctggagtgcagtggtgtgatcttgactcactgcaacctctgcctcccaggcacaagtgatccttgtgcctcagccttccaagtagctgggattacaggtgtgcaccaccagacccagccaatttgttgtatttttggtggagacaaggtttcaccatgttggccaggctggtgtcaaactcctggcctcaaatgatccacctgcctcggcctcccaaagtgttgggattacaggcatgagccaccacactcagccagtgaaataactttggtgataaagttttagtaacacctgccaattggaaatcaggtaaaaaagaaggtaaagattctgcagtggttatatggttaaatggctctgagtctttcagtgtgcaagcctgtgtacattattttacaaaagtgtttataaaaatttgtaaaataatatttccttctgaaatattttatttttacctgtgctcagtgatttctacccttgggaggtatgagatctgcccctatgttctattgacacagtgctgctctagacatttagtctgcagggagattttgatgttagaactgaggctgcaatggtagggaatattcctgcagtttttggtaccctggcatatggcctacatgtaaagaagggttagtggaaaacagggttaatatatggaactttgctttattttcaacttcactggaaagtactgactacataagttagctatagcataattgttggccatagctaattttgtttatcacatatgctcttttcttcactgcctatagctgttgagtttcactactaaaaggtcttcaagtacacacctgtattctttggcacttgaaagttgatcttttatgtgatattatacttattgtaagtctgctttgatctaaagtaattttatttaaaattatattctgaaccctcttcaacagttatggaggtatttcccaaggctggtacattagaatcacttgaaacttaaaaaacaaacactaacctgcctctgttctgatttagaggcctgggatggaaggaagggtgaaaaaagccacaagaattttagatatacaattaaggtttttttttgtttttgtttttttgagacagagtctctatctgtcacccaggctggagtgcagtggcatgatctctgctcactgcaacctccacctgctggattcaagaaattctcctgcctcagcctccctagcagcgaggattacagacatgcactactatggctggctaatttttgtgtttttagtagagacggggtttcaccatgttggcaaggctggtctcgaactcctcacctcaagtgatctgcccgcctcgggctcccaaagtgctgggattacaggcatgagccaacgtacccggccacaattaagcttaaaaaccactgagttaaggaatttcaggtgtgtgccatactggattataaatgccgaaaaacatacaagttagtaagcaaattataaaattaatattataacaatttattgttttcttttttatggctttcttattgtttattttactgttagttttgaaacttgttcttattttaatatgattcttcatttttttctaggttacatttagtaacactttttgaaaatgatcatcatttctctcacctctcatctttggaacgggagatgactttttgcattgaaacggttaggtttcttcttctaacgaattaatttgtggtttaagaatagccagaccgagaggtgacagcatgctggcagtcctcagagcccttgcttgctctcggcacctcccctgcctgggctcccgctttggtggcatttgaggagcccttcagtcccccactgcactgtgggagcccctttctgggctggccaaggccggagcccactccctcagcttgcagggaggtgtggagggagagacacgagcgggaaccggggctgtgtgctgcacttgcgggccatctggagttccgggtgggcgtgggcttggtgggccccgcactcagagcagccagccagccctgctggccccgggcaatgggggacttagcacctgggccagtggctgcggagggtgtactgagtcccccagcagtgctggcccaccggcgctgcgctcgatttctcgctgggccttggctgccttcccacggggcagggctcgggacctgcagcccgccatgcctgagcctcctacccaatccatgggctcctgtgcggcctgagcctccccgacgagcaccaccccctgctccacggcgcccagtcccatcgaccacgcaagggctgaggaatgcgagcgcccggcacaggactggcaggcagctccacctgcagccccagtgcaggatccactaggtgaagccagctgggctcctgagtctggtggggacgtggagagtctttatatctagctcagggattgtaaatacaccaatcagcaccctgtgtttagctcaaggtttgtgagtgcaccagtcaacactctgtatctagctgctctggtgagggcgtggagagtctttatgtctagctcaaggattgtaaatacaccaatcagcactctgtgtctagctcaaggattgtaaatacaccaatcggcactctgtatctagctcaaggtttgtaaacacaccaatcagcaccctgtgtttagctcaaggtttgtgagtgcaccagtcgacactctgtatctagctgccctgatggggacgtggagaacctttgtatctagctcagggattgtaaacgcaccaatcagcgccctgacgaaacaggccactcggctctaccaatcagcaggatgtaggtggggccagataagagaataaaagcgggctgcccgagccagcattggcaacccgctcgggtccccttccacactgtggaagctttgttctttcgctctttgcaataaatcttgctactgctcactctttgggtccacgctgcttttgtgagctgtaacactcaccatgaagatctgcagcttcactcctgagcccagcgagaccacgagcccaccgggaggaacgaacaactccagacacgccaccttaagagctgtaacactcaccgcgagggtccaccgcttcattcttgaagtcagtgagaccaagaacccaccaattccggacacaagactatgaggtagaaatgtattaggaattgaaatgaacttttggcgaactgcactgtttcataagctattacccaggtttattatttaaatagtaaagtgtttgagattatttttctgttacttcattatctctcaccctttcctaatgcagacttctttttaaggtaataaagatgaattataatagctgaggaaggaggacaaagaaagcactgaagaagtgataaaggggaatgaaatgagatgttatcagaaattgctttctctttggctacggttaggagatcccatgttttacctgggccttttaatgatgacgattattatttggctctcttttgatttcaagataatctcttttaagagataacttttgatatagtttttaaataattttctgtttttcaatacttaatcttaaaaatggagttttctgccgtacgtatctcacataattattgtgaggagtaagtgggatagcaaatgccaaaattgcgcaattttacatttagaagacagcacaaccgtccatcttccagatctgctcacagctggtcgggggcctagtgaagcattgaaactggctctcctcagtctagccattgctttttgtttaaattatagtaaaatttagatttaaatttgtaataaaaaatttcaatgtttatcatttaagtgtacaattcagtgacattaagtacattcatgttgtcttgcaactattaaccactgtccacatccagaacattttgctatcccaaacagaaactctacccactaaacactaatcacacccagctctattttctgtctctgtgattttgcctatgccaggtccctcagtcactgctttttaattttcatccctatattgccccataaagtttcaaagcattggatacattaacatatgtatgacatttgaacattttaaaggtatttccaaagacagaatataaaatattattaaataaagagtgtaactgtggcagagtctggactttggtgacagatcgctggattctaatagcggttctatgctttattgtatgatggctagtcaggtcacctctcagattctcagtaatctcgtctgctcaatagaaataatgccaatcttagaggggtttagggaaaatgaagggagataatgaatggcagcacatagcagaatacttaaaacaatagctgttattagtaacttatttatatatttaatatttccctaaatatagtcttttgcatattagatatcctttaattgttgtattgctttgttatcctcctaagcagaaaggaaaattctttatgaattcatattttgccaatcaactatgagataatggcctttcagacatcagctaaaacagacctgtaatttagtagttactcgtgttggattaggcagatatgattatagcataaagcattttttagggagaatgcattttaaacaatgtggcccttttttgcttttagattttaggagcgaaagcaagaaattgttggggaaataagacacaacatgctgttgttaatccatgaattttaactcaacagcacttttactatcctaatgaagcctttattttatatgctgaagtgtaagacactaaaataatctgctttttagtacatagcatttgtgagcaacaataatcaattgacattgagctttcactttgcacagaggattagatggagctatgaattaagctagaagcactggattccttgctcatgatgcttatggtcattatattttatttcctgagagcatgggaaaaaaagtaattttctatatgcaaagttgtacagaggcatgaaggcatccctgtttatgatagaattaatcagatgtcaaccttcaagcatctcaaatgtgggggataaaaccagatgtgggaaaatcaaacatatactgtctacacattttaagacattattagagaaactctttaaattgtttgaccatccctctaactctttagtttgaaagcctatagaaaatttgaaagaatagtacagtgatcacctgaaaatacgtgttctttaaagtccaagaatgcaaaatagcaaggagtgattaggaagttgtcttattaacctttcttttttcagaaaaaaagttctaaagaagtgataaaaataaatattttaaagttttaattacattgacaatatgtgccttttttttttttaaaaaagggactttattattcttacttcaagaccattattgaagcaccttcatttttgggaggactgtggatgattatgaatgacaggcttactgaatatcctcttgtaattaatgcagtaaaacgcttccatatttatccagaggtgagtcataatttgagacaaataatatttgtagagtgatcctctttgtcagataaaaatagtaagcacaatcttgttaagaaagggaggggacgtttcaggtttattaattgtatgtatccttatagttgagtagaatatcataagttcctcttaaaatttaaagaccccagaaacagttctctcatgaactcgaagaatgaaccttagtgtgtaaataatggccagggtaatagacaagccaaatggaaaagagggtcatgggagccaaaaagttctaaatagggatgggctt

SEQ ID NO: 7926 - DNA, 674 bp, Homo sapiens
ttttttgttgcttttgaatagaaatatagttgattttcaatattaactttgtacctgcatctcgatgaagtcagtggttctagtagcttttttgtagaatcctttggatttttctatgcacatgatgatacagtctgtaattaaaagcagttttactttccagtagatataccctaaatgtttttaaacagctttattgaggtataattgacatatgatagctggtcatatagatgaagtgtaaagtttgattagttttggcccacctgtaaaaccatcaccagtcaagacaatgagcatatccctccatcccgaactttccctgtgctccttggtaatccctccttctttcgtctctctttgcccacatcccatccctaggaaaccactaatattctttttgtcattatggtttagtttgcattttctagaattttatagaaatagaattgttctgtgcctaggtcttaatatatgtggttgactgagcgatgacacagatagatcagtaccgctaaagaagaatttatgagtaatactgccttggagaagaggacaagtcacatcacacagagccacaggagagagacagtttggtcaggcagaagcagtattgagggtaaagcctaggccatcgcttttattggggtttctatgggaaaggcaaaacaagg

SEQ ID NO: 7927 - DNA, 838 bp, Homo sapiens
gtaagtgctaggcagagtgacctttcatctgatgctaagcccctacaagtttgagaaggtaagaaaagatgaaggagacatatattaggtcagctcttacttttgaaaatgttttatttgaagaaacacctgtagcattgaggtgactgaatgcctccacttatttcaggaaaacgtatccaaaaaaagttgaaatatttggacaactttttttttaagtgccatcgatttccctagcagcattctaaaagatagcaagtaaaatgatgtttgttatcctaaatgctttagttttaggtcatttattaattttcttacaggtgcactttctagtacatgaagtatcctttgtaattaatgtgtgccatatgtttattcccatttagtataactataaattatattttaaattatatatttttaggatagttatattttttttgggttctacgacattgaagttggactagtgatttatttgaatgctgaatcctagtataggggaatataatcttatattttaacaggggtcctctatgggaaaataggatgaactttgtttcccagaaattgttaagtgatgaaaaacttcaaaataattttcctgcattttctgctttatttacatgtaaagtgaattccctgaaaattggatttaaaaagcattctccttcaatgtgcctttaccttgtagctttaacaacttttctgttaaatatgtagttttttattaaacaatgttattaaataaaaacatttatccactgattttattactgttccaatgtaacacattttctacttcatcactcttctgttaccactcttaaatgtctta

SEQ ID NO: 7928 - DNA, 2454 bp, Homo sapiens
tatacaaactcatatacatacttaaattggtacggtggtgtatgtgtgcgtgcgtgtgtgtgtgtatgtgttgtagtcctcaagatgaagttaaatatagactttaattaccctgcaatgaatttaaaacacattctgtatgcttaaactttgagtgcgttggctgtgaaatgtatacatatataaagaggatacctactaaacccaccttaatcataaaggaaaattattttttgttagaattgcttattaaataggcatactttatactgtggtttataatttcaaatataacttggggttatggtcctattcactaagagaatgaaagatatccatgagttaaaagaacaaaactaaaaatttcagatctaacaattgaaagaaaattgaggcagtaaatgacctcttttactcttttatgttttacaatattatcatgttatttacagttaatgctgaaataattctcaagtgcaggaatataaatgttaagtggttttatgattccaagctgatatatttcacctgttaaaaattatgctgctaaattagcattagaggccttatgtttggtaattacaagtgtctgggctattggcgcgtctctatatatgtgtgtgctttgttccagtttcttcaaattatctatgtataattgtatgaaatatttaaatagcaaagaagtcaaagaagattgttaaatattcaacaagaatcataaatacctttatatgtattttaaaagtattgggctgttctgaacatgattatgctggtctgtctgtcttttagcctgactccttcactcttgtgtgtgaagtctattagcaactttcaataagctaagcaatgttgtaacttgcaaaaaagcctccactctgagaaacagggccttatagagtaggaatgttttcatactgggactactgaaattttgcagatgtgtgcatctgttccatttaaggtgcccttaaatgtgttgaatgtaatgtgttgaatgtttatgtgtaatggctaaagtatctatatgtatgtgcataaaactgtcacaagatgtattctcaggaatactgttacctggagtttgaaaggaataactattaaaaaaaaaagttggggaagattagaaaaaagctcaagataaatgttcaaaatattattaagtacatgactaaaagctaattactacatatgataaatgcagtgttggtaatagtagatcatttcttaagccatgatacttaatgatatttatcttattcagaggaaaaacaaaaaaggtacccacttcccatgtagaaaaaattagactcagcaaagaggttgcttcttctgaaattagcttttgagagaccttggaataaaccatgtgttatccatgatagtatgactcagatccaattaaaacagtttaaattctggatataggatctcctatagcaaaacattttactttcatttttcagtatttgctgctttctagaattctattagataagctatgtcatttttctgaaaaagaaactgagttattgagtgtattaagacaaggcactgagaactacagtgtcaaaatcaaagggcataaatgggcatggcagtgctggtggaaaaatctgtggtactggtgatctggttagggcctgttgcacaggctgggagtaactggtttgctgtttcaagcctccaagagtaccttaaacaaggtgatagctcctctcttctttagcattatattcctttagtcaacaaagaactttctccactctgctgcccagctctgagagtatctgagatgagaataggatgtgtgtggaggggcttttagggaagaaagggtcataaatgaatagaagtacagtctgaaacatgaattaaatatccttcctcaagttataaaggatactttaatagaacacagtctccagaattcgctgctatcacaccaagtcatgctgttgccctgtgacctcacacttcccattccatggccttgtcttggcagggagtaaaaaatcccacttctttttactttagtgggtctcaactgcagcatttcagaaacaaattttgatttgacactcaggagaataaaaacaagttgagggcagaatgtatttggaaaagcttaagacaaatttactgatattattttatgatcatttaggattacagatcaatttacctccataaatctttgaattgtcactgtgaccacaggatgaaaatcctttattagccattttataggttaaaacaaaaaattgactacacagccgacttccctcagataactatgaagtctattatgagtactgaatgaccaaagaacatggaaaaaatgcatatgaataaatactgaaatgtttatgaaagatatttatgaaagatattaagacttctgtgtttaggtatgcacatatgataaaataaatctaaaaacattaaaga

SEQ ID NO: 7929 - DNA, 779 bp, Homo sapiens
caaaatagcactttacttctaatgggtggcacaaatctgaataggttttgctgccaatacacatgatgtttcataaacatcttaaaagtcaatggctaaaaggatttagttgtgtgaaaatcacaaaaccagggaggaataaggggaaagagccatttcactgcacattgtttatgattcaagaagccttcagcagttaaaaatatatactattcattgctgctttcatagaaatattaacaaatgatatgatctaaaaatagaatgcaattttttgagattactcacattatacatctcatgcaaatatttatttttatagtttaaaaaatatcaattcaggttggctatacaagtagcaatttacataaaaaaataattaataggaaaaatattactttggggagactaaataacaagcctgcagccatttttgttttgagtaacaatacagccatttagaagaagaaaaaaatactatatagagagctgtggacttttagatatttatttttcaactatcattttcattgcatgttgtaaatcaaaatgcagatggcataagatcatcccatttcataatctatcacattagaatattacagaatattctagaaatcatcagaaataattctgaattaagaacctaaacagcctatacaattataaaaactaaatgtatatataatcacttaaaagagatggtattcctattcctagccctgactacatcaataccaagattagaagctattggaaaatgtgattagtaatacttt

SEQ ID NO: 7930 - DNA, 3861 bp, Homo sapiens
cagcagctcatcccagctccagtcgtggactgtccagccctcctttgaagtgatctcagcacagccacagctcttattccttcatccacctgtaccatctcctgtcagtccatgtcacactggtgagaaaaagtccgactccaggaactacttgcccattctgaattcttacaccaaaatagccccacatccaggcaaaaggggcctttcccttggcccagaagaaaaaggaacaagtggagtgcagaagaaaatctgtactgagagacttgggcctagcttgtcttccagtgagccaaccaaggctggtgctgtcccatccagtccctcgacgccagcaccacccagcgccaaacttgccgaggactcagctctgcagggtgtgccctctctggtggcaggtggaagtccacagactcttcagccggtatccagcagtcacgtggctaaagctcccagtctgaccttcgcttcccccgccagtcctgtctgcgcatcagacagcactctccatgggttagagagcaactctcccctttcaccactgtccgctaattatagctcacctttatgggctgcagagcacctctgccgcagcccagatatcttttcagagcagcggcagagcaaacataggcgctttcagaataccctagtagtcctacataaatctggtttgctggagatcactttgaaaaccaaggagttgattcgtcagaatcaggcaactcaggtagaactagaccagctaaaggagcaaacccagctgtttatagaagccaccaagagcagggcccctcaggcttgggccaagctgcaggcatctttaacacctgggtccagtaatacaggcagtgacctagaagcattctctgatcacccagccatatagcacagaggcatattttcctgttacttgagtggttcttttagctcatttgctgttacctactcctgtttcccaaagcttatgtaagagcttttccttctaaacttaaactgtgttgtggttcacttaggaagccacgtgccaatacctggctgctgtcttaactcgtagtctgggcacaggatacatatgtccccgtcccactgaggacctcagtttgggagtgcccttgagccccttttccttagcctgcaggtgcttcaatggatcatggggcaaagcaggagatgattgtgtggggctcttcctgctgtcacctcccatcatcccactctctcaccaggatcaagggtacagtaacacgaatgagcatacagagcaacacctgttgagccagggagtaggtgacacaaggaaaccttcatggatcttcccttgcctgtcttagtcacagagagaaataagaggaggttgtttgcatcccacaaggcatcgtactagttgggcgagacctaaaattccctgggcacaggttgcacctgggtgtgagcacttaatcactcaacgctttgttttcttacacttgaaaatcaagggaaagagtagtaccatctgactcctacactttcattacaagtcagatttttcttaaactagcaggcaaaaacagtacttccaaattttaaggtatggaatgaatgcagtacatctggaattgtagtcgatgaattgcttttttgacttagaagctgaagaaaatagacatagccggcatatctcatggtcaggagctggacgattctggtaacttaggctttttttctctcttcttttgaaacagtgtaacctgttttatgtctaaaaatcttaaggatagtttcagtggttcctgggatgtagtataagttaactctgctgccatcttgttttttttttttttcctttattttgataagtgattattatgcttgataaactttgaattaaatacagttgtcttgagggtatgataagtccacaaaaaattggaaagcatcttacccattttcttcacatcccaaatttttatttgttccatgtcatagtgatgggaagcagttacagagcagcgtcttctgtgtttccttcatgtgttagatattggcaacaaagccagaggtgtaatgttggttatatgaagttcatctcaaaatggagaccatgaccagagtttccagatgatacacgttcttttcagcttcattaaataggcaactatgtttctaaatagtaaagtttcaaaatattctctcaatttaaaatttcatcctcttgaaaatctttgttctttacaaaattatcttaataagttctatatggtcagcttcatcttccttttttttttttttgagatggagtttcgctcttgttgcccaggcggagtacaatggtgggatctcggctcactgcaacctccgcctcctgggttcaagtgattctcctgccacagcctcccaagtagctgggattacaggtgcctgccaccatgcccagctaatttttgtatttttagtagaaatggggttttaccgtgttggccaggctggtctcgaactcctgacctcagttgatccgcctgcctcagcctcccaaagtgctgggcttacaggcctgagccaccacgctcagctcagcttcaccctgtctgcaaagaaaagttttaccaagaccagaagttaaatatgacatttcctaggtagttgtaactctaacatagtttaaaaagtatgtggcttcagattgcctatactttgttcacaaacgtgtgatttagatatgactgatgtagaagtgaacaacttggtaacatccctagactccactcatgaacgcagaattattacctgctgtttgctttctgaaagaatttcagaaatcagagcaaatgtgtctttaggcagattcagctccttttaatatttttctcttggcccactctctttgcttcccctgaatctgtgtggtactatagcagctctactctgtgcaccatgctaggaagcttcctttttggcagaatatgtttggcagcaaagctatagagacaggtgcattcagaacatcctgggcaccagtcatgagtcttactgtgtcaaaaatctgaaaacacttgctgagaaccaaatttattccattggaaaaaccctctgtggagctataagcctcttggactcttcttcctagattaaggcttgcatttccctccctgtttcagtaaaagatgatgaaagccactatcaatcctcactgctgagtggcagggagaagcagcaccactctcagctcttttctaatcttgtaacttagtgctagaagtctctccaggctattaccatgggcatttgttctctgttggagctgtaagcagatgaacccaagtagagaagatagatcttggaaggagagatccattgagtccagaagccagatcagcaaatggaggaacctcggaggtgaccagaaagatctccatcggttgcccaaggctgtaagtagtgatggttttagcgatgaataacgtaattggctatgaagtactgtggcagagctgctgttttctgaaggtgagaagccatttttagctcagagcaacccttaagagaacttttggcagattttgttggcattattgaaatatatatagaaaagttgctgattgcaatggttatgggaatggaatttaatgacatttgtaatttattacactcattggtttttattgattatagtattgtctgactttttattttctactatggttcctttagcagaaaagtaacttttgtgcatatattgaagtggtttttcagctatgaattctttagggtagaaatttatttagcaaatgtgaattcttttgagaaagtatgaagttttgcagaaattgactgtgaaatgtcagagaaaaataaaagtcacttacttgaaaccta

SEQ ID NO: 7931 - DNA, 291 bp, Homo sapiens
gttgttgtttttgaaaccaagtcttgctctgtcactcaggctggagtgcagtggcgcaatctcagcttactgcaacctccacctcccaggttcaagcgattctcctgcctcagcctcccaagtagctgggactacaggcgcacaccaccaagcccagctaattttttgtattttttagtagagacggggtttcacacgttggccaggctggtctcgaactcctgacctcaggtgatccacctccctcagcctcccaaaatactgggattacaggcatgagccatcacacct

SEQ ID NO: 7932 - DNA, 474 bp, Homo sapiens
agaaataatctctcaagctcttcgtacaaagtttgattaagagagagtgtctgcaactctctgctttgctcccagctgggtctgctgttctagtgagcgccagcagttattctcgttttctgcagtattcccaggctgccaaaaggctctgctctgtaagctgagaaagactcaacagctacaacactggtgttcacagcagcaaggtttatttcctcacaagatgatattcctgggtttgcatacgtttgctcttttcagtgaaccatgtcctctaaatgtcaccttgcttccattcagcacggtctgtgttccgactgtccaggggcttccaggaacagcccacagattgatggcttgctgaaagctccctcgttatctttcactgtaaattcctttcatcagtaatctcttgtgccctggatgcagcacttctttgtacgcgtgctgtgaaataaaatctcagataatgtg

SEQ ID NO: 7933 - DNA, 1820 bp, Homo sapiens
atctttaggtttttcctatagaaaacattcttcctccatcagtagccctttatttgatattcagaagtggaaagctttttcattctccagtagaacttttaaaaattgttacagatacctagctcttcacagatatcatgtactgtaaacagtcatgtgtcttaattttattttctctatttgagtgcataattatcctaataatcccaaagacactgacaactcaaggaacagcagtacagtactattagaagttaagtatgttgttgttatttcacatttcatttaattgtggataaatgttagacatctgttgaaataagctcatatggtggaaacgacaactatattatgaattattttcagaaatggatctttgaatagcagatcaggatttaaataataaaattatctatgaatcacttttatggtcatacatatatgatacaaatccagagttattggtgcagaaatggctacccgagagcttggtaaatttgccttggtttcttatgttaaatgtattgtgcttcccttctgtctctagaatgtggctcttcagaagacagacaatcgacatttaaatttttccaaacaatgaaaaactaaattaaaaacattgcttgatatttcatttaaaattgcaccttgcttaaggtttactgaataactgaaatgtcagcaatttaaaataaattcaattgtgtgataaaatatctcacctataatagaagaaaaggaaaatcatattatttggcaattttgcagcattgtggttgcctaacaggtatatccagcagatgagaaacagtatgaaaggattgtattaacatggtaagttttgccctaaggaaaacgatcttgcattctggattcttgcagcaaagtctcagatacttaatacgttttcttgttttatcatctgttctatgattcggcttcactttgtgtggttattgaattatgtaacagagatttggttttcccaaaatgttatcacatttgaaactatgattgctttgtgttcagtccttttggaacacgtagcttccagcttaagggtagagaaatatatacctaaaatcatcaatacatgaaagaaaaaggatggaaactatgtcctcagttttacttctaccaaaacatccctgtatgtgtgtgcatgtatgttggcgtgtgtgtgtgtgcatgcatattagtaaatgtgtgtttgcatgtgtgtgttggggagtgtatgtgatctgggtgtttgtttatctctgttattattcccctttagctttattttagtcaactctacattatgatgaatttcaaaatgaagctgtattaaaataattgtaatataacaattcaatctcacatgttactgcagatagttaacttttgctgcaatctattgtacatttgcaattttctgtgttagtaaacttagcagaatctggttatttatttttgtgtaggcttaatgttcactgaaagataagtcaattactgttagtaaaaaattaaggtactctcactgcagagatttaaggcctgggcctaatgtgctgtattatgaagccttgtgactgaaaaatatgtttacatatgttgtctatttttttaataaacttttatagctggtctatttgctcagtagctttgatcctctcttgattattgtgactatagtttgcaatggtttattttgtattcaataagaaaaattgtgttaataaagattattgtttaataagccaggtattaacctgctaaatatattaaactgaaaatcactaaatgagtcattcaattaaatacatcaaaaaaggtag

SEQ ID NO: 7934 - DNA, 1821 bp, Homo sapiens
atctttaggtttttcctatagaaaacgttcttcctccatcagtagccctttatttgatattcagaagtggaaagctttttcattctccagtagaacttttaaaaattgttacagatacctagctcttcacagatatcatgtattgtaaacagtcatgtgtcttaattttattttctctatttgagtgcataattatcctaataatcccaaagacactgacaactcaaggaacagcagtacagtactattagaagttaagtatgttgttgttatttcacatttcatttaattgtggataaatgttagacatctgttgaaataagctcatatggtggaaacgacaactatattatgaattattttcagaaatggatctttgaatagcagatcaggatttaaataataaaattatctatgaatcacttttatggtcatacatatatgatacaaatccagagttattggtgcagaaatggctacccgagagcttggtaaatttgccttggtttcttatgttaaatgtattgtgcttcccttctgtctctagaatgtggctcttcagaagacagacaattgacatttaaatttttccaaacaatgaaaaactaaattaaaaacattgcttgatatttcatttaaaattgcaccttgcttaaggtttactgaataactgaaatgtcagcaatttaaaataaattcaattgtgtgataaaatatctcacctataatagaagaaaaggaaaatcatattatttggcaattttgcagcattgtggttgcctaacaggtatatccagcagatgagaaacagtatgaaaggattgtattaacatggtaagttttgccctaaggaaaacgatcttgcattctggattcttgcagcaaagtctcaggtacttaatacgttttcttgttttatcatctgttctatgattcggcttcactttgggtggttattgaattatgtaacagagatttggttttcccaaaatgttatcacatttgaaactatgattgctttgtgttcagtccttttggaacacgtagcttccagcttaagggtagaggaaatatatacctaaaatcatcaatacatgaaagaaaaaggatggaaactatgtcctcagttttacttctaccaaaacatccctgtatgtgtgtgcatgtatgttggcgtgtgtgtgtgtgcatgcatattagtaaatgtgtgtttgcatgtgtgtgttggggagtgtatgtgatctgggtgtttgtttatctctgttattattcccctttagctttattttagtcaactctacattatgatgaatttcaaaatgaagctgtattaaaataattgtaatataacaattcaatctcacatgttactgcagatagttaacttttgctgcaatctattgtacatttgcaattttctgtgttagtaaacttagcagaatctggttatttatttttgtgtaggcttaatgttcactgaaagataagtcaattactgttagtaaaaaattaaggtactctcactgcagagatttaaggcctgggcctaatgtgctgtattatgaagccttgtgactgaaaaatatgtttacatacgttgtctatttttttaataaacttttatagctggtctatttgctcagtagctttgatcctctcctgattattgtgactatagtttgcaatggtttattttgtattcaataagaaaaattatgttaataaagattattgtttaataagccaggtattaacctgctaaatatattaaactgaaaatcactaaatgagtcattcaattaaatacatcaaaaaaggtag

SEQ ID NO: 7935 - DNA, 1821 bp, Homo sapiens; identical to SEQ ID NO: 7934

SEQ ID NO: 7936 - DNA, 5251 bp, Homo sapiens
tttttttttttcagtagagacggtatttcaccatgttagccaggatggtcttgatctcctgacctcgtgatccacccgcctcggcctcccaaagtgctgggattacaggcatgagccaccacgcccggccaagtggaatgaattttcaagagcattgaagttaccataaggggcctagaaatactctgtatacctatatagtgctctaggtattgactagtagtgatttccagcatatcagttcagttaccaaaataaataataatattgttcatttttgtggtgttagtagctgtcttagaagagattgtaacacttgaaattttggtaaaactaaaaatactctacatacattaacttcattactcattttctgtttttcatgttaaaatgttgtttaaagaacaaaattaaatgattttcttctgatattttattctgtgaatgtattttgggaatttttttccccattttccttctacactttatttggtatgtcatcatccttagatttgatatgtagtaggtttagagaatatctttgctttttacatttttttcataagttttatatatgaaatatcatggaaagaagttctaggttataaatatattaataatggcatatatacatttatagcatctctgttttcatcaaactgtttcatagttctattataatttttattcacagacatttaatgattacccttaatattcatgacaggagccctctggcacaaatggaagaagaaagaagggagcaagtagctaaaattaagaagatggagatggagatggagcaggtgtttgagatgaaggtcaaagaaaaagttcaaaaactgaaggactctgaagctgaggtaatcagtccaatattccatctcttagcagacattgtgttcctttttaaatagtatcttcagtaaaatttatagataatataaccttcttatacatattttttaaaaattaataccctagcataacaaaatggagaaatttctacaagcaagcactgtttacaataaaataatatagacttcaatacataagtgcttggacatagtgtattaggtatgacagcataatagagtacttacaatgaattattaaagttataatgaacaagtgtgagttgggaaaaataaaattataagccattccatacaggtggcataagaacactaaaaatgagagtttggggtggatgtatgcacaaaaactagtgttaggataataataattgaccagacttatttgtgtatgaatgaaaaagagggaaataacctttactgaactaaagacatgcctggataaattacacacagttaaaggagagaaaattagggaatgtgatatttttgctaacaggttgggccttatttataatgtagtgtcaaggaaactcctagcgtcgcaacattgggcagggtaatgacaaaacatcccagcagacatatctactatcttgaaacccttctagatgtcgagttatacatttagtttctattagtcaaaaagaccttggagacatttccttcattaggtggcaagaaagaaaagatggagaaaaggataaacttaatataagaatccacagagcagtagtttgatagatatctgagaatagtaggaaaaaaattgggtaatcccaaaataaatcagtgatttcagtatgaagttttctcaacataaatctgctataattaaaaattacaggccttcaggaagtgtcgagtctgggacgcccagcgcgggcccgagcagggggaagggaagcgcagctcggtccgcgtgggtggaggggacgtgaagccgccctgagatgatggttgaggaagggctctacggctcccaagctaggccaaatgcctccggcggccgcgcgccgggcgccccttcccctgtggggcaaccctagcttgggacgcgtgaaccacctccgtagctgccccaccagcacccccagccgtgcgcccctgcaccatgcagctgccctgcgcatggagccgcgagggacagcaggcccagccctcagcaccacctgcctgccaggaggttcgggaaactggcgccgcagcggagagggcatctgtccaacgcctcccccggggctcagctgcgggcccccaggcataggcacccatgacccttctgtgttgtttgtctttgtatagtctgcagatgtggatcctgactcctgagagaagtagctcaccgtgacgaagctgcgtttgcttttatcgatttgcaaatcaaagaagggggacatattgggagaaggccccccaaaatctgccataaactggccacaaaactggccataaaatctctgcagcactgtgacatgctcatgatggccataacgcccacgctggaaggttttgggtttaccggaatgaaggcaaggaacacctggcctgcccagggcagaaaaccacttaaaggcattcttaaaccacaaacagtagcatgagcgatctgtgccttaagggcatgttcctgctgcagataactagccagacccacccctttatttcaggccatcccttcatttcccataagggatacttttagttaattgaatatctatagaaacaatgctaatgactggtttgctgttaataaataagtgggtaaatctctgttcggggctctcagctctgaaggctgtgagacccctgatttcccactttacacctctatatttctgtgtgtgtgtctttaattcctctagcaccactgggttagggtctccccaactgagctggtctcggcacttctctttgccttaaaaacaggtacagcggaccttcctggcatcagaaaaaggcctccagaaaaagagacacaggtactagcaattccaaattatccagagcccttctaagttgtaagatctgaaagaaatgtctgccatctatattctcagccacacttagtttcttaatctgcaagatggaattaataatagtacttactttatgatgctgttgcagaaattcactgagttgctacacgccaaacactgagaacccagctgggcatataataagcattctattgcatggcattattgcatcatttttacttctattactgctactgcttgtaactgcttgtaactgtttgtgcttttttgatatgaaagtccaccatcagggagcactgtagtggaaaaggtattaggccaggcatagctcttagttctctggccttgggtccttcatctgtgatattcagttaacaatacctagccagtaggggtgttaaagattaaataaatgtgagaatgtgcctgttgcttaatcttcctcaaagggttatggactctcagagccagaagaaggtcatctctcctttgctcctcgtatgctgggatctgccacatcaatggcaacagctgggcctccagaatttgctccagggtgtttggaagtcctgacaccctcctgatcttctctgtaacatgcacactttggcctgtgtcagtttgctggaaccacatcaggccggccctcttcctgggacaaaattctttctttttctttctttctttttctttctctttctttctttttctttctctttctttctcttttcccttccttccttccttccttccttccttccttccttccttcccttttcttttcttttctttctactgtgacataatcttggctcactgcaatctctctctcctgggttcaagtgattctactgcctcagcctccaaagtagctgggattacaggtttgcaccaccatgcccggctaattttttgtatttttagtagagacagtgtttcaccatgttggccaggctggtctccatcacctgatctcaggtgatccacccacctcagcctcccaaagtgctgggactacaggcatgagccaccacgcctggccgagagacagttaagttatactttaaatgataataggcctcccccaaaactcagctgcttttgtaaagctaatgggaggccatcaggctgggggcaaggaggagagcccggatcctgctaaggtgcagacataaacgagtatcagccattattctggaggttataagatatgcaccttccccaattacccctgcaatcacaccattattgtagattggcccttagagtatcttttcaggttttttggcatgtctgacactcatggctctacttggacccaccaaccctgctcctatggctccacccagaagccattcagcctagaggacagctctgaccccccctgtgatttcatacaatcagcagcaagtaactgttacctcaccatccccaccccttctgccagactgcctttgaaaaacctctaacctgtgagcacgagatgattccagaacaaactctgtctcccatgtggcatgaccagccttgggtctcttaaactttttctccactataatgccatggtctttatgcagcaggcaggaagaattcaggtggttataattccgtatgtgctttttgaacatttttctactgggctattgctctcttcataatgatttttttaacttctctctataaggaactgatttcatctgaaattgaagagacaatcagagaaaaactatagaccactcatgatggttgttatatgtgcttggctgggccatgggtcccagtgtttggtgaaacacagcagcagatgtccctgtgagtagatgttgctttgaaggtatcttttagatgtgatgaacatttgtcatcagtagactttgagtaaggcagatagcccgtcacaatgtggatgggccttatccaattagttgaaggcctttgaaaaaagactgagatcccaaacgaagaaggaattctgcctccagacagccttccaactcaagtagcaacattacctcctccctgcggctctagctgctggcctttcctatagacttcagacttgccagccccacaatcatgtaagccaattccttaaaataaattctctgtcctgtttttgccccctctctctttctgacagcacacacatgccctcttggttctgtttctttgaagaaccccaggaaaacacacaaaggaaaaacaactcgatagacagaagattcttcaatgacaacaatggaagccatcttcaccattcaactaaacttgaatgggatattatcaaacttaaaaaaaaattatcaactgatcgtgtaatcagtttcatcttttaagacaggaaatgaaataaagtatttacagatgaatgtaaaa

SEQ ID NO: 7937 - DNA, 105 bp, Homo sapiens
ttttttttttttgagatggagtctctctctgtcacccaggctggagtgcagtggcgtgatctcggctcactgcaagttccacttcccaggttcatgccattctcc

SEQ ID NO: 7938 - DNA, 8297 bp, Homo sapiens
ttttttttctttttttttttttttgagacggagtctcgctctgtcgcccaggctggagtgcagtggcaccatctcggctcactagaagctccacctcccgggttcacgccattctcctacctcagcctcccgagtagctgggattacaggcatctgccaccatgcccggcaaattttttttttttttttgagacggagtcttgttctgtcgcccaggctggagtgcagtggcatgatctcggctcactgcaatctccgcctcccgggttcacgccattctcctgcctcagcctctggagtagctgggactacaggcgcccgccaccgagcacggctaattttttgtatttttagtagagacggggtttcaccgtgttagccaggatggtctggatctcctgaccttgtgatccgcccgcctcggcctcccaaagtgctgggattacaggcgtgagccaccgcgcccggccgcaactctcttttttcattcagcattgttttatgagagtcatccaggtgactttgtgtcatgttcatttattttaactgctttatgaaattctcttgtgtgaatacatgaccacagtcccttctcagcaatgctaaaaatctaaacatctctgaaaccacagtttttggttttgtttttaacctatttggtggccaaaacctcaccaggtaaagtttaatagcctctaccacttagtatagatacctaacacatttcagtgaagaaataacgtctgatgatggggagtgcccccaaaccccagtgaggctgttacatggtaaattgtgccaaataatcgttgtacattgaagaattctgaattccaaaacccatctgcccaagggttttaaacatgcagttctgtgcgccacagtcccttggtccacgctgctgttgaatgaacgctcaggtgggtggcttccacattcctgccgctttgaacggtgcttctgtgaacagcgttgtctgtgtttggtgcatcctggtgagtttttctagaatataaatgtattaaaagtagaattgctgggttgtgaggagcacacatgttcagctttgtaaggagtaccagattgtttttgtagcacagtccgttctcctgataccagagtagaaaaagttgaagtgaacttattctttgctaagcattggcattctcagtctggtgggtgtcccacggcagcgttgtctttccgtacatgctcagtgtgggattctccggctcacagctcttccagcgctgccctctgcccttggaggagcatctaaacccctccctcagctgttatttttttcctgtagaaataaatcagaatgagttatgcagaaaaacccgatgaaatcacgaaagatgagtggatggaaaagctcaataacttgcatgtccagagagcagacatgaaccgcctcatcatgaactacctggtcacaggtaatggcttacagtgaggatgctgttgcatgaatgtgattctccctttttgaacacataaggagtgctgtagcactgaggtttgatgacgtagttatttgtgttcagacattatgaaaacacaatgctaacctggtaagtttggaagttatcatgtgaaagccttttctgaagatgagatttttccaggtctctgagacctaacacaaacccatttttcagcctttgacagttttacagttactcaaaataattgagactgttgtgaagtaagtatattgaaagcctaaatagttgatctcttctggccagtctgcaaaaatatgctggcctgtttctggaaagtatgcccaactcagaggatgggaatggggaagagcagaagcgtgcagagggaaataacagtcaggctgttcttgatgtcaactggaggaagggcagtgctgtatatggcaagaaaatagatgtttttaaaagacatgacatgaaaaatctccctcctgttagtccccagttccttctcccaaattaatctctgtgaaacttttttgggccaagcatggtggctcatgcttatagtcccagcactttgagagacagaggaagattgttcgcgcctaggaattccagaccagcctgggcaacatagtgagaccttgtctctacaaaaaaaaaatgttaattagctggatgtggtggcttgtgcctgtagtcccagctacttgggaggctgaggtgggaggatcacttaagcccggaaggcggaggttgcagtgagccaagattgtgccactgcactccagcctgggagagtgagtgggaccccatctcaaaaaaaatatttttggaaggtgaagaggaaatttaggcctataattatgtcaggggcaggggaaggggcacacatgctggctttgaaaaattgtagacactcttaagaggtgggagtcaacaggccactgcaggtatagctgaccatggagggcccctgtgctgtggaggctgagccagtgtgacttgcctaacctggcaccagagctgcggctgctggcgtctggacctattatctgtcctctcaaaggagcccacaccaacacactgggccagcagccattctgacctctttggctaatgggttagagtttttggatgggataacaaggaatgaagtatactcttctcattttctatatgtattttgagagcataacttgtaaattataaagatattaataccgagttcctgagaaagtgtggttcacatcagaggttattaattgaggcaattggagtttctggagatacaaagtctttgccttaattccttgctaactttcctagcagtgaagatggtttttctattcagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcaggtatgtttcaggagagagtagtctggtttgtgaatacttgataagttaaagttatttgcaatgattgagaaataactaggctaatttgctttaataatgttatttcaatgcatgtgagggggagaggtttgagtttgctcttttatgtagttcagaagcggttttttgttttaaaaatgcaaatttgataactcagagatgcaagaaaagtcttccctctgtgatgtacttttgattgggacctggtaccacctgccctaagtccctggcctgggtgtgtgggggtcaagcttgtctgtctctgcctccagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtggggcctgccagagggaagctttcttccattccccatgtgctctgagggggcttcgtgacaacgccaagtgtgtggctttgctgtgtggactgagagacaggtggcttctgtgcctgggatgctaagtggttccttcatggcttttttttttttttttggaggtgaagtcttgttctgtcgcccaggctggagtgcagtgacgagatctctgctcactgcaacccccgcctcctgtgttcaagcgattctcctgcctctgcctcccaagtagctgggactacaggagtgtgccaccacgcccagctaagttttgtatttttagtggagatggggtttcaccatattggccaggctggtcttgaacccctgacctcaggtgatccagtctcccaaagtactgggattacaggtgtgagccatcatgctcagcctctctctggcttttaatcttttatcttgtcaaactagggacaacggacttggtgatcgttacacagtattcacaccctttgctggtgtcttatatttatctgaaccttctttctgtttatgtcccaagtatttctcatttaaaatcctgtcttctgaaacttttctctcctcgctgctatgtttttgtctggcagaacatgacagctcctcgccttcccagacccaggtccctcttcccccgggtcctctcccgggggctctgtcctccctacgctgtcttggaaggatggcctgtcctagagtccacttgagatgttttcttgaggcttgtgaggagggtgctggtatgtcctgctacgctggtcttacctctctcccagtcccctcagcactttgttcaaggcttgctcatggcacttaactgccatcgaggttgcatgtgacgtttaacaaccagactgtgagcttccccaggcaaggactatgtatttcatgtcctgagagtgtctcgcagttaagagcttaatgtttgtttaaactgcctctttttaatagactctgctggtgctctgcgtgtatggtggtttttatcagatgtatttatattctaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaagaatgaccaaaatggcctctaaaagatgttaatcatctcaaatgaccttttgtctttggggcgttcttccccctgtgatagcggcagtggctttttctggtacctgcagctggaaaggccacttggccctgtgctgagtgagcggccttcattagagcgaggcagcccttggccggtggggacgcagagccccagcaggtggtgcacgactgttggcggaaggaacgcgtgttcatcctcagtgatctgccctccagcatctcggcagcatctcatcctccatcgtcagctggctctgccgatgtcctgcttctgttcactcacagaactgtcccctgctccgtggtgggcaggagggaagtggtgcagggctgcgtgcattgcctgcgagtcgggacagttgatgggcacatggccttgtagctctgggcacagatgtgtttggattcattgcagcggaccaccgggcactgttgaccccactgagcagtgctaagtgttggtttagtggatgttcgtggaattgctgacccatccaagggcgtcctttggagccagtggagcctgccggcgcatctgaggggcagaatgctgctagcacttgaatctgggatctcgccttattctcaagtagcaaggcatctcgacaagcatggtctaggtctggtggccagcttgccagtacctgagccggtcgggtcatctgcctctgagggaccgtcctcaccgagctcctgcatcccttgagtgttgatcaggaggcgtccacagcattgttctcgcctctgaatgatgcttctttctgtgttggagcctggcgaagttgtgttttcaagccctctacttctctttccagtgggtaggagcttttggcagtgtttactttacctagatggcttatataatccagtaagagatgcaaagataaaattgctgcggttgttacagaagcatggcggcctccagactgacccattggttgccctttagattttgtaaggatgcggtgctggggaggtggtgcttccctaccccctagaaatgctgccttccaactaccactctcccagatgtgacccttgcgattatttcctctgaggtttgaggatgaagataagttggagggaaagagagtaactaataggggatgaaatatagcagaagctagaagaaagcggtgaggtgagagagatgcatctgcacgttttcttcaacagcaccaggtgattcagcatattcctaattacctttcactattcgtgtatataagatcgtttacttgcataatatatcatcaatttgacatattcttaaaactagagggtgtgagaagcacagcaataggaagtctctccacaaactaggggaacacaaatggggtcattcacgtgcctggactgtcactatgtggctgtcacgtgaagtgctggtgttgatttccatttcagccagtgggtagctgataagccagtgccagcatccagcatgagcagatgtcggggagactgggaagtctccagcgttactgctctccttcccttcatgataagccagtgccagcatccagcgtgagcagacgtcggggagactgggaagtctccgatgttactgcctgccttcctttcgtgtgaggggctgcacttgcttttcttgtgatctgttagtggacgaggtcttccaaggaagtgctttgcacactttctttgctcctttttacagtctttgtctttgcagcaagcaaatgaaattaagccactttgggataatgaacattcagtataattctactttgtctcattttggatctcactgttgtctttataaaaatggcacattttacaaagtagtttattcttattatactttctgctggagagtgccttgaaataaaatgtgagagtattctggtactctgtgttccagatgcatgaaattgggtgaggaataacccctagtctggaatctttgtgaagcatagggttattgcaaggcaaatgggaactaacacatcttgccatttgaatcagggtctccagtttctagaaaaggcagacactggttgggaccaaagtctccatggcacatgactgaagactggtggtcgtgtgtgtgcggagtccacggaagcctcggggaggtggagctgctccttccattccgtcaggacgtgatctgaaaacatgtagagaagatgagttgaggacagcttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcaaattgtattgtcaacatgggtcatttaaagtcctgtatgaaccataacctgctgtggtacctttgtacatgtttgattctgtattctttattccagtgtggcatatgtgcccctctgtatcttttgagaagtgcggaataggttgcttctaccacctgttcttaatgtaacagtaaaagttttcacatttttctcagaa

SEQ ID NO: 7939 - DNA, 665 bp, Homo sapiens
aattcttggctttaaatatccctgtgccccagcaccgccccccccgccccttatttcactaattcatgttttcagctctgagctcaggatctgtaattcagacacctgcttgatttctccagacgcatgtctaatagtcacgtcaaacttgccctgcttctcaaacctgttcttcttccagtccttcctccttatttgtggccccatcttgcagggcctctcatgcttgaaacctgtgaccatcttctattcttccctctcttttgtccggtaatctgtctagcagcagccattgactctggccaaagcatcttgatctcaccttgctctccatctcttctgccgatgttctctctcgcttgggtgtctccctaagggactggctgctcagatctcaccaccctgcattcatcccattttcagccaagagaccaaagttttttaatttattgaaacactttagcagtacttcgtataaagtagtatgtgtaacgtatgtatcagtggcaaaagagaaagacagagtggacggtggcgtgcccctgcctgtctcaggtatccacccattctcccaaagccggaacagctgcctctggggcttcagccatttgcccctcccacaggtaaccccctcctgagtgtcagctttcatgcccttatttaaa

SEQ ID NO: 7940 - DNA, 434 bp, Homo sapiens
tttttttgcttaatgaaattttccaaacatattaaaaacagagggaatacgccagcacatcccagtatccaccagtcagcctgacacccaccaccacctgccagagccccaggcaggagataactacaggtgtctgattctgggtggctaccatgctttcagggccatgagcgtcttcatgagtggaaggcagttgtagggttcttggaaaggactcagactgaccccttcaagggcctgaggtgaaattcagaaactgcccatgcagagaagctgagcagcgggcatcatggagcgaggcgttgagagcttgcatgtttgttgggtatcagagaacagggaaggcctctcctcacctgctgctcctccctatgtggcagtggcatgtcacagtgttcttgatgttcacacacctgtgccagtccattagcctc

SEQ ID NO: 7941 - DNA, 1578 bp, Homo sapiens
cttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtgagtatcgccgaagtgggcattcgcggggtgcgctgccctggagtcactggggaacgacccgactccagaggcctcgacctgacctgtctcctgttttgtctccccttaggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgcagtcttgagtgtatctttgcaagcgccgactccccactcctcccggccttcagatggcaaggaccggcgggaggcgccgtggccgagtccccagcccgcgcacctccctgggcccaggagccccttttcctggagtcacagaacccagcatccggttgccggatgtagtctttcattgcccagtctgcggttttcccaggtagttgccccgcggcgaatccgagatgtggcaatcac

SEQ ID NO: 7942 - DNA, 1578 bp, Homo sapiens; identical to SEQ ID NO: 7941

SEQ ID NO: 7943 - DNA, 473 bp, Homo sapiens
gccagatcctgtctcaaaacaaaaaaaaaaagttaaattctgtgtccatgagcagctgtctgtaaggaagttatggaaatgtgaatctgctttaagttgagtaattaccattactgtaacatttgtataatgtctcacaatttagaatgtttgtcccataaatttggttgtttgacttacagcaaggggcaaatctgggtggctgctaacctattgcctttgtatttgtggccctctgcaccagcctttatgtgaatatttctgcacgctcctaagagagtagttttgctgaactgtccctatacagtctttgcacctttactgtgtacatgtgtgttggtaggtgtacgtggtatgttttcctttttttccaggattgcattctttttatggctgaataatatttaattgtgtattgttgttgttgttgttgttattttatagtgacaaggtctcactatgttgcccaggct

SEQ ID NO: 7944 - DNA, 15266 bp, Homo sapiens
gcagcaacggggtgcggcagggtggggaacgcgggagcggggccagctcccaggaaagctggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaaggtctgcaggcctctgggcgcgggggacctttatcaaagggagcggcgaggggaagggagggaccatacgcaggcggagaagaggtagctggggatcttaaggattttgtagggaaaagccttagcggacccatgggtgtagaagggacgggccgtggcggatgcagactgggagggcctgacgggaaagggaaaggatgggcccctgtggacgccacagcgcgccttccccatccgcaaaggctttccctccctctcctccagctccagcctgaaccatgtttttcacttgtggcccaaatgaggccatggtggtctccggtaagtactgttgttcccttcccagccagtgaccccagaacccctgtgagtctggcctctgccccttctccctctccctaccaacttcccagcaccagacttctgccccttgatggccacgaactgcccagtttgattcccaccattccaaggcccagactgcttcccctccagctcccagattctctcctgtgggttgctgtcccctcacccccgccagttcctcagtcttccacattcaagctctgccaccgttcctcactgccccacaccttgcagggttctgccgaagccccccagtcatggtggctggagggcgtgtctttgtcctgccctgcatccaacagatccagaggtaggcaagaagggaaccagggaagggggacctccgttttctctttttcctcctcttcttactgtctgtcccttctttttcccctaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggttggcctaggggcagggaaccatctggaaggatgtcaaaatgaggggggcccaaggcccacactagtctgtgagagacagtggatccaagagcatacatcccggccgggcagggtggttcatgcctgtaatcccagcactttgggatgccaaggtgggcagatcacttgaggtcaggagttcgagaccagcctagccaacctggtgaaaccccttctctactacaaatacaaaaattagctgggtatggtgatgggtgtcggtaatcccagctacttgggaggctgaggcaggagaatcacttgaacccaggaggcagaggttgcagtgagcaaaaaaaaaaaaaaaaaaaaaacttacatcccttctccccaccatcctgttatcacaggagatctataaggacaggcagaaattctcagaacaggttttcaaagtggcctcctcagacctggtcaacatgggcatcagtgtggttagctacactctgaaggacattcacgatgaccaggtaaaactaggcaattgatccttccccacttccttgctcccatctcttaagccctccaaaggactaatttctacatctctcccacaggactatttgcactctttggggaaggctcgaacagctcaagtccaaaaagatgcacggattggagaagcagaggccaagagagatgctgggatccgggtgagagagatgggggttgcttagtgggaaaggggatagaagtggcacaactgagaagaagcaggggtgctgggtgagcagggaaaatacatgaggcagaaagagaaccttggtgggaagcaggctgtcaccgtggcctttctccccctgccctgacatttcctacctgatctctgcttggacaggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtcagagccactgccaggccactctctgccccttccccattcctctcaggctgtccatctcaggacaccactacactatttctcatactttaactttggtcttattctggctctccatctctggaccaactcccccatatgaggagagatttaaaagactcagacgttacagctgaaaagctttaaagaaaaggccagccgggtgtggtgactcatgcctgtaatcccagcactttgggaggccaaggcgggctgattgcttgacctcaggagttcaaggccagcctgggcaacatggtgaaaccgtgtctatgcgaaaaatacaaacattagccaggcatggcagctcgggcctgtagtcacagctacttggggtatgaggcaggaggattgcttgagccaggatgcgcaggttgcagtgagtcgagatcacactactgcactccagcctgggtgacagtgaaatcctgtccaaaaaagagaaaaaaaaggccacgcgcggtggctcatgcctgtaatcccagcactttggtaggccaaggcaggtggatcacaaggtcaagagttcgagactagcctggccaacatagtgaaaccctgtttctactaaaaatacaaaaattagccaggtatggtggcacgcacctgtagtcccagctacttgggaggctgaggccggagaattgcttgaacccgggagacagaggttgcagtgagctgagaccacgccattgcactccagcctgggtgacagagtgagactccatctcaaaaaaagaaaaaaaaaaaagagaaggccaagaagggatatgatcaataaggctgatcatatgtttggagcaggctgtgcccgtgcaaaggcatctgactgagaaagtggatccgagctcagatccggcccatgcccctctaatcaagcagtgcattctgacatgggtctgcatctacacagaggaatttctgatttgcacagaggcatgctatgggctagcggcagccctggttaattaaaaaagggtatgaagaaggaaaacatggacttggacattgaatcctgcaaagtgagatatgggcagcccttgatattgccaggaagtatagttgatcttcattcttcattattcgtatctgagaatttgcctattcactaaaatgtattggtaacctcaaaaggttaccaataaagtcgcagcactttcaggatcttttgcagacacgcacagtacccaggtgaggttgatcaaggagatgctctgctgccttgtttcagctctcataccgtaagccgtgttattttcacagtatatttactgccgtgttttttgcatttttgtgctttttattggtgaattcactctttaaaatggcccccaagcatcagtgctgtagtgctgtctagtgtcctttagtgcaagcgggctatgatgtgccttatgggagaaatacatgtgttaggtaagcttcgttcatgcataagttatactgctgttagctgtgagttcagtgttaatgaatcaacaatatattttacataaggtgtctttaaacagaaacacatataaagcaaggctctatgttgatcagttgatgaaaatgttttgaccagaggctcacgggaacctagcctgtatttcttctaggaacaaattaggtattaactaattcagcattcatggctactttatagaacagaactaccaagaacaatgaaaatcaactgtactttgagacctttacccaaaggatagcaatattatgcattttgtttttgccaagagttggtacaggctgaaagcataatgaaggtaaaaacatcttttgttattatgttaaattcctgggtgacttgacaggttgaacatggcatacagctttgcaactcaaactgtgttctacccagcagcagctgcagcatcactgcgaagcttgttagaaatacaaaattgcaggccctggccctgaccagctgaatcagaacctgcattttaacaaaatctcaaggtgaattcctaggtgatttgtatgcacattggagtttgagtttgaaaagggttaccatgatggaaactgctagcttgcagtgaagctatggataaggttcttaaccttctaaacatgaccttacttgtctgcagattaagggattggactggttggactcttttcaacttttatcagtttctcgttatgcaccaggcagtgtgctaggtgttcaggaaagaaggatttattcaacaaatatctgttaagtgccttctatgtgctagacaccattttggaggtgaggctataaatatggaggtgaggcagaaaagattcctgcccttatgcagcttacattatgacacaggaaacagctagtaagcaagtaaatgaccttcccaggctataattcttgtttaggtgctgtgaaggaaataaacagggtgatgtgaaaaactgtgggaggggagttagtatattaggttagcgggtggtagagaaagtttctatgaggaagtggtgtttgagatcagacttggagataagaaggaacaatgtacagttctgagccaagaatattctagcctgtgctttttaagtagtcatacttaaaaagtggctgggcgcggtggttcatgcctgtaatcccaacactttgagaggctgagacaggaagatcacttgaggccgggagtttgagaccagtctggccaacagtgaaaccctgtctctaccaaaaatacaaaaaatattagccgggtgtggtggtttgagcctgcagttccagctacttgggaggctgaggcgtgagaatcgcttgaatccagaaggcacagtgagccgagattgcgccaccgcactccagcctgggcgacagagcgagactccttctaagatagatatatggatggatggatggacggatggacggacggacggacggacggacggacggacggacggacggacaacagacagtcagtcagtcagtcagtcatacgtggcttgtggctaggcaggggaccagtaagtgcaaaggctgtgaggtggagtcagaaaggaggtttctgatctgggggcgctggtgtgctgtgagtgaggaggaaaggcaggcagggccagatcacaaagggtttgtgtggtcacgatggagacacagaagagaactgaaagcacagtggaaagctattggagaacttcaagcagaaaggtgccatggtcttatttatatttgtatagggatcagtctggttgccttgtggagaacgggcaaagagaggaagcaaggccgggtgcggtggttcacacctgtaatcccaacactttgggaggccgaggtgggcagatcacgaggtcaggagatcgagaccatcctggctaacatggtgaaaccccgtctctactaaaaatacaaaaaattagctgggcgtggtggcaggcacctgtagtcccagctactcgggaggctgaggcagaagaatggcataaacccgggaggcggagcttgcagtgagccgagatcgcgccactgcactccagcctggatgacagagtgagactctgtctcaaaaaaaaaagcaaaagatgagttgggctctttttcagagatgatggattaaacaaatgtagctaattttactctctcctaaaacctcactaaagccaaaatgattttttttttttttgagatggagtctcgctctgtcgcccaggctggagtgcagtggcgcgatctaaaatgattttttttaaggtaaagatagaggcttgtccaaaggtagtgagttatctcaattgattgttcagtcagttacagattgaactccttgttctactctttacctacttctcactattgcacttgattagtctttctttcttcctttctttccttctcttctcttctttcttctctcctctcctctttgagaccgggtcttactcggtcccccaggctagagtgcagcggtacaatctcagctcactacagcttcaactgcctgggctcaagcaatactcccacctcagcttcctgagtagcttggtctacaaacatatgccaccacgcctggctaatttttgtatgttttgtagagacggaatttcaccatgttgcccaggctggtctcaaactcctgggctcaaaggatccttcccgcctcagcctcccaaaatgctaggattacaggcgtgagccaccatgcccagctgactaggctttaaaaaaaaaaaagatggagaaaataggaacggaaaccagagcatcattttggaaactggaagtcagtagtaattgactaagcaggtatgacacagctgagcttgaaacctgcaaaagggaaaacaatgaaatgatctgaggctcaggagctggcagcacccagtgcttctccagctgtggtagactggttaaataagaggaacatgtgaaaagcaccttctcagagcccctcactgcctctgggtaatggttcctgccctgctccaacagacatctggaggtttattatcttatttatctattttatttatgttttttttgagacagggtctctcactctgttgtccaggctggagtgcaggtgcagtggcgcagtctcggctcactgcaacctctgcctcctgggttcaaatgattctcgtgcctcaccctcccaagtaatcctcaactgggattacaagtgcccaccaccacgcccaggtaatttttgtatttttttttttttttttagtagagaggggtttcaccatgtcggccaggctggtctcgaactgctagcctcaagtgatccatccacctcagcctcacaatgtgctgggattacaggtgtgagttaccatacctgccattggaagtctattatctgaagagagtagactagaggatgtgatgggggctggcccagcacaggtgaggacctagatagtttaccagtaacaggggcatgaaatgactataactttcatgaatgctaaatactgagagccaaccccaaccccaaccccctcaaccccactcagctcccagaacttccatcttccaaaaaagagatcagaagactgctctggggaacatgaccaatccaaaaagaaataacttaaaatcctgaatcagatgtttctccgtacatggcctatccagatcaccgtagggtgaagctcaaagtcagcaagcctcacccacatactcagagcttcctttcagtgttgagaccttcttccctctgagcagatgacaaaggagtttgaaaccagcctggccaacatggtgaaaccccgtctctactaaaaacacaaaaattagctgaaatggtgactgtaatcccagctactcaggaggctgaggcaggagaatcacttgaatccgggaggcagaggttgcagtgagctgagatcgtgccatttcattccagcctgggcaacagagcaagccatcacagatttgggagcaaccaagaaagccagggacagggtatgcttggtaacctggcaagagctgacaaaggggaaaaataaaaccccacagaaagaagcagggaagtaagggaaagggactaataagagtcaagcagggccaggggtgttggctcatgcctgtaatcccagcactttgggaggccaaggtgggtggctcacgaggtcaggagatcgagaccatcctggctaacacggtgaaaccccaactctataaaaatacaaaaaattagccaggcgtggtggtacgcgcctgcagtcccagctactcgggaggctgaggcaggagaatcacttgaacctgggaggcagaggttgcagtgagatgagatcatgccactgcactccagcctgggtgacagagcgagactccatctccaaaaaaaaaaaaaaaagtcaagcacatgcaaatgtggcatgacttattgggagcagaaacattctgagaaaaattatataaaaatgaggttttagattgaaatggtctactaagtgcccaatgcaatgaatgaaaaatatatacattgaaacataacactgtgaaacttaagaatgctgaggacaaaaaatatgaaagcttctagagagagagagatctcaaagaggcaggcttcaaaatgacttcagattcctttttttttttttttttttttttttcagagacagggtcttgctctgttgtccaatacagtggcataaacaaggctcactgtaacctcaacctcccaggctcaagtgattctcccacctcagcctccccagtagttgggaccacaggggcacaccaccacgcccagctaatttttaaatttttttctagaggtgagatcttgccatattgcacaggctggtcttgaactcctgggttcaagttatcctcccaccttagcctcccaaagtgctgggattataggcatgagccactgcatcaagcccagctttcttttctttttttttttttttgagatggatttttgctcttgtcacccaggctggagtgcaatggcgtgatctcagctactgcaacctctgcctcctgggttcaagcgattctcctacctcagcttcccaagtagctgggactacaggtatgtgccaccattgctggctaatttttgtatttttagtagagacggggtttcaccacgttgaccaggctggtcatgaactcctgacctcaggtgatctgcccacctcagcctcccaaagtgctgggatgacaggcatgagccaccatgactggcccaagcccagatttcttaaaaagctagaaaaccatggaggaatgccttcagaattctgatggaaagttaatcccaacatagcagcctgctttcagcctaactggtattaaaatagaagggtagaggccgggtgcagtggctaacgcctgtaatcccagcactttgggaagccgaagcaggtggatcacctgagataaggagttcaagaccagcctggccaatgtggtggaaccccatctctattaaaaacacaaaaattagctgagcgtggtggcaggcacctataatcccagatacatgggaggctgaggcaggagaattgcttgaacctgggagatggagattgcagtgagccaagactgcgtcactgcactccagcctgggtgccaagagcgaaattccatctcaaaaaaaggtagaataaaaatctcagagaaagcaagacctcagaaaaaatattgtctttatattctttctgaggaagcttctggaggttgagtttcaccaaaaggtgggcatagacaggaaggaaaaagaaacagacaaatggttgcctaagggacacaggagagaggtgatcctgcacaccggtgtagagggcaacgaggccagtttggaacgggtttgaaaatttagggtgaaagacagtacagagtgccgtctccagagctatgcttctctctggagtgaacagatgggcccgggggaaggtaggaggcaggggaagcatcacatgtattgatgagacctacaatgatgatggtgcatggctgagcctgagcaatgggacaacgaaggcatgtgttctggctgggtgtgatggcacatgcctgtaaccccaacactttgggaagccgaggcaggtggatcacgtgagcccaggagtttgagatcagcctgggcaacatagaaaaccctgtctctacaaaaagtacaaaaaatagccgggtgtgctggttcacacctgtagtcccagctactctagagggggaggcgggaggatcatctgagcccaggcaggtcaaggctgcagtgagccatgattacgccattgaacctgggtgacagagtaagatgatgtctcaaaaagaaaaaaaaaatgtgttccttgcctggcacctctcctcactagcatcttgataagagccttctgattccctcacactgcaaggaataagaagatgaaatctaggctgggtgcgatggctcatgcctgtaatcccagcactttgggaaactgaggcgggtggatcacttgagatcaggagtttgagaccagcctggccaacatggtgaaaccccgtctctactaaaaaaaatacaaaaattagccagacatggtagcacatgcctgtagtcccagctacttgagaggctgaggcaagagattagcttgaacctgggaggtgaaggttgcactgagctgatcgtgccactgcactccagcctgggcaatagagcgaaactgcctcaaaaaaaaagaaagaaatctgcctaaataagaggaattctatgaatacacacattcttgtagatgttcagagtatccctggaaggatacacaagaagctggtcttggtggtttctctgggaaagggacccaggtggtttggagaatgaggaagaagcctcgtggttcacttttttttctgttaaatctgcaccatgtgcaaaagacaaaaaagatcacctgtccccacccccacaaaaaataagtcagctattgcagtagcctaggctagcactaaggttatcgcagcaacagtggggggatttgagcaagactggagatagcagaaagccaacatgtgctcagtgccctcaaggtatttatactctagaagggggcacacgtgggaaaaatagattaaacgggggctcatcagagaaacactggactccactggactggccaagcagacaggagggaacccaccttcatgcacctgctcctttttttttttttttttttttggagatggagtcttactctgttgcccagggtggagtgcagtggcgtgatcccagctcactgcaaccttcgcctcccaggttcaagcaattctcctgcctcagcctcccgggtggctgggactacaggcattcgccaccacacctggctaattttttgtattttagtagagacagggtttcaccatgttggccaggctggtctcgagctcctgaactcaggcaatccaccctccttggcctcccaaagcgctaggattacaggcgtgagccaccgcgcccggccaccggctcctatttttatatcccactctggagctctggttcccgggcacttgctcttcacctctgactcagagcgtgaacctgacttcaccctcctacccaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtaaatgtcccctccctgaccctgcctagctcacttgccacctaggcaccccaagatggagtgctgaagccttcaccacctggactcctatggatttcaggtttcaggagcgtctgcctctgcagcactgggcctttctcctgggagtaagggctgctgggctccaccctccacttcccttctgtccacaggtcccaactaattatgcaggcggaggcagaagccgcgtctgtgcgggtgagttaagaggcagttccatgctggcttgtggagagggtgggggttgctgcttgatcggggatttcttgttcttaatgatttccgtcaatctcacaagcatccttaaccctcagatgcgtggggaagctgaggcctttgccataggggcccgagcccgagccgaggctgagcagatggccaagaaggcagaagccttccagctgtaccaagaggctgctcagctggacatgctgctagagaagctgccccaggtctggaggtcatgtgggcaccaagaaaggaggaaatagaaccagggactaaggggtggggtgtagtgaggggcttagggagaaacagcctagggggactctaaattaggggtgggaattattagtgaccaaagtgaggaaggatgatcagtggaacgaggaccttaaaacccagagtaagttgttttatgaggaatgtggtcagatcatgggcactgagtgggtgtctctctcctgccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaggtctcaggttggagctgaggagaattgctaggttcctgtgttgtgtgacacagtatgcctagcatttaaccagcatccaggcctgggagtcattgatgtttattaatcactttctgtgtgccagacacagtgctaagcttctacataaatgagttgttttaaatcaaactaccattagggtatataggattttacaaagtccagaaactcaacatccagcatgttcctactcattctgctagtgcagctggagtgaaatccaggtcgactgtctctgcaacctgtgcttgtggtcaccccactagtatagggaactagttgcagcctattgacagttaattaattctagggcatatcactgcttttctcagcgccccagttaattcacctgtagatcatggtagaagtcagcaaacaggctctggaaccactgttttgttgcgaatcctagctacaatgcctgctagctgtaatcttggacaagtaatcaacctctctatacctgtttcctcatcttaaaattgggttaataattagaaactaccctgttgaattgttgaggggctcgagcaaatatttgcagtgtttagaatagtgcctggtatatagtaagcattatgtgtatgttaaagaaatggggccaggtgcagtggcttacgcctgtaatcccagcactttgggaggctgaggcaggcagatcacctgaggttaggagttggagaccagcctggccaacatggtgaaacaccatctttactaaaaatacaaaaaaaaattagccaggcttggtggtgcatgcctgtaatctcagctactcgggaagctgaggcaggagaattgctggaacccaggagccgaaggttgcagtgagctgagatcacaccactgcactccagcctgggtgacagaataaggctctatctcaaaaaaaaaaaaaaattccaggcgcggtagctcatgcctgtaatcccagcactttgggaggctgaggcgggcggatcacgaggtcaggagattgagaccatcctggctaacacagtgaaaccccgtctctactaaaaatacaaaacagccgggcgtggcggtgtgtgcctgtagtcccagctgctggggaggctgaggcaggagaatggtgtgaacctgggaggcagagcttgcagtgagccgagatagcaccactgcactccatcctaggcaacagagcaagactctgtctcaaaaaaaaaaagagaaagaaatgcatattcgggctgggtgctgtggctcacacttgtaatcccagaactttgggaggccagggtggacgatcagctgaggtcagaagtttgagatcaccctggccaacatggtgataccccatctctaccaaaaatacaaaaattagctgggtatggtggcgcatacctgtaatcccagctactcgggaggctgaggcaggagaatcacttgaactcaggaggcggaggctgcagtaagccaagatcgcaccactgcattctagcctgggtgatagagtgagattccgtctcaaaaaaaaaaagaaaaaaaaaaagcgtatgtaaataaaagcactggatcataccaatgaccttcaagctgggttccttggagcctcctggaggcctgcagtagaatattcagagctaaggagagtgtgcaaacaaggctctgccccctctcctctcttcagtgatttattgtatgtgggtcctgatgtctttgtttggggaaacaggtggtagggcaccagaaagaaccctggccgtgtgtgttctgcctatagcccattcgtctaaactggggcccgggagagtaggggcctcagcctcccgaatgttcccaagtgtcatctactgttgtctttttgccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagtctgagggatgggctggaggttttcaactttgctacccaaataaattgctgtaagtaagtactaataaaacagaagcaactggaaattaatgcttggcccggcacagtggctcatgcctgtaatcccagcactttgggaggccaaggcaggcagatcatctgaggtcaggagttcaagaccagcctggccaacatgacgaaaccttgtctctaccaaaaatacaaaaattagccaggcagggtgaaacatgccaagtagtagtcccagctacttgggaggctgaggcaggagaattacttgaacctgggaagcagaggttgcagtgagccaagatcgcaccactgcactctagcctaggtgacagagtgagactgtttcaaaa

SEQ ID NO: 7945 - DNA, 473 bp, Homo sapiens; identical to SEQ ID NO: 7943

SEQ ID NO: 7946 - DNA, 15271 bp, Homo sapiens
gcagcaacggggtgcggcagggtggggaacgcgggagcggggccagctcccaggaaagctggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaaggtctgcaggcctctgggcgcgggggacctttatcaaagggagcggcgaggggaagggagggaccatacgcaggcggagaagaggtagctggggatcttaaggattttgtagggaaaagccttagcggacccatgggtgtagaagggacgggccgtggcggatgcagactgggagggcctgacgggaaagggaaaggatgggcccctgtggacgccacagcgcgccttccccatccgcaaaggctttccctccctctcctccagctccagcctgaaccatgtttttcacttgtggcccaaatgaggccatggtggtctccggtaagtactgttgttcccttcccagccagtgaccccagaacccctgtgagtctggcctctgccccttctccctctccctaccaacttcccagcaccagacttctgccccttgatggccacgaactgcccagtttgattcccaccattccaaggcccagactgcttcccctccagctcccagattctctcctgtgggttgctgtcccctcacccccgccagttcctcagtcttccacattcaagctctgccaccgttcctcactgccccacaccttgcagggttctgccgaagccccccagtcatggtggctggagggcgtgtctttgtcctgccctgcatccaacagatccagaggtaggcaagaagggaaccagggaagggggacctccgttttctctttttcctcctcttcttactgtctgtcccttctttttcccctaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggttggcctaggggcagggaaccatctggaaggatgtcaaaatgaggggggcccaaggcccacactagtctgtgagagacagtggatccaagagcatacatcccggccgggcagggtggttcatgcctgtaatcccagcactttgggatgccaaggtgggcagatcacttgaggtcaggagttcgagaccagcctagccaacctggtgaaaccccttctctactacaaatacaaaaattagctgggtatggtgatgggtgtcggtaatcccagctacttgggaggctgaggcaggagaatcacttgaacccaggaggcagaggttgcagtgagcaaaaaaaaaaaaaaaaaaaaaacttacatcccttctccccaccatcctgttatcacaggagatctataaggacaggcagaaattctcagaacaggttttcaaagtggcctcctcagacctggtcaacatgggcatcagtgtggttagctacactctgaaggacattcacgatgaccaggtaaaactaggcaattgatccttccccacttccttgctcccatctcttaagccctccaaaggactaatttctacatctctcccacaggactatttgcactctttggggaaggctcgaacagctcaagtccaaaaagatgcacggattggagaagcagaggccaagagagatgctgggatccgggtgagagagatgggggttgcttagtgggaaaggggatagaagtggcacaactgagaagaagcaggggtgctgggtgagcagggaaaatacatgaggcagaaagagaaccttggtgggaagcaggctgtcaccgtggcctttctccccctgccctgacatttcctacctgatctctgcttggacaggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtcagagccactgccaggccactctctgccccttccccattcctctcaggctgtccatctcaggacaccactacactatttctcatactttaactttggtcttattctggctctccatctctggaccaactcccccatatgaggagagatttaaaagactcagacgttacagctgaaaagctttaaagaaaaggccagccgggtgtggtgactcatgcctgtaatcccagcactttgggaggccaaggcgggctgattgcttgacctcaggagttcaaggccagcctgggcaacatggtgaaaccgtgtctatgcgaaaaatacaaacattagccaggcatggcagctcgggcctgtagtcacagctacttggggtatgaggcaggaggattgcttgagccaggatgcgcaggttgcagtgagtcgagatcacactactgcactccagcctgggtgacagtgaaatcctgtccaaaaaagagaaaaaaaaggccacgcgcggtggctcatgcctgtaatcccagcactttggtaggccaaggcaggtggatcacaaggtcaagagttcgagactagcctggccaacatagtgaaaccctgtttctactaaaaatacaaaaattagccaggtatggtggcacgcacctgtagtcccagctacttgggaggctgaggccggagaattgcttgaacccgggagacagaggttgcagtgagctgagaccacgccattgcactccagcctgggtgacagagtgagactccatctcaaaaaaagaaaaaaaaaaaagagaaggccaagaagggatatgatcaataaggctgatcatatgtttggagcaggctgtgcccgtgcaaaggcatctgactgagaaagtggatccgagctcagatccggcccatgcccctctaatcaagcagtgcattctgacatgggtctgcatctacacagaggaatttctgatttgcacagaggcatgctatgggctagcggcagccctggttaattaaaaaagggtatgaagaaggaaaacatggacttggacattgaatcctgcaaagtgagatatgggcagcccttgatattgccaggaagtatagttgatcttcattcttcattattcgtatctgagaatttgcctattcactaaaatgtattggtaacctcaaaaggttaccaataaagtcgcagcactttcaggatcttttgcagacacgcacagtacccaggtgaggttgatcaaggagatgctctgctgccttgtttcagctctcataccgtaagccgtgttattttcacagtatatttactgccgtgttttttgcatttttgtgctttttattggtgaattcactctttaaaatggcccccaagcatcagtgctgtagtgctgtctagtgtcctttagtgcaagcgggctatgatgtgccttatgggagaaatacatgtgttaggtaagcttcgttcatgcataagttatactgctgttagctgtgagttcagtgttaatgaatcaacaatatattttacataaggtgtctttaaacagaaacacatataaagcaaggctctatgttgatcagttgatgaaaatgttttgaccagaggctcacgggaacctagcctgtatttcttctaggaacaaattaggtattaactaattcagcattcatggctactttatagaacagaactaccaagaacaatgaaaatcaactgtactttgagacctttacccaaaggatagcaatattatgcattttgtttttgccaagagttggtacaggctgaaagcataatgaaggtaaaaacatcttttgttattatgttaaattcctgggtgacttgacaggttgaacatggcatacagctttgcaactcaaactgtgttctacccagcagcagctgcagcatcactgctaagcttgttagaaatacaaaattgcaggccctggccctgaccagctgaatcagaacctgcattttaacaaaatctcaaggtgaattcctaggtgatttgtatgcacattggagtttgagtttgaaaagggttaccatgatggaaactgctagcttgcagtgaagctatggataaggttcttaaccttctaaacatgaccttacttgtctgcagattaagggattggactggttggactcttttcaacttttatcagtttctcgttatgcaccaggcagtgtgctaggtgttcaggaaagaaggatttattcaacaaatatctgttaagtgccttctatgtgctagacaccattttggaggtgaggctataaatatggaggtgaggcagaaaagattcctgcccttatgcagcttacattatgacacaggaaacagctagtaagcaagtaaatgaccttcccaggctataattcttgtttaggtgctgtgaaggaaataaacagggtgatgtgaaaaactgtgggaggggagttagtatattaggttagcgggtggtagagaaagtttctatgaggaagtggtgtttgagatcagacttggagataagaaggaacaatgtacagttctgagccaagaatattctagcctgtgctttttaagtagtcatacttaaaaagtggctgggcgcggtggttcatgcctgtaatcccaacactttgagaggctgagacaggaagatcacttgaggccgggagtttgagaccagtctggccaacagtgaaaccctgtctctaccaaaaatacaaaaaatattagccgggtgtggtggtttgagcctgcagttccagctacttgggaggctgaggcgtgagaatcgcttgaatccagaaggcacagtgagccgagattgcgccaccgcactccagcctgggcgacagagcgagactccttctaagatagatatatggatggatggatggacggatggacggatggacggacggacgggcggacggacggacggacggacggacgacagacagtcagtcagtcagtcagtcatacgtggcttgtggctaggcaggggaccagtaagtgcaaaggctgtgaggtggagtcagaaaggaggtttctgatctgggggcgctggtgtgctgtgagtgaggaggaaaggcaggcagggccagatcacaaagggtttgtgtggtcacgatggagacacagaagagaactgaaagcacagtggaaagctattggagaacttcaagcagaaaggtgccatggtcttatttatatttgtatagggatcagtctggttgccttgtggagaacgggcaaagagaggaagcaaggccgggtgcggtggttcacacctgtaatcccaacactttgggaggccgaggtgggcagatcacgaggtcaggagatcgagaccatcctggctaacatggtgaaaccccgtctctactaaaaatacaaaaaattagctgggcgtggtggcaggcacctgtagtcccagctactcgggaggctgaggcagaagaatggcataaacccgggaggcggagcttgcagtgagccgagatcgcgccactgcactccagcctggatgacagagtgagactctgtctcaaaaaaaaaagcaaaagatgagttgggctctttttcagagatgatggattaaacaaatgtagctaattttactctctcctaaaacctcactaaagccaaaatgattttttttttttttgagatggagtctcgctctgtcgcccaggctggagtgcagtggcgcgatctaaaatgattttttttaaggtaaagatagaggcttgtccaaaggtagtgagttatctcaattgattgttcagtcagttacagattgaactccttgttctactctttacctacttctcactattgcacttgattagtctttctttcttcctttctttccttctcttctcttctttcttctctcctctcctctttgagaccgggtcttactcggtcccccaggctagagtgcagcggtacaatctcagctcactacagcttcaactgcctgggctcaagcaatactcccacctcagcttcctgagtagcttggtctacaaacatatgccaccacgcctggctaatttttgtatgttttgtagagacggaatttcaccatgttgcccaggctggtctcaaactcctgggctcaaaggatccttcccgcctcagcctcccaaaatgctaggattacaggcgtgagccaccatgcccagctgactaggctttaaaaaaaaaaaagatggagaaaataggaacggaaaccagagcatcattttggaaactggaagtcagtagtaattgactaagcaggtatgacacagctgagcttgaaacctgcaaaagggaaaacaatgaaatgatctgaggctcaggagctggcagcacccagtgcttctccagctgtggtagactggttaaataagaggaacatgtgaaaagcaccttctcagagcccctcactgcctctgggtaatggttcctgccctgctccaacagacatctggaggtttattatcttatttatctattttatttatgttttttttgagacagggtctctcactctgttgtccaggctggagtgcaggtgcagtggcgcagtctcggctcactgcaacctctgcctcctgggttcaaatgattctcgtgcctcaccctcccaagtaatcctcaactgggattacaagtgcccaccaccacgcccaggtaatttttgtatttttttttttttttttagtagagaggggtttcaccatgtcggccaggctggtctcgaactgctagcctcaagtgatccatccacctcagcctcacaatgtgctgggattacaggtgtgagttaccatacctgccattggaagtctattatctgaagagagtagactagaggatgtgatgggggctggcccagcacaggtgaggacctagatagtttaccagtaacaggggcatgaaatgactataactttcatgaatgctaaatactgagagccaaccccaaccccaaccccctcaaccccactcagctcccagaacttccatcttccaaaaaagagatcagaagactgctctggggaacatgaccaatccaaaaagaaataacttaaaatcctgaatcagatgtttctccgtacatggcctatccagatcaccgtagggtgaagctcaaagtcagcaagcctcacccacatactcagagcttcctttcagtgttgagaccttcttccctctgagcagatgacaaaggagtttgaaaccagcctggccaacatggtgaaaccccgtctctactaaaaacacaaaaattagctgaaatggtgactgtaatcccagctactcaggaggctgaggcaggagaatcacttgaatccgggaggcagaggttgcagtgagctgagatcgtgccatttcattccagcctgggcaacagagcaagccatcacagatttgggagcaaccaagaaagccagggacagggtatgcttggtaacctggcaagagctgacaaaggggaaaaataaaaccccacagaaagaagcagggaagtaagggaaagggactaataagagtcaagcagggccaggggtgttggctcatgcctgtaatcccagcactttgggaggccaaggtgggtggctcacgaggtcaggagatcgagaccatcctggctaacacggtgaaaccccaactctataaaaatacaaaaaattagccaggcgtggtggtacgcgcctgcagtcccagctactcgggaggctgaggcaggagaatcacttgaacctgggaggcagaggttgcagtgagatgagatcatgccactgcactccagcctgggtgacagagcgagactccatctccaaaaaaaaaaaaaaaagtcaagcacatgcaaatgtggcatgacttattgggagcagaaacattctgagaaaaattatataaaaatgaggttttagattgaaatggtctactaagtgcccaatgcaatgaatgaaaaatatatacattgaaacataacactgtgaaacttaagaatgctgaggacaaaaaatatgaaagcttctagagagagagagatctcaaagaggcaggcttcaaaatgacttcagattccttttttttttttttttttttttttttcagagacagggtcttgctctgttgtccaatacagtggcataaacaaggctcactgtaacctcaacctcccaggctcaagtgattctcccacctcagcctccccagtagttgggaccacaggggcacaccaccacgcccagctaatttttaaatttttttctagaggtgagatcttgccatattgcacaggctggtcttgaactcctgggttcaagttatcctcccaccttagcctcccaaagtgctgggattataggcatgagccactgcatcaagcccagctttcttttttttttttttttttttgagatggatttttgctcttgtcacccaggctggagtgcaatggcgtgatctcagctactgcaacctctgcctcctgggttcaagcgattctcctacctcagcttcccaagtagctgggactacaggtatgtgccaccattgctggctaatttttgtatttttagtagagacggggtttcaccacgttgaccaggctggtcatgaactcctgacctcaggtgatctgcccacctcagcctcccaaagtgctgggatgacaggcatgagccaccatgactggcccaagcccagatttcttaaaaagctagaaaaccatggaggaatgccttcagaattctgatggaaagttaatcccaacatagcagcctgctttcagcctaactggtattaaaatagaagggtagaggccgggtgcagtggctaacgcctgtaatcccagcactttgggaagccgaagcaggtggatcacctgagataaggagttcaagaccagcctggccaatgtggtggaaccccatctctattaaaaacacaaaaattagctgagcgtggtggcaggcacctataatcccagatacatgggaggctgaggcaggagaattgcttgaacctgggagatggagattgcagtgagccaagactgcgtcactgcactccagcctgggtgccaagagcgaaattccatctcaaaaaaaggtagaataaaaatctcagagaaagcaagacctcagaaaaaatattgtctttatattctttctgaggaagcttctggaggttgagtttcaccaaaaggtgggcatagacaggaaggaaaaagaaacagacaaatggttgcctaagggacacaggagagaggtgatcctgcacaccggtgtagagggcaacgaggccagtttggaacgggtttgaaaatttagggtgaaagacagtacagagtgccgtctccagagctatgcttctctctggagtgaacagatgggcccgggggaaggtaggaggcaggggaagcatcacatgtattgatgagacctacaatgatgatggtgcatggctgagcctgagcaatgggacaacgaaggcatgtgttctggctgggtgtgatggcacatgcctgtaaccccaacactttgggaagccgaggcaggtggatcacgtgagcccaggagtttgagatcagcctgggcaacatagaaaaccctgtctctacaaaaagtacaaaaaatagccgggtgtgctggttcacacctgtagtcccagctactctagagggggaggcgggaggatcatctgagcccaggcaggtcaaggctgcagtgagccatgattacgccattgaacctgggtgacagagtaagatgatgtctcaaaaagaaaaaaaaaatgtgttccttgcctggcacctctcctcactagcatcttgataagagccttctgattccctcacactgcaaggaataagaagatgaaatctaggctgggtgcgatggctcatgcctgtaatcccagcactttgggaaactgaggcggatggatcacttgagatcaggagtttgagaccagcctggccaacatggtgaaaccccgtctctactaaaaaaaatacaaaaattagccagacatggtagcacatgcctgtagtcccagctacttgagaggctgaggcaagagattagcttgaacctgggaggtgaaggttgcactgagctgatcgtgccactgcactccagcctgggcaatagagcgaaactgcctcaaaaaaaaagaaagaaatctgcctaaataagaggaattctatgaatacacacattcttgtagatgttcagagtatccctggaaggatacacaagaagctggtcttggtggtttctctgggaaagggacccaggtggtttggagaatgaggaagaagcctcgtggttcacttttttttctgttaaatctgcaccatgtgcaaaagacaaaaaagatcacctgtccccacccccacaaaaaataagtcagctattgcagtagcctaggctagcactaaggttatcgcagcaacagtggggggatttgagcaagactggagatagcagaaagccaacatgtgctcagtgccctcaaggtatttatactctagaagggggcacacgtgggaaaaatagattaaacgggggctcatcagagaaacactggactccactggactggccaagcagacaggagggaacccaccttcatgcacctgctcctttttttttttttttttttttggagatggagtcttactctgttgcccagggtggagtgcagtggcgtgatcccagctcactgcaaccttcgcctcccaggttcaagcaattctcctgcctcagcctcccgggtggctgggactacaggcattcgccaccacacctggctaattttttgtattttagtagagacagggtttcaccatgttggccaggctggtctcgagctcctgaactcaggcaatccaccctccttggcctcccaaagcgctaggattacaggcgtgagccaccgcgcccggccaccggctcctatttttatatcccactctggagctctggttcccgggcacttgctcttcacctctgactcagagcgtgaacctgacttcaccctcctacccaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtaaatgtcccctccctgaccctgcctagctcacttgccacctaggcaccccaagatggagtgctgaagccttcaccacctggactcctatggatttcaggtttcaggagcgtctgcctctgcagcactgggcctttctcctgggagtaagggctgctgggctccaccctccacttcccttctgtccacaggtcccaactaattatgcaggcggaggcagaagccgcgtctgtgcgggtgagttaagaggcagttccatgctggcttgtggagagggtgggggttgctgcttgatcggggatttcttgttcttaatgatttccgtcaatctcacaagcatccttaaccctcagatgcgtggggaagctgaggcctttgccataggggcccgagcccgagccgaggctgagcagatggccaagaaggcagaagccttccagctgtaccaagaggctgctcagctggacatgctgctagagaagctgccccaggtctggaggtcatgtgggcaccaagaaaggaggaaatagaaccagggactaaggggtggggtgtagtgaggggcttagggagaaacagcctagggggactctaaattaggggtgggaattattagtgaccaaagtgaggaaggatgatcagtggaacgaggaccttaaaacccagagtaagttgttttatgaggaatgtggtcagatcatgggcactgagtgggtgtctctctcctgccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaggtctcaggttggagctgaggagaattgctaggttcctgtgttgtgtgacacagtatgcctagcatttaaccagcatccaggcctgggagtcattgatgtttattaatcactttctgtgtgccagacacagtgctaagcttctacataaatgagttgttttaaatcaaactaccattagggtatataggattttacaaagtccagaaactcaacatccagcatgttcctactcattctgctagtgcagctggagtgaaatccaggtcgactgtctctgcaacctgtgcttgtggtcaccccactagtatagggaactagttgcagcctattgacagttaattaattctagggcatatcactgcttttctcagcgccccagttaattcacctgtagatcatggtagaagtcagcaaacaggctctggaaccactgttttgttgcgaatcctagctacaatgcctgctagctgtaatcttggacaagtaatcaacctctctatacctgtttcctcatcttaaaattgggttaataattagaaactaccctgttgaattgttgaggggctcgagcaaatatttgcagtgtttagaatagtgcctggtatatagtaagcattatgtgtatgttaaagaaatggggccaggtgcagtggcttacgcctgtaatcccagcactttgggaggctgaggcaggcagatcacctgaggttaggagttggagaccagcctggccaacatggtgaaacaccatctttactaaaaatacaaaaaaaaattagccaggcttggtggtgcatgcctgtaatctcagctactcgggaagctgaggcaggagaattgctggaacccaggagccgaaggttgcagtgagctgagatcacaccactgcactccagcctgggtgacagaataagactctatctcaaaaaaaaaaaaaaattccaggcgcggtagctcatgcctgtaatcccagcactttgggaggctgaggcgggcggatcacgaggtcaggagattgagaccatcctggctaacacagtgaaaccccgtctctactaaaaatacaaaacagccgggcgtggcggtgtgtgcctgtagtcccagctgctggggaggctgaggcaggagaatggtgtgaacctgggaggcagagcttgcagtgagccgagatagcaccactgcactccatcctaggcaacagagcaagactctgtctcaaaaaaaaaaagagaaagaaatgcatattcgggctgggtgctgtggctcacacttgtaatcccagaactttgggaggccagggtggacgatcagctgaggtcagaagtttgagatcaccctggccaacatggtgataccccatctctaccaaaaatacaaaaattagctgggtatggtggcgcatacctgtaatcccagctactcgggaggctgaggcaggagaatcacttgaactcaggaggcggaggctgcagtaagccaagatcgcaccactgcattctagcctgggtgatagagtgagattccgtctcaaaaaaaaaaagaaaaaaaaaaagcgtatgtaaataaaagcactggatcataccaatgaccttcaagctgggttccttggagcctcctggaggcctgcagtagaatattcagagctaaggagagtgtgcaaacaaggctctgccccctctcctctcttcagtgatttattgtatgtgggtcctgatgtctttgtttggggaaacaggtggtagggcaccagaaagaaccctggccgtgtgtgttctgcctatagcccattcgtctaaactggggcccgggagagtaggggcctcagcctcccgaatgttcccaagtgtcatctactgttgtctttttgccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaatgcttggcccggcacagtggctcatgcctgtaatcccagcactttgggaggccaaggcaggcagatcatctgaggtcaggagttcaagaccagcctggccaacatgacgaaaccttgtctctaccaaaaatacaaaaattagccaggcagggtgaaacatgccaagtagtagtcccagctacttgggaggctgaggcaggagaattacttgaacctgggaagcagaggttgcagtgagccaagatcgcaccactgcactctagcctaggtgacagagtgagactgtttcaaaa

SEQ ID NO: 7947 - DNA, 2305 bp, Homo sapiens
gtcttacagtggaaactatttggtttttcaggagaatttgctcatatatttctggcttaaattacggacattttccccttcaagtgtctgactagtcacaaacatctatgtaattttttttaaaaaacagaagaaaagatgccatatatcttacatactttactccttagaaatcccttcaggctctcactccttacttttgctttacttgcaagtttgacttcttagcttgtaatggaaggggtgtaggaggtctctgtgatgctagaagctggtgtccggatagagtaaggggagacacggaaattgtttaaaaacgtgtaaaggaactcataaagcattgccaaataggggccattttgcttagaggcaaaagcagctcctttcccaggggaatcaccaaggtatcagctgaggatcctttgaagcagtggaaagaatattgtaggagttgacagacgttgtttaattctgccacactggtggcccttgctgaaatctgtccacaaaagcattttgtttggctggcatagtgttgttttatttttaaatgtaattagttgctaatatttgaaaatgggagatattacataaaacctgaattttcggcttttcttgaagaataggaaggtcttgtcatttagggcctgtattcaagcgaggcactaaactgctggagttgagtaaatggctcccttctttagacaggtcatgtatctccaccttaccacagcccccacttgtcctttttgcatatttacataaaacagcttttgactttaagttagagatacttttgcagtagaagtgataggaggaggtggaagtgtacataatctagctgatatgtaaggttcttccaattcttatttaaatagccactaacaatgattctaaacaagattgaaaatacagtatgtttcatatctggatatgctgttggtagctcaaaacctacgtttttacttgcctgctggacatttcatgtggatatctccatatcttgatttcttcctttgatttgttattgaattattcgtagatacatccgacttgtgttctcttactcttacctgaggctctttggatatgctagtcccttcatccttctttgcctggtccaacactactcatccttctagactcactcaacctgaactgtcaaatcatcagggctgagttggatattactcctttgttttctttttgcaccctgtcctagctctgtgaattttaagttcctatttacttgcctataactagattggatgctccttgagaacagggatgatatcttacccacattttattccccatacttatagtgcttgacatctggtaggcactcaatttgaataaataggtgaggggatatacaaactaaaactatcacttctctcctccacctgtcatttcagtttttcttctcgattaatggctttattgttacatttgactggtttaaaatgttggggtcatctctggcttctttgtattactgtgcacactcaggtagagcctgtatgttcatttccctttgacatgttcttctagtctattcctcctccgacttctctaattgagtctcctttgtcagactactgtgataacttcttaatggggttcactggcccccacctcaccttctgtttttcaaatctcaccagttataggacacttctgaacatgtcacactcagaattgttgatgtcttttgagttcaacctatgctaaagtgcactttttagcatagaattaacagcaattgatatttggcttcatcctgcttttctgactggattgtctaccataaccttttatctcctttttgctttagccagtccggactgctacttttcctgaatatggctggaatgtcccactgtatctgtttcaccgcatctatgagtctaagtcctatcttatctattgcacaaatatatcatgcctactatagaccaggtattgcccttgacactcaggctaaaaaggtaaatgacagggccgggcgcagtggctcacgcctgtaatccagcactttgggagagcaaggtgggcggatcacgaggtcaggaattcaagaccagcctggccaacgtggtgaaaccccatctctactaaaaaatacaaaaattagcctggcgtggtggtgggcacctgtaatcccagctactcgggaggctgaggcaggagaatagcttgaaaccggaagacggaggttgcagtggggcgagattgcaccactgcactccaacctgggcaacaagagcaaaactctgtctcaaaaaaaaaaaaaaaaagtaaa

SEQ ID NO: 7948 - DNA, 903 bp, Homo sapiens
ttgagacttgagatgtggtgacacttggatcataaacagagggcttcgattccaggatgggggttcctccagggggaaatgaaaaggagctctcactctgttcttacgtatgcacaatgctctgaattgtggcacatgggtttgcagaaggataatggagataattgaaagtaatgaaaatgaaaccaaatctccttccccaaaaacttaaaagaactgattcaaaagtaccccaagaatatgcaaagaaaagggaatcacatcaacagatgattggataaagaacatgtggtatgtatacataatggaatactattcagccactaaaaagaatgaaaccatgtcttttgcagcaacctggatggaactggaggctgttatcttaagtgaaataacttagaagtagaaagtcgaatacttcatgttctcactcataaatgggagctacataaagtgtacccatgaacatagagtgtggaacaaacattggagactcagaagggtgggaggagggtaagggatgagaaagtacctgatgggtacagtgtacacttttctggtgttggttgcaggaaaagcctggacttcaccacttcgcaatatatccgtgtaacaaaactgcacttgtacgccttatatttatacaaatttaattttttaaaagggaagagagaatcatattaatttctcaccactttttaagtaagcaaacagcagtatttcccagaggcaagaggttcagcaagaagtcaggaaatgtttttgtagataagcatctatcattctgatgggccatgactagtgtgttcacttgtaattcctttgcctttaaaaaaagagaatgatatcaaaaaataagtgccttatactgtgaaaaacgataaaaggacttcctgattctaa

SEQ ID NO: 7949 - DNA, 903 bp, Homo sapiens; identical to SEQ ID NO: 7948

SEQ ID NO: 7950 - DNA, 248 bp, Homo sapiens
ttttatcctattttgtgattttcagtattaagagattattgatcacttgcagagttacaaggcaagcactagtttaaatctgaattagactagggccattgaccttatatacctgtaaaagacactacggtgtatacaactgtagaaacaatatacacatagtagtttaatattacagtctgtattccaatgcagaatcttttgagaaaaggttgccaaaacatcatttgcatttacttgaacccttt

SEQ ID NO: 7951 - DNA, 2064 bp, Homo sapiens
ttctctgcaggtgtcaaagtcgtgttctcaggccactaccacaggaatgccgggggtacctaccagaacctcgacatggtggtgtcatctgccattggatgccagctgggcagagacccccacgggctccgagtcgtggtggtcaccgccgagaaaattgttcaccgatactacagtctagatgagctgagtgagaaaggaatagaagacgatctcatggatttgatcaagaaaaaatgacgctccttcccgttcccgttcacttttcacttgcactatttttttattttgccagaaacagcagctgcacacaacctcttgctgaaatataaaaatagcccaggcaggtttgtgaatttatgtccttttgcataaatcagagagctggggccctgtcctgaattatattcaaaatagaactgcatttcctttaaaatggagcgaatgatcctggaaatcagtttttaaaatattagactatctctgcatggatgtttgaataaattctcctaatgctgtgtttctcaactccacttttgaattggatgtattcgtggttagcatatggtcaaagtctgcctatagacctcaattccaatctgacagccaagtatgatctttgataattccttaaacaaactacacctgattgtattaaattgtggtcacgattcccaaaacgctaggcaaaacaaagttcatctcctttcctttccagcggaacgaacagctgtctcccttgttgtgagagccatgcagacttattttgacaaggagccaagtaggcaccatttactgttcaattctgagacttctgatgataggaacagaatgcagttgatacagctcggagcttaaatttgccttcctgggtgcctagaaaagtcacctttgcacataaattggccatttctgaaaatctcctccaagagactgaaaccaaagctctaaaacgccgcttcttcagtctctggggagcacgttgagttggttcacatccacattctggctgtgtagccactccacagatgggtggtctcttgggatcagaatgcccctccactcatgagactcttcattttgtccactttgacaggaaaagtgggaatgtatgcagagctctcaaaagaaacaaaaaaggccaaaacggtgccttcagccacatcctctgaattggccctgacttggactaaatgcactaatgcaaaatcccttgacaaaagcgcataggttatttcaaaccagcattgttttttatgtaacctgttttaccgcatcttctcagcagcttctgaccactgctcaattttctcctttacagccattgttctggtggacaaataacctaggtactccaaatcctggcaggaaaaatatacagcattatgaaacagcactcagtaatcctaaaatgatttccaaagctggttacacatgacctgcaaagtctattaaattaaaagactttctcattacagagtttagtcaacgtagcaaaaccatgggaaattaaatggaaagataattaaatatgtaaattcataaggaacaaaagacgagaagttaattatacaataggctggtgacaccagagttcattgttatgtgccacaagaaaattaaattttttaaaaaactagaacgctcttcttttagtgttttgctgaaatcctgttttgtatttgtttctttacaacaggtgtaggtataggaggtcaagaaaaggagttcggtaaagggcatagctaataacaaccacacattgggccaggcacagtggcttacgcctgtaatcccagcactttgggaggctgagacgggcagatcacctgagatcaggagtttgagaacagcctggccaacatggtgaaactccatctctactaaaaatacaaaaattagccaggcatgctggtgcacacctgtaatcccagctactcgggaggctgaggcaggagatcgctggaactcaggaggcagaggttgcagtgagccaagatcatgccactgcactccagcctgggcaacagagcaagactctgtctcaaaaaaaaaaaaaaaaaa

SEQ ID NO: 7952 - DNA, 2062 bp, Homo sapiens
ttctctgcaggtgtcagagtcgtgttctcaggccactaccacaggaatgccgggggtacctaccagaacctcgacatggtggtgtcatctgccattggatgccagctgggcagagacccccacgggctccgagtcgtggtggtcaccgccgagaaaattgttcaccgatactacagtctagatgagctgagtgagaaaggaatagaagacgatctcatggatttgatcaagaaaaaatgacgctccttcccgttcccgttcacttttcacttgcactatttttttattttgccagaaacagcagctgcacacaacctcttgctgaaatataaaaatagcccaggcaggtttgtgaatttatgtccttttgcataaatcagagagctggggccctgtcctgaattatattcaaaatagaactgcatttcctttaaaatggagcgaatgatcctggaaatcagtttttaaaatattagactatctctgcatggatgtttgaataaattctcctaatgctgtgtttctcaactccacttttgaattggattgtattctggttagcatatggtcaaagtctgcctatcgacctcaattccaatctgacagccaagtatgatctttgataattccttaaacaaactacacctgattgtattaaattgtggtcacgattcccaaaacgctaggcaaaacaaagttcatctcctttcctttccagcggaacgaacagctgtctgccttgttgtgagagccatgcagacttattttgacaaggagccaagtaggcaccatttactgttcaattctgagacttctgatgataggaacagaatgcagttgatacagctcggagcttaaatttgccttcctgggtgcctagaaaagtcacctttgcacataaattggccatttctgaaaatctcctccaagagactgaaaccaaagctctaaaacgccgcttcttcagtctctggggagcacgttgagttggttcacatccacattctggctgtgtagccactccacagatgggtggtctcttgggatcagaatgcccctccactcatgagactcttcattttgtccactttgacaggaaaagtgggaatgtatgcagagctctcaaaagaaacaaaaaaggccaaaacggtgccttcagccacatcctctgaattggccctgacttggactaaatgcactaatgcaaaatcccttgacaaaagcgcataggttatttcaaaccagcattgttttttatgtaacctgttttaccgcatcttctcagcagcttctgaccactgctcaattttctcctttacagccattgttctggtggacaaataacctaggtactccaaatcctggcaggaaaaatatacagcattatgaaacagcactcagtaatcctaaaatgatttccaaagctggttacacatgacctgcaaagtctattaaattaaaagactttctcattacagagtttagtcaacgtagcaaaaccatgggaaattaaatggaaagataattaaatatgtaaattcataaggaacaaaagacgagaagttaattatacaataggctggtgacaccagagttcattgttatgtgccacaagaaaattaaattttttaaaaaactagaacgctcttcttttagtgttttgctgaaatcctgttttgtatttgtttctttacaacaggtgtaggtataggaggtcaagaaaaggagttcggtaaagggcatagctaataacaaccacacattgggccaggcgcagtggcttacgcctgtaatcccagcactttgggaggctgagacgggcagatcacctgagatcaggagtttgagaacagcctggccaacatggtgaaactccatctctactaaaaatacaaaaattagccaggcatgctggtgcacacctgtaatcccagctactcgggaggctgaggcaggagatcgctggaactcaggaggcagaggttgcagtgagccaagatcatgccactgcactccagcctgggcaacagagcaagactctgtctcaaaaaaaaaaaaaaaa

SEQ ID NO: 7953 - DNA, 248 bp, Homo sapiens
ttttatcctattttgtgactttcagtattaagagattattgatcacttgcagagttacaaggcaagcactagtttaaatctgaattagactagggccattgaccttatatacctgtaaaagacactacggtgtatacaactgtagaaacaatatacacatagtagtttaatattacagtctgtattccaatgcagaatcttttgagaaaaggttgccaaaacatcatttgcatttacttgaacccttt

SEQ ID NO: 7954 - DNA, 2224 bp, Homo sapiens
gctaaagtggtattgattttaaacttgactcaccaacttcacaggggttaatacagatgtgaaaaatcttgagttataagcttcctgcatgcatgagacttgtttttattttgctgctctagtgttattggttttattacgcaaggagaaagaaggcagggaatttatggtcaggagattcctggtcaggaggttcatagtcagaagatctagactgggtcacaagaaatgacagaatttaagcatttgagccagggaataagaatgtgtgtgctctgcctgtgttttccacattcattttactcagcattgcactgtcatcttgcttaagaacaattcagtaggtcagaaacattggattccaaagctgttaatggtttattttccatttcttgccttcgcaatatctgaaataaagttatatcccagataactgatgggaaaacagggttcaaagctataggatatatgactcatttaacataaaattattcaaattaatgaattagcaaatcctcttgtgcttataataagcaaatataagttttatcttgtctattataaaagaaatgtctaaacattaagtgcaaaaccaaactaggcagcaggagaaggaaattagttatgttgtttttataataaggattgtaaaaccaatatcttagtgaaattctcagaaagcttgatttaaaaatttatcaaaattcgggagtttttttgtttcatttggtctatttgtcagtggtttgaggtcttagttctgcagcgacatcttatggagttggttagtttgcacaaccatttaataatgtctgccagaactgatcattgttctaacagatttgatgcaaataggatccctgcctgcgctttgaatgtggaagtaattaaacggatgctatgaggacttttatttttttctctgttggtgcttatctaaaatttccttatcatggcaactgtataatttttaagacactccaaaatatgtactgaggtctgaaattctcactacatattccaagttaggataggaggggagaaggaagctgttgaatagtgaaataagacagcagtaaaagatcacagtacagctggtgtttgttggcaagagtttccacttaaaaatttgcagcagtgcaagtacctcaattattattggcgcttttcactgttcgtgatcaccaggagtgaaaaaaaaagaaaagaaaagaaaagaaaattgaattctttgaagctcagagaagtaaactgaaaaatttttgagtaccgaaatttacccatttcttcttctgattgtgttcttttgaacagaacacattgcattaaactctagaaagaaaaaaagtgactgttttcatatttttatgattggagtcacattcttaagatctataatgtagattacagcaccattttgttatctgctagaagaaatatagctaatcatctctaaattagtaatgttacattttattttgcttcctatttactagtgtggcacattttaatgacagaaaatttccttgaaggcaagagctttacacacagtaggatttcactcagtttttgcatatattgaccattgcagaatacaaacaactgttaagtaatttctcccaaagacaggccataataaagaggaaaaatataaactatatgacactaaaaatcctgttaatcttgatcaatcagtgaatgaaacactaattgtgccaaacaacacattctacctgaacaaaaggaggtaattgcagtatgtttctatgaatacatagcagctgttctatgccattattatcactggtgagtaaagatcatggtgaatcattgtctaatatcttgtgatcttgctcacatataaaaattgccaggggacttcattaattatgattgcatcttaagggctctggacattttcatgagtgccacaggacacctagaaaataattgcatcttttgagaaccatgtgccagtgacaaggtaaagctcaggttgtatattccagagattctctggcaaatgagcattgcctgccttaatattctaagcccatcagttagaaaaggctgaccctatgacttaaaattgcatgctgcatgattagaaagatagataacaatatattttaaagaattatttgtacctcacacatgcccaacaagattgaatgattttaattgaattgaatattggtaaatttgctagaaacagaaaaataag

SEQ ID NO: 7955 - DNA, 2224 bp, Homo sapiens; identical to SEQ ID NO: 7954

SEQ ID NO: 7956 - DNA, 333 bp, Homo sapiens
ttactatatcttttaagtagaaggcttttaaagtgtgtcatggagacagaagcccatacttacctcctgagcatctatggaaaattaagagttggcttttattataggtctctcaagtgagctaagcataaccaagcataggctcctacttaaggtattacatttttagagagtactgaaaaggtaggcgtccttcaaactacctgggatgaaggaaaagctttggagtcccaaggaatagcagagggagaataaggatggcacctgaatgtggtgtaggggttccagggaccaacttctcagggtcttgagaagaccactgctctgcatgat

SEQ ID NO: 7957 - DNA, 333 bp, Homo sapiens; identical to SEQ ID NO: 7956

SEQ ID NO: 7958 - DNA, 26439 bp, Homo sapiens
gggactacaggtgcgtgccaccacacccagctaatttttgtatttttggtagagacagggtttcaccacgttgtccatggccaggatggtcttgatcttgaccttgtgatccgcccgcctcggcctcccaaagtgctgggattgcaggcgtgagccaccgtgcccggcctgtcctctgtggttttctgggcttatgttaaaattataactcaatcaccagtctttataaatttgcttttttatatttaaaccaaacctaatgctaattgtgatatgttatttattctcacctgatttgaatcattggattcaattaaatgagtttaattatcattaaataattctaagagaaataatgtctattcggatggtgggaattttctttctacatgcagccccattctgaatgaatgaaatcaaatcacgtgaagatcagggtcctagagtaacttaatattttgtacattggttatttgactcctcatttttatattacatgttatatcaagggagggggcataaaagaaatacaaaaattgcagaggtatctggaatgtacctatttgttaattctatttgtcatttcttttgtttcatcttttgagtaataagctgcttggaaaagtttctgttctttagctgattttttagctataaaaatgtatttgaaaagctcataaatttcaggattgaaaagataattgaaagttttaaaaaaacctaattcattgaagtaataaccaaataattttcaatcttgattcaactgtgattcaaatcttacaccatttgcccacttctatgaattttatgtataaaattttttaagagtcagagttttttttcttgattaattggatgtatttcacagaatttccaactgctcacgttagttttcttccttttagagttgatctctctaatgtattagatcttcatgcctttgatagtctctctggaataaggtatgttttgtataatttggttacttttattgttatgtaccttttttccccatagttaacaggaatgatttgcacaattgcatccatgatttaagcttcctgccattcctttggcatacaagaccatacttaatgaggtatattcttggaagttttactaactggttgtttggaaatcatattgcattttcctgtagaaattatagtgtaaatgatagttaactttagaggctaatcgttaacacttctacaccaaacactatatctagtactctttctatgagaaaatgcatgaaatacatagaaaattttagcttagcgttttcacacaaataactctcttcactttatttttttattttttattttttcttgagtttttttttaatttatttatttattattattataccttaagttttagggtacatgtgcacaatgtgcaggttagttacatatgtatacatgtgccatgctggtgcgctgcacccactgactcgtcatctagcattagttatatctcccaatgctatccctcccccctccccccaacccacaacagtccccagaatgtgatgttccccttcctgtgtccatgtgttctcattgttcaattcccacctatgagtgagaatatgcggtgtttggttttttgttcttgcgatagtttatggagaatgatgatttccaatttcatccatgtccctacaaaggacatgaacccatccttttttatggctgcatagtattccatggtgtatatgtgccacattttcttaatccagtctatcattgttggacatttgggttggttccaagtctttgctattgtgaataatgccgcaataaacatatgtgtgcatatgtctttatagcagcatgatttatagtcctttagggtatatacccagtaatgggatggctgggtcaaatggtatttctagttgtagatccctgaggaatcgccacactgacttccacaatggttgaactagtttacagttccgccaacagtgtaaaagtgttcctatttctccacatcctctccagcacctgttgtttcctgacttcttaatgattgccattctaactggtgtgagatagtatctcattgtggttttgatttgcatttctctgatggccagtgatggtgagcattttttcatgtgttctttggctgcataaatgtcttcttttgagaagtgtctgttcatgtccttcacccactttttgatggggttgtttgttttttttcttgtaaatttgtttgagttcattgtagattctggatattagccctttgtcagatgagtaggttgcgaaaattttctcccattttgtaggttgcctgttcactctgatggtagtttcttttgctgtgcagaagctgtttagtttaattagatcccatctgtcaattttggcttttgttgccattgcttttggtgttttagacatgaagtccttgcccatgcctatgtcctgaatggtaatgcctaggtcttcttctagggtttttatggttttaggttgaacgtttaagtctttaatccatgttgaattgatttttgtataaggtgtaaggaagggatccggtttcagctttctacatatggctagccagttttcccagcaccatttattaaatagggaatcctttccccactgcttgtttttctcaggtttgtcaaagatcagatagttgtagatatgcggcgttatttctgagggctctgttctgttccatgaatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcactggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagtcagattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagatgatggggttttctagatatataatcatgtcatctgcaaacagggacaatttgacttcctcttttcctaattgaataccctttatttccttctcctgcctaattgccctggccagaacttccaacactatgttgaataggagtggtgagagagggcatccctgtcttgtgcccattttcaaagggaatgcttccagtttttgcccattcagtatgatattggctgtgggtttgtcatagatagctcttattattttgaaatacgtcccatcaatacctaatttattgagagtttttagcatgatgggttgttgaattttgtcaaaggccttttctgcatctattgagataatcatgtggtttttgtctttggttctgtttatatgctggattacatgtattgatttgcatatattgaaccagccttgcgtcccagggatgaagcccacttgatcatggtggataagctttttgatgtgctgctggattcggtttgccagtattttactgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatcgtaccagttcctccttgtacctctggtagaattcggctgtgaatctatctggtcctggactctttttggttggtaagctattgattattgccacaatttcagatcctgttattggtctattcagagattcaacttcttccttgtttagtctttggagggtgtatgtgtcaaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaatttttttgaagggttttttgtgtctctatttccttcagttctgctctgattttagttatttcttgccttctgctagcttttgaatgtgtttgctcttgcttttctagttcttttaattgtgatgttaggttgtcaattttggatctttcctgctttctgttgtgggcatttagtgctataaatttccctctatacactgctttgaatgcgtcccagagattctggtatgttgtgtctttgttctcgttggtttcaaagaacatctttatttctgccttcattttgttatgtacccagtagtcattcaggagcaggttgttcggtttccatgtagttgagtggttttgagtgagattcttaatcctgagttctagtttgattgtactgtggtctgagagatagtttgttataatttctgttcttttacatttgctgaggagagctttacttccaagtatgtggtcaattttggaataggtgtggtgtggtgctgaaaagaatgtatattctgttgatttggggtggagagttctgtagatgtctattaggtctgcttggtgcagagctgagttcaattcctgggtatccttgttgactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggttgaaagtctgttttatcagagactaggattgcaacccctgccttgttttgttttccatttgcttagtagattttcctccatccctttattttgagcctatgtgtgtctctgcacgtgagatgggtttcctgaatacagcacactgatgggtcttgactctttatccaatttgccagtctgtgtcttttaattggagcatttagtccatttacatttaaagttaatatcgttacgtgtgaatttgatcctgtcattatgatgttagctggttattttgctcgttagttgatgcagtttcttcctagcttggatggtctttacattttggcatgattctgcagtggctggtaccggttgttcctttccacgtttagtgcttccttcaggagctcttttagggcaggcctggtggtgacaaaatctctcagcatttgcttgtctgtaaagtattttatttctccttcacttatgaagcttagtttggctggatatgaaattctgggtcgaaaattcttttctttaagaatgttgaatattggcccccactctcttctggcttgtagagtttctgccaagagatccgctgttagtctgatgggcttccctttgagggtaacccgacctttctctctggctgcccttaacattttttccttcatttcaactttggtgaatctgacaattatgtgtcttggaattgctcttctcgaggagaatctttgtggcattctctgtatttcctgaatctgaacgttggcctgccttgctagattggggaagttctcctggataatatcctgcagagtgttttccaacttggttccattctccccgtcactttcaggtacaccaatcagacatagatttggtcttttcacatagtcccatatttcttggaggctttgtttgtttctttttattcttttttctctaaacttcccttcttgcttcatttcattcatttcatatttcatcgctgataccctttcttccagttgatcgcatcggctcctgaggcttctgcattcttcacgtagttcttgagccttggttttcagctccatcagctcctttaagcacttctctgtattggttattctagttatacattcttctaaatttttttcaaagttttcaacttctttgcctttggtttgaatgtcctcccatagctcggagtagtttgatcgtctgaagccttcttctctcagctcgtcaaagtcattctccctccagctttgttccgttgctggtgaggagctgcgttccttcggaggaggagaggcgctgcgttcctttggaggaggagaggcgctctgctttttagagtttccagtttttctgctctgttttttccccatctttgtggtttttatctacttttggtctttgatgatggtgatgtacagatcggtttttggtgtggatgtcctttctgtttgttagttttccttctaacagacaggaccttcagctgcaggtctgttggagtacccggccgtgtgaggtgtcagtctgcctctgctagggagtgcctcccagttaggctgctcgggggtcaggggtcagggtcccacttgaggaggcagtctgccagttctcagatctccagctgcgtgctgggggaaccactgctcttttcaaagctgtcagacagggacacttaagtctgcagaggttactgctgtctttttgtgtgtctgtgccctgcccccagaggtggagcctacagaggcaggcaggcttccttgagctgtggtgggctccacccagttggagcttcctggctgctttgtttacctaagcaagcctgggcaatggcgggcgcccctcccccagcctcgctgccgccttgtagtttgatctcagactgctgtgctagcaatcagcgagactccgtgggcgtgggaccctccgagccaggtgcgggatataatctcgtggtgcgcctttttttaagcccgtcggaaaagcgcagtattcgggtgggagtgacccgatcttccaggtgccgtctgtcacccctttctttgactaggaaagggaactccctgaccccctgcgcttcccaagtgaggcaatgcctcgccctgcttcggctcgcggatggtgcacgcacccactgacctgcgcccactgtctggcactccctagtgagatgaacccggtacctcagatggaaatggagaaatcgcctgtcttctgcgtctctcacgctgggagctgtagaccggagctgttcctatttggccatcttggctcctctctcctctcttcactttaataatggattagttttctgccttctcctgtggggaatctttttggtaagggagggaagaaagattagttattcttgtgcatcagtatctttttctttttttattgtagtaagaacatctaacatgagatctaccctcttaacaattttttaagtgtacaatacagtattgctaactataggcatgaggatgtgcagcagatctctggaacgtttcactctttataactgaagctttataccccttgaatagcagcttcccatttccctgtcttcatagcccctggcatccaccattctacactctttctgtggggttgactattttaattacctgacgcaagtggaatcatgcattatttgtctttctgtgactggtttatttcacgtagcataaagtcaccaaggttcatccatgtttttgcatatggcaagttttcctttttaagtctgaataatattccattttctacatataccacatttactttatccctttttctgttagtggacatttaacttgttctcacagcttggctattgcaaataatgctgcaatgaatatctcataagtctcgtatatgtccatagaagatcatgaaaatggacatgtctctgggtattttgaattggtgggacaattttgcttaagggtaggcatagtgggtggctctacatttgagagttctaattcccattcctatatatatttcttttctttttatttatttatttttttgagatggggctctctgtcactcaggctggagtgcagtggcacaaacatggcttactgcagcctcaacctcctgggctcaagtgatcctcccatctcagcctcccaagaagctggggacacaggcatgtgtcaccatgcctgactaatttttttttttaattttctgtaagcatggggtcttgctatgttgcctaggctggtctcaaactcctgggctcaagtgatcctcatgcctcagcctcccaaagtgctgggattacatgtgtaggccaccacacccagccttatatatatatttctaattttgccttagccatgcccttaaaaactaattctactttcaactagtttttttttttccaccttcagtctgtagtattgttcacattttgaaaacaatacctacagtaacctgtgaggtaggacatgatagtgttttattggaccccttttactttatgaattggaaaaattaaatttgcatgtagtttgtaaaaaaaaaataaagaaagaaagaaaaaagaaattgattgagattatttcagcagccagaagtgtgggacaggcagggcagttattcctccttctcagtttggaaactgaagctcagagagtaaacttgtcagtgatacagttattcaagaagttgtcttcagttgagagatacgtttttcacctgtagcttctggtattggaacagtacctttttagactaaacaaattacggttaaaattataagggtattttcggagtacctggaaaaaatcagcattttgcttttctagttccatttagtaggaagacaggaaagtttggtatacctgaattacatgtgagttatttctatttttctaaaaattcttataaattgtgtaaggtaaaaatgactacttcttgttttatggtaaatatagttatatcctttcaagccactgctgtacaaagttgtgaaatctccctgaggctttttccctcatgtcagcttcaggtatccagtatcacttatgcttgataatgattgtatgaaaatcattcagaattatactatgttttttcatataaagcttttgttttactaattttgaaatgactgttcctccattaagcgaatacagccctaagcataaatttggtttgttcatttaaaaatggtctttttttcccatcttagttctggctttactagggagatagattggctgaggttgtcacctaattctgggaggttaagaccctttgtcttttgctacccatttctgaaataaccagaagtctagcccatcctaacttttctctcgatgatccttttcttctttttacttcaaggttccagcccttcatttgactatcagtgctgtttcactagttagccatgatccctttcatccaccgtgtctggattagaactgtatttttaatttgatgctgtgggcagttttgatagttacagatcctgtgatacatttaaatgtgtttacaaggggaacaaatgaaacaatgctgcatgaaatttgcctttctttttttttttttttccccttggagacagggtctgggtctattgcccaggctagagtgcagtggtgcgatgtcagctccctatagcctctgtgtcctgggcttaagccgtcttcccacctcagactcatgagtagctgggactataggcacacactaccatgcctggctaattttttattttggtagaagatgaggttttgccatgttgccgaagctgatcttaaactcctgggcttaagtgatctgcccacctcagcctcccaaagtaatgggattataggcgtgagccaccacacttggccttttcttttttttatatttatttaattattttattttattgagacagagtctcactctgacacctgggctggaatgcagtggctatcatggctctctgcagtcgtgaactcctggactcaagtgatcctcccatctcagcctcctgagtagctgggactacaggcttgcacccatgcctggctaatttttttattgttacttttttgtagtgacaggctctcgctacgttgctcaggctcgtcttgaactcctggcctcaagtgattctcctacttggcctctcaaagtgctgggattataagcctgagccactgaacccagcaaaatttgcctttcttaaactaatttatctctgttgggtccaagagcttacaagttggttgtcatttaatatgttaaacactagaatattttttagttgaaattttattttttccctttacatgttgtatcctttagtgctttatttcactaataagaattatagtatgcaatcatttcccacctctatattcagtatatcaatttttgtttttcctttctacttctgtcttttgctataatttgctgtaatacaggtactttcatcaaggcatccagttctttatatcattctatatttttacttgggagaaatagaaatgttgctaattccatcttactgacaatacctaaattattgtttgttatagaacataatgatttaaatatacaaaacactaaactgtttgagattttttacattttatgcgtgcagaatttacattttatgtgtgcagagacaaaaattgttataagattacaagttaatgtgcaagatgatttccgattcatgagtttcaggttttgatagcatatccttatccactagattagtcttttaaaaatgtgtatgatagggaaaaaatcgaggccatgaaattctgagacttatgggaactaaacttaaatgttcgttgttagattttttttttttttttttttgctgcgtatgaagttctaggcagtcattgtccaacaacattaaatactgaacatatgggaaaagcatatgatttttcgaaatgtttttctaaagtaatctcattctacatacacttaagagcagttataatgctttagtgacacttgaagtagctatttaatgtgatctcaccactatagggaaggccgttgcatgacttttttgtgtgtgcttaactgctaaacaggagaatcttttcctgagcaaccagctgggaaggatttaatttgacattctccctactaggaccccccaaagagactcattccctccaatagttcctacaagttctttctctttcctaaacttgctgttactaatttacccctcactcttcttcaaggcaaagcatctgcaaggttttcagtcctttccccctcccgtcctgtccccatcagtgttgaaatgtatgctacagttattatggttgtaatttgttatgccatgttgatcttcttgtgcttttcatatcagaacaatgcatttttaacattctgactttctttttctctcaattggtaactgactatatagaaaatttatatttatggatactatttcttttttaataagttcaagggaaaacattgataaaggaaaatttatcctttcaactttctttaggtgccagcattattttcatattaggaagcaggagaaagttaaggaactctgagcaatactagaatggttatatatatttaagtttgtattaaacctgttggaatggtaaagaaatttactgacatatttaaccatacaaaatagtgttgctaaaagactagtttttctctttattctgtgcatatgtatatatatgaatgtgtgggttttttttaagaaattttaaaaaaacttaatctgccagcttttctctattggaatttgcgaacaacttgtaaaattggaattacagaatattagaatagtcagttatggaaagtcacttcattatccttgtgtcactaaataacgtataaagttaaatcagaagtgtattcatctctgaatttctaatcagttgtttttagtttgcagaaaaaacttcagcatgtgccaggaacacaacctcaccttgatcaggtaaagaaaaaaaatctaaatccaaaattcctaatcaatgtttttaaaggacctctttaactagataggctatgtttaggactattttattataaactttttctaaaatggtatttttgaactgtattgataatttttggaatcttaaatgcttttgacatagtctaattctatttcttaacacataataggaattcatcaaaccagatttgttttagaatctgaggaaatcatgctttctagcctttccattctgtagattgcttagcatattggttagttctgatagggattactccttaaaagcagcctgggggttctataggcagtctgtttttaagtatgttgaattgtttaaggaaaggtctgatataagcatggcttatttaaataaaaattgacttggagtttcaccttcaggtagcactataaatttgaactccttaagatgtttttcatgctctaaaattctaatccctaaggtaaatatctaagatgctaggaacaatttaaatataattttactgtacctgcgtttctgttaagcagatcatagatcgtagagctttaggataacttctttgttcctcttaaaaccctgaggggtggagtgggggatgtgtaagtgagcagtgtgcctaatcttccttcctctctctcaagtgatcactcagtttttgaattgctattggttgtaatagggccgagataacagctacttgcatttgtattcattttggttcacatttatgagcaggtttgccactatgtttgtggcacctttccctgtgaaacttttgttaataggatattcctcttcacttatctttaaaatgaataaatgagagaaatacaagtccttggagatagaatttatggtaaaaaaacaaaaaacccagttcttcatgatagtcggtatctgtcatatagctgaacatgaagcacatttgagcttctgggtaaagaacgtgatgccaagaatcatagggatgaaaagatgaagcaaacgcagcgctcactttccatgagcgtttggggcggccagtgtctccatccatagagcctcgaatgaacctctattgtggcggttacgatgccttgcagtttgcttgaaatgcttttgcctggcaagagtctatacattccttacgtataaaatctgtattgcttagtacagggcttggtgggtactcagtgagtatttgttacaagaatgaaaagctgcgtttctcaaatggggcataaatcagaatcgcatgtggagcctttttaaaaaaaattcgataactcagtagttctcaccctcagtctccaggattgggacttgggtatgtgtatattaatgtatatttttaacattttattatggaagatttcaaagatataaaagaataaacagaatagtaaagtgaaccccttgtatgcatcacccagtttaaatggcatcaacatttagctgattttatttcacctatcctcccaacatttcttttgcctggagtatttaaaaaaaacaaatgtattttaataggaaatttcaaacgtgcgtaagagtagaatggcataatgagcctgtatgtacctattgcccttggtgtagtgtattaaagcaaattccagacactatgtcactttactactaaatagggcatatctatatttttgtagcctctgtaggagattctgatgcactgtcctgctttagataatataaacataggggaaaatagtatcacagccaaagggctatgggattcagaggcatgaacaatttcatttggtttagtggatctggggtgtaagggaggaaatttatcttttcctcgcctatcactagattcatggctgaggtctctctaacagaagaccaactatcaagagaaatttcaacatagaaatttatttagtaagttttacttgacacaggagccttcataaaacatacctgtgtatgttttctgttagttatgatatggaagaggatagtaatggagaagcataattagataaaacagtatgatctaataataaactgggaagaacttagcaaggcctgtttgctcagatttttctctgtgacccttcatattcagacttaaggatgttcttttcctctgtgtatagagagggcacctcttaaatgagggtcttatgacctgcatcagcggaaggtcagaaaatctttcctaggttttatgacctgcttcaggagagaaggtgagagtgaccttcctgattctgccattttctcaaatattgagttgccatattttgggatagcatgtcctgaaccccatcaaatgcttcatgaggatagttttttgtttgtttgttttggttttggtttatttatttgcatacagtaaagcatgcaaatgtgtaattttagtgtacaattcgatgtttgggttttgtttttgtttttgtttttttggttttttttgagacggagtctcgctccggctggagtctcacccaggctggagtgcagtggtgtgaccttggctcactgcaacttcctccttctagattcaagtgattctcatgcctcagcctcctgagtagctgggattacaggcatgtaccaccatgcctagctaatttttgtattttttttttttttttagtagagatggggtttcaccatgttggccaagctggtctcaaactcctgacttcacctgcttcggcctcccaaagtgctgggattacaggcatgagccactgtgcccggcctcaatgtatttttacatatatttgtacctatatatctgtctatatgcacattcaaacacatatccttctaactcccactcaggtcaagatacaaaagatatccaaaattgtaaagagttcctttttgccccttcctagtcaaagaaggggtaagtgctattctgacttacttaacaaaaaataaccttgaactggtaggatttttttgacggtaggattttttttgaccggaagaagtaaggaaaagagcaatacggatgtttaaaaatgagaaggtgagaatcttatagatgagtaggtctctggtacagaagtcttagtggagagttggtactggaatcctggtctaaggtattaggttttaatttgctaaacaaagagaactcaagcagtgctgtctaggagtgttatgtaagctagattggactttagagtcaggagaccatgcgggaagatactgtgtgataagggcctgaaacatgttggttacagtgagactagaaatgggataaatccagagctgtttcaccagtagacttgcctgaatatcctgtctgactgagtatggatcagaaagaaaagaaggggtgatgggaaacgagcctagattgactagagaaacctagaaatagaaaaatcgggaaggcaaagtgatttgaatgataatgccatatattcagttgtccctggtggccagatattatagtatagatattatacaggcaaagaagaacagagggatagagtgtgaaggtacagattttgagtttaagcacattagggggcttagtgttctggatgaagaaaacctataaaagttattgtatgttaggtattgtttgcaaaaagtagaaaatggagaaataacccagtgggttaaagaagaaacagactaaataaacaaacctgagtaagttgttcctaaattttattttagagacaattcctcattttgctttagttttctcaattattgcctcacttttctgtttctttctgtgtcagcatacatggaagaaggagttaattttagattcaaaacaaaaactggaaaaaaaaagtctgaaatgggtaatacctaggacctagtatatatgtgttattaaggctctatccctgaatttttaatgcagttatctatttttcatggattctttgtttattccccataaggaacacctgggtttggagagtgggaaggtagatgagaaaacccaagtgacaaataatgtttagtttattattagaaccaactatgagttgtgacccttatcttctgcactgggaattacagatttttttcagggtttttctaacgtgaaaagagtttattggtgtaggaaaacatctggttccaaaatatagatcatccttattgagccccatgatgcgttatcttaatttttaaagccttttttgtctcatactggagtttattgtaccccttaaaaatattaagtcacatatttaacctgataaaagcaaaaatcattataaaaatctttaggctgggtgtggtggcttatgcttgtaatcctcacgctttgacaggccaaggtgggtggattgcttaaaacccaggagttgtagaccagcctgggcaacatggtgaaaccccatttctgcaaaaaatacaaaaaattagccaggcatggtggcatgtacctgtaatcccagctactcgagaggctgaagtgggaggattgctttagcttgggagttcaaagctgcagtaagccatgattgtgccactctactccagcctgggcaacagagtgagaccccatctcaaaaaaatttattaagttaaaatctttaacaataaagcaatttggagtcgtattttgcgacattctcaatatagttttccaacttgcattaaaatacattttaaacatttttgaagactaaatttatttttttttaactgacagttatgtttcatttgacaaccttttgctgtatatttttatgtggacttttaggtattgtagtgattcctttaatgaagaaataaaataattgtcatttaaaaagtgcatattattattaccttatgctataaaaatagttttaaaatagaatatgtttattaagatttaaaaataagtatagtcatgcaccgcataacagcgttttagtcagactgcataagattacgatggagctgaaaaattactgtcacacaaatacttaccattgtgttatcatttccatacactggtcagtacagtaacatatatgctgtacaggtttgtagcctaggagcaacaggctatacagcatagcttaggtgtgtagtaggttataccatctaggtttgtgtaagtacactatcatgtttgtataacaacaaaattgcccaacagctcatttctctttatgtatccatgactgtatattttttattgtggtaaaaaacacttaacatgagacctaccttcttccacaaatttttaagggtacaatatagtattgttaactgtatgtacattgttatatagcagacctctagaacttttcatcttgcatgactaaaattatacccattgaacagcccctcccaattttcgtctccctctaacccctggtaaccaccattttactttctgatttgatgagttttactgttttagacacctgatattagtggattcatgcaatatttgtccttctgtgactggcttatttcacttagtgtaatgtcctcaagattcatccatgttgtagtatatgacgggattttttttaaggatacataatatttggttgtatgtatattaccacatttattttatccattcaactgtcctggacatttaggtggttgttagtgtcttgactgctgtgacaaaataagtacttttaaaagtctcacatttgcaagttcaatttgaacctttttttagtctgcttgtacttctcttatcaagcaagaaagcacttttctgctttttgtattactagtaacagtggagattaaatatctcatgtttttgggcgttctagagcccaacacatcacctgttcctttccatactaccacaactgacactctctggaaagtgccacctccctgcagcaggccaaccagcacaaaaatagtacattaaaccagcaaagctaagaaccctcaaagagtacatttcaccctcctaccgcctccactggaacaggtgctggtatccacagctgagagacccacagatggttcacatctcccgactctgtgcagactaccccccagtaccagcctggagcctggtagacttgctgggtggctggatccagaagagagatagcaatcactacagctcagctctcaggaagccacatccataggaaaagggagagagtactacatcaagggaacaccccgtaggacgaaagaatctgaacaacaaccttcagccctagacattctctctgacagagcctacccaaatgagaaggaaccagaaaaccgaccctggtagtatgacaaaagaaggttctttaacaccccccaaaaaatcacactagctcaccagcaatggatccaaactaagaagaaatccctgacttacttgaaaaagaattcactaggttggttattaagctaaggcaccagagaaaggtgaagcccaatgtaaagatataaaaaaaaaaaaagatacaagaagtaaagggagaaatattcaatgaactagatagcataaataaaaaacaatcaaaactttaggaaataatggacatacttatagaaatataaaatgctctggaaagtcttagcaatagaattgaacaagtagaagaaggaaattcagagcctgaagacaaggtcttctaattaaccgaatccaataaagacaaagaaaaaagaataagaaaatatgaagaaagccttcaagaaatctggaattatgttaaatgaccaaacctaagaataaccggcattcctgaggaagaagagaaatctaaacgtttgttaaacatatttgggggaataattgaggaaaacttccccagctttgctagagacctagatgcaaatacaagaagcacaaagaacatctgggaaattcatcgcaaaaagatcatcatctaggcacattgtcgtcaggttatctaaagttaagatgaaagaaagagctgtgaaacaaaagcaccaggtaacctataaaggaaaacttaccagattaacagcacatttctcagcagaaaccctgcaagccagaagggattggaaccctatcttcagcctcctcaaacaaaacaattatcagccgagaattttgtattcagcaaaactaagcttcatatatgaaggcaagatacagctttttcagacaaacagagaattcaccactaccaagccaacagtgcaagaatgctaaaaggaactctaaatcttgaaacaaatcctggaaacatagcaaaacagaacctctttaaagcataaatatcacaggacctataaaacaaaaatacaattagaaaaacaacaaaaaccagaaaaacaaggtatacaggcaacaaatagcatgatgaatagagtggtacctcacatctcaatactaacattgaatataaatggcctaaatgctccacttaaaagatacagaattgcagaataggtaagaattcaccaaccatctgttgccttcaagagtctcacctaacacataaggactcacataaacttaaggtaaagggatggaccaagacatttcatgcaaacggacaccaagtgtgagcaggagtagccattcttatattagacaaaacaaactttaaagaaccagcagtttaaaaagacaaagagggacattatataatgaaaaaaggccttgtccaacaggaaagtatcacaatcctaaacatatgcacctaacactggagctcccaaatttataaaagaattactaatagacctaaaaaattagacagacagcaacacaataatagtgagggattttaatactccactgacagcactggacaggtcatcaagacagaaagtcaacaaagaaacagtggatttaaactataccttggaacaaatggagttaaaagatatatacagaatattccatccaacaaccacagaatatacgttctgttcaacagcacatgaactttctgtaagatagaccatatgatagccaacaaaatgagcctcaataaattttaagaaaattaaaattatatcaagcactctctcagaccacagtggaataaaactggaaatcaactccaaaaggaaccttcaaaaccatgccgatacgtggaataacctgctcctgaatgatcactgggtcaaagatgaaatcaagatggaaatgtaaaaattcctcaaactgaatgacaatagtgacacaacctatcaacctctgggatacagcaaaggtggtgctaagaggaaagttcatggccctcaatgcctccatcaaaaagtcggaaagagcacaatctacggtcacatctcaaagaactagagaaacaagaacaaacccagcagaagaaagaagaccagagcggaattaaatgaaattgaaacaaaacaacaaaaaaaatccaaaagataaatgaaacaaaaagctggttctttgaaaagataaataaaattgatagactgttagcaagatcagccaagaaaagagagaaaatccaaataagctcaataagaaatgaaacgggagatattacaactgacaccacagaaatacaaaagatattcaaggctactatgaacacctttacatgcataaactagaaaacctaaaatagatggagaaattcctggaaagatacaaccctcctagcttaaatcaggaagaattaccctgaacagaccagtaacaagcagggagattgaaatggtaattaaaaaattaccaacaaaaaaatgtccaggactagacggattcacaacagaattccaccagatattcaaagaagacttggtaccagtcttaaagacactattccacaagagagagaaagaaggaatcctccctaaatcattctatgaagccagtatcaccctaataccaaaaccaggaaaggacataaccaaagaagaaaactacagaccaatatccttgaacatagatgctaaaatccttaagaaaattctagctaactgattccaacaacatatcaaaaagataatccaccatgatcaaggggtttcataccagggatgcagggatggtttaacatacacatgcgcgtagccaaagcaagactaagcaaaaagaacaaatctgaaggcatcacattacctgatttcaaacttatactataaggccatagtcaccaaaacagcatggtacggttataaaaataggcacatggaccaatggaacagaatagagaacccagaaataaacccaaatacttacagccaactgatcttcaacaaagcaaacaaaaacgtaaagtggaaaaaggatacccttttcaacaaatggtgctgggataattggctagccacatgtaggagaatgaaactggatcctcctctctcactgtatacaaaaatcaacccaagataaattagagacttaaatctaagacctgaaactataaaaattctaaaagataccattggaaaaatcattctagacattggcttaggcaaggatttcatgaacccaaaagcaaatgcaataaacacaaagataaatagctgggacttaattaaactaaagaacttttgcacagcaaaaggaacagtcagcagagtaaacagacaacctacagagaaggagaaaatctttcataatatatacatctgaaaaagaacaaatatccagaatctacaatgaactccaacaaatcagcaagaaaagcagtcccatcaaaaagtgggctaaggacatgaatagacaattcttaaaagaagatatacaaatggccaataaacatatggaaaaatgctcaacatcactaatgatcagggaaatgcaaatcaaaaccacagtgcgataccaccttacttctgcaagaatggccataataaaaaaatcaaaaaaatagtagatgttggcatggatgtggtgaacacggaacacttctacactgctggtgggaatgtaaactagtacaaccactatggaaaacagtgtggagattccttaaagaactaaaagtagaactatcatttggtccagcaatcccactactaggtatccacccagaggaaaagaagtcattatacgaaaaagatacgtgcacacgcatgtttatagcagcacaattcgcaattgcaaaaacgtggaagcaacccaaatgcccatcaatcaatgcgtggataaagtaactgtgatatatatatacatacaatggaatactcctcagccataaaaaggagtgaattaatggcattcgcagtgacctggataagattggagactattattctaagtgaaagaactcaggaatggaaaaccaaacatcgctatgttctcactcataagtgggagctaagctatgaggatgcaaaggcataagaatgacacaatgaactttggggactcagggagaaagggtgggaaggggatgaggaataaaagacaaaaattgggtgcagtgtatactgctcaggtgatgggtgtaccaaaatctcacaaatcaccactaaagaagttaaccaacaccacctgttccccagtaacctatggaaagaaagaaatgtctcatatgtttctgcctaaattggtctttaatactttagcgattctcttgagtttggattataaaatagttttggtctttttgtattttctgctgtaagcctgtatgattatgtaatggtgagtaaaattgctaggccagatatgcagttctaggaagttatgcaaagatgtgctttagtatattattttctacctttttaaattcattttgagcttggcttttgagcctctgttttccaaggtggggtgtatgtttttataatgttatgcttagcccttgtgtattttcatctctgagtttgaaatttggggttatattggcaaagggaggtttgggttttaattaggtgacctgttagaggaaatgttaagcttctgtttctttagggtagacagtgagagatttatcaagataaagaagaaaaataaatcctagagttaatattcaatacatgatgatgtcacccttactaaagccaaagagggcattatcctatcattctcatcgctaagaactcttctcctcttggcacatgcttattcagttaaagataagccaagcctttcttttgtattttttttttaagagaacaaatttactttggttttgagttttattcctggccctgggtagcttatttttttgacccttattttccccaatttataaaatgaaatagttatcttcactccccaggattgttgtgaagagtaagtcaaaagataaaatgaggtgactcaggcaaaagtacctggccctgtgtagtgagtacattgtatgtgttacatatattcttattgctgagaatccacgaaagaatgaattaaataatgaggaccctttcatcagggtttttgagtgagttttttaaaatacaaggtagtagtttgtgtaaatactaaatccattggtacctgtgcagaatgtaggaaatggagttgctaattccaaaaaaacagcacatatgctgaggaaagtataatacctaatatatatggtttaagcaatgtaaaattccatgaatatgttccttttcatcttaaaatttgtgatttaaaaaacattgatattactataaagaattattgttatttcccttgatttacagagtattgttacaatcacatttgaagtaccaggaaatgcaaaggaagaacatcttaatatgtttattcaggtgaatgcaatttttaactgataaatgatttatcaatggttttgttacatagttgttgctattagcgatggttggtcttattaaaatatgtcacttgatacagaatctcctgtgggaaaagaatgtgagaaacaaggacaatcactgcatggaggtcataaggctgaaggtacagtttactgttgcagactttcggacaaagtccttttcttggctgttataaaaactatatttggttttaaacagaaacactggttttagtacaaatcatctttgtctactttcatttttctttattattttcatgactgaaaaggagctttggaaatcactgcataaggcttgatttatttgcacaactttctttagggttgcagctagaacaaacctgtgtgctttgaaatgttaccttctgctctctgttcccaagtacagagaaataatgttgcaaatctcacttctgctgaacattatgcttcctgatgcatttagcagacactaaacatttgtcatactctaaacaaagttacaaaggactagaagaattcttgttctgtatttagaaacccactcacgttacttgatatttgggtatttaagtcatgaaaggtatttcttctaggaagcagtgattctaaagtgtatgcttaaccagtcagttgagtgtctactcttgtgtgttcacaagtgtgcacaaagtttttggtaaattaagaatattatttcaaataaattaatttcatccccataggagccagtttatcagataattcatttttcatttctgcaaatcaatacacaatgagctcatattcagataaatataatagtttttctttatttcatcattgttcattgattgcaacccatttctaaaacaaattatttaatataatcaaactcctttaacttctcaacttttcccactaaaactgtgaaacattatataaaatctttaatcaataggatatgatacatatttcatcattttgtttcaggttttggttgtgataaataacactgaaaaaccatcctaatatatgtattaactttatcattagaaaaggggattgttcaaaaaaaaatcaatacacagaaaccttttttgaaaattaaaaacattaagaaacttcttgtaattcacaaataattggaattaagtaattttctcagcttaagagtttgtattttttaagtgaatatcagtaattaatccattaacattgatgctctatttctgcttttaagtttgaactgaggctgattaatgttcagtcaattctcctttgagcagggattggtgtcaatcaaagacaaatcacaacaagtgattgtccagggtgtccatgagctctatgatctggaggagactccagtgagctggaaggatgacactgagagaacaaatcgattggtcctccttggtaagtctgaaaggattcacagttttaaaacaaagtgaaaaatatatttgaaagggatatcatgtgccactcaaacagattaaccattcaggtcctcttttaaaactaaataagcttgtggtcaatgtttcatctttatcacgttacaacgttcgtaaaagcttgttaggacttttgttcttcttcagttttagaaaagtggttaatccaaggaccaatgtgactttgatgtactgacctggaaagttaaagatggaatcactcaattactattctttttgtaaatttctaaacaccataaagcatttaatgaactggaattgataggtgaactgtgtcattttaataagcataatgtaatcacgtcatattttgttttgtttgcaggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgatcacctggctgaaggagtgtttgtcaggtttctccattgtaaagttactcttttcccccatttcatactgtgctctttggaaggaaatcactatgcacagcccacactaaaggaatggggagttgtagtgtacttttttgggagtggtctacataattaattgaaattcttctgcaaaggacagttgtccctttcgctttattagttcgatcatttatgtttatcagtgtggacacatgaatattttatactttgggttacaatttaatactgctttattttgttgctcaaattagcccagctttgaccattgggaactctttccgttatctcctgttcccgcctttgacatgcccccatcaatgtgggttt

SEQ ID NO: 7959 - DNA, 568 bp, Homo sapiens
catatatttgtacctatatatctgtctatatgcacattcaaacacatatccttctaactcccactcaggtcaagatacaaaagatatccaaaattgtaaagagttcctttttgccccttcctagtcaaagaaggggtaagtgctattctgacttacttaacaaaaaataaacttgaactggtaggattttttttgacggtaggattttttttgacgggaagaagtaaggaaaagagcaatacggatgtttaaaaatgagaaggtgagaatcttatagatgagtaggtctctggtacagaagtcttagtggagagttggtactggaatcctggtctaaggtattaggttttaatttgctagacaaagagaactcaagcagtgctgtctaggagtgttatgtaagctagattggactttagagtcaggagaccatgcgggaagatactgtgtgataagggcctgaaacatgttggttacagtgagactagaaatgggataaatccagagctgtttcaccagtagacttgcctgaatatcctgtctgactgattatggatcagaaagaaaa

SEQ ID NO: 7960 - DNA, 567 bp, Homo sapiens
catatatttgtacctatatatctgtctatatgcacattcaaacacatatccttctaactcccactcaggtcaagatacaaaagatatccaaaattgtaaagagttcctttttgccccttcctagtcaaagaaggggtaagtgctattctgacttacttaacaaaaaataaccttgaactggtaggatttttttgacggtaggattttttttgacgggaagaagtaaggaaaagagcaatacggatgtttaaaaatgagaaggtgagaatcttatagatgagtaggtctctggtacagaagtcttagtggagagttggtactggaatcctggtctaaggtattaggttttaatttgctagacaaagagaactcaagcagtgctgtctaggagtgttatgtaagctagattggactttagagtcaggagaccatgcgggaagatactgtgtgataagggcctgaaacatgttggttacagtgagactagaaatgggataaatccagagctgtttcaccagtagacttgcctgaatatcctgtctgactgagtatggatcagaaagaaaa

SEQ ID NO: 7961 - DNA, 568 bp, Homo sapiens
catatatttgtacctatatatctgtctatatgcacattcaaacacatatccttctaactcccactcaggtcaagatacaaaagatatccaaaattgtaaagagttcctttttgccccttcctagtcaaagaaggggtaagtgctattctgacttacttaacaaaaaataaccttgaactggtaggattttttttgacggtaggattttttttgacgggaagaagtaaggaaaagagcaatactgatgtttaaaaatgagaaggtgagaatcttatagatgagtaggtctctggtacagaagtcttagtggagagttggtactggaatcctggtctaaggtattaggttttaatttgctagacaaagagaactcaagcagtgctgtctaggagtgttatgtaagctagattggactttagagtcaggagaccatgcgggaagatactgtgtgataagggcctgaaacatgttggttacagtgagactagaaatgggataaatccagagctgtttcaccagtagacttgcctgaatatcctgtctgactgattatggatcagaaagaaaa

SEQ ID NO: 7962 - DNA, 568 bp, Homo sapiens; identical to SEQ ID NO: 7961

SEQ ID NO: 7963 - DNA, 1106 bp, Homo sapiens
gctgatggaggaaatgtgcctcacatgccgggggcgctggggaggaggcgtctgggattttgtggttgaataagacacctggcctggccctcctggagcttagtttagtaggtcacacaagcagtcattggtaaatttgggattcaaacaaatctgttaggctcaaacctgtctgttatttgtcctccaagcttcatataaactgaggagccttaaagggtaaaaacttcaggagcagcaaagtttcaaaaaaagatcagcaagaaagctcttttccagattttatcctgaaggcactagctactttaagctattttttattatattttgcccttgcagttggcgtttgatttctcactgaacattcgttgtcataattatagacactatgtgactatcaagggcataatattctttcatgctgcatttttattagatggcacctcaaagttttcccaagtaggtgggttttaaattatgaatatataccgtggcatagtatcttacttagtattttaataagatccttatttatataacaaatattttttttattcctctgtagtgctactttagtctctgagctaattttcatgaagccaatctaaaaatcgtgttacttctaaggatgtggagcgagtgagatgaacagttgtgctgtcatattgcccctccccagtgcagacagtgaatgaggacccactgatttaaaggcaacactgcagccccttcttgcctcattgaagtcccaagttttattacagtaaaagcacttaatgttgacatttctgaaagaatgaagaggccgggcgcggtggctcacgcctgtaatcccagcactttgggaggctgaggcaagcggatcatgaggtcaggacatcgagaccatcctggctaacacggtgaaaccccgtctctactaaaaatacaaaaaaattagccgggcgtagtggcgggcgcctgtggtcccagctactcgggaggctgaggcgggagaatggcgtgaacccgggaggcggagcttgcagtggtccgagattgtgtcactgcactccagcctgggcgacagagcgacaacgtctcaaaaaaaaaaaaaaaaaaaaaaa

SEQ ID NO: 7964 - DNA, 595 bp, Homo sapiens
ttagtgttctggatgaagaaaacatataaaagttattgtatgttaggtattgtttgcaaaagagtagaaaatggagaaataacccagtgggttaaagaagaaacagactaaataaacaaacctgagtaagttgttcctaaattttattttagaggcaattcctcattttgctttagttttctcaattattgcctcacttttctgtttctttctctgtcagcatacatggaaaaaggagttaattttagattcaaaacaaaaactggaaaaaaaaagtctgaaatgggtaatacctaggacctagtatatatgtgttattaaggctctatccctgaatttttaatgcagttatctatttttcatggattctttgtttattccccataaggaacacctgggtttggagaatgggaaggtagatgagaaaacccaagtgacaaagaatgtttagtttattattagaaccaactatgagttgtgacccttatcttctgcactgggaattacagattttttcagggtttttctaacgtgaaaagagtttattggtgtaggaaaacatctggttccaaaatatagatcatccttcttgagc

SEQ ID NO: 7965 - DNA, 178 bp, Homo sapiens
ccaactatcaagagaaatttcaacatagaaatttatttagtaagttttacttgacacaggagccttcataaaacatacctgtgtatgttttctgttagttatgatatggaagaggatagtaatggagaagcataattagataaaacagtatgatctaataataaactgggaagaactt

SEQ ID NO: 7966 - DNA, 596 bp, Homo sapiens
ttagtgttctggatgaagaaaacctataaaagttattgtatgttaggtattgtttgcaaaaaagtagaaaatggagaaataacccagtgggttaaagaagaaacagactaaataaacaaacctgagtaagttgttcctaaattttattttagagacaattcctcattttgctttagttttctcaattattgcctcacttttctgtttctttctgtgtcagcatacatggaaaaaggagttaattttagattcaaaacaaaaactggaaaaaaaaagtctgaaatgggtaatacctaggacctagtatatatgtgttattaaggctctatccctgaatttttaatgcagttatctatttttcatggattctttgtttattccccataaggaacacctgggtttggagagtgggaaggtagatgagaaaacccaagtgacaaataatgtttagtttattattagaaccaactatgagttgtgacccttatcttctgcactgggaattacagatttttttcagggtttttctaacgtgaaaagagtttattggtgtaggaaaacatctggttccaaaatatagatcatccttattgagc

SEQ ID NO: 7967 - DNA, 595 bp, Homo sapiens
ttagtgttctggatgaagaaaacatataaaagttattgtatgttaggtattgtttgcaaaagagtagaaaatggagaaataacccagtgggttaaagaagaaacagactaaataaacaaacctgagtaagttgttcctaaattttattttagaggcaattcctcattttgcttcagttttctcaattattgcctcacttttctgtttctttctgtgtcagcatacatggaaaaaggagttaattttagattcaaaacaaaaactggaaaaaaaaagtctgaaatgggtaatacctaggacctagtatatatgtgttattaaggctctatccctgaatttttaatgtagttatctatttttcatggattctttgtttattccccataaggaacacctgggtttggagaatgggaaggtagatgagaaaacccaagtgacaaataatgtttagtttattattagaaccaactatgagttgtgacccttatcttctgcactgggaattacagattttttcagggtttttctaacgtgaaaagagtttattggtgtaggaaaacatctggttccaaaatatagatcatccttcttgagc

SEQ ID NO: 7968 - DNA, 595 bp, Homo sapiens; identical to SEQ ID NO: 7967

SEQ ID NO: 7969 - DNA, 178 bp, Homo sapiens; identical to SEQ ID NO: 7965

SEQ ID NO: 7970 - DNA, 8970 bp, Homo sapiens
acgggatgggattcttgtcacggcgcacgttctgtgggcggagtgggcggagctgccggggtcagttggtccaagtgtcccggcctgaggtgtcggccggatccctccttctcccggcgcctcaagcggaaggtgagggccgtcccgggcagcggagggcctggccccaggcgactagagctgcatcctcagtacctccgagggcctggagggcggggcgggctggacgcggccctgcgcaccgggggcccgggaggagcggtctcgggcctgggtatttggtgggcggcggaggcctggctcccggcagaacccttgcgcgacctctttttctcctgttttcgttgtcaggcccaggcgttctttgggagagggacctctcgcggtccctgacgcagacatcgtgtagctttctccccgcagctcctgggtcgggagccgctttgcagctctcggctctggaattggactgcgggaggggcgtttgggtggaatgggacctggcacgcctggaccttcccgtggctgctctgcgagagcctgagagatgggaggggaggctgaggtggggagggagcctagagagccgtaaaataaggattggaccatttttccaggcggcgaaagcggcacctgggtttgtttcctgatcgtcttctcccccagagtcctgctgaacaagttttgggaagaaaggtttggaaaggagaaagaggatacattcctgaaaggcagggcttctgttatacagtgtgtcaacctcacactattacgcaacaataaggacagatgccattccaggttgccaacacgttttctatgcccgaggacccaaagctgtgcccatgtattctggtacctctattcctgattaaaatcagtgtagctagccattctctgagagtatagcttccatttaaatcctcatttggccaaacagttccttgatcttgtggaatttgaaactggatttatttaaccaggacaagtcaaaggagaacttgaacagatctgaacagacattatattgaagttccgtagcttgaagggaatggagtttattttcagttgcttagtaaagattccagaggagtttgacatcagtggtagcaaaatgtttggcaaacttaagattagggccatattaaagttttttccattgcataatggaaaaagcatggactgtgaagttagacctgggttcaaattcttggtagagacattggctgtgaaacctctgaaacagcttttctgaaagatatatagactttctgaaatttagtgtccatatctgtaaattgcagtttccttctgttgatttgatgaaataacatatgcaaagcatttagcacattaatgcacgaagacattattttagcagtcttagtagttctccagtatgacagatggtgaaatcaattttagatgcagaaaagttgagtggctgaagatggacgggtattaggaaaaagtctcaaaatctgcaggctcagatgtgacaatagttgtggtggaatggtggaaaaaacactgggcatttgttgtagtcttggccctgttgctaactacttctgtggtcttcagtaagccattgtcatctttggccttgattttgtaaaatgaagcagctggaccagatggttttctttaaattctttctgttgcccaaattagagctaaaaggtagagaagacgatagcagacatttattgaatacctactatgtactaggtactgttgccaacacattgtatctatccactcattctcacaacaaacccatgagatacgtacggttattatccacattttacaaatgaggaaacttaaggccgaggtgttaaccttgcccagggttccagagcttataaattgcagagctaggatttgaatccaggtaatctgaatccatattgttaatcattgtgccaggctgcctcttgaggagagtgatattgtggatattgtacactattagagataactgtaaaataagataggggcatatttggtaagatgatcgtctttggtcacaggtgtgtgtgcatggcaaaaattatttaattaaatgaatcttgtcccaatgtttgccacatttcctggtttgtattctctctatgcgttctgcctcctggacttaaataatcaaaaaagtaattctagattcccttccactaaccaaggctagatacccgaatttactgtgttttttgagaaacctttgaaaggtctgacctagccatacatcagagctgaagaatctcagcgaaccatgtccatttctggggtaaggtggtttaggataggcagagcagcctcagcgccccaaattcatttcagtgttcccacgcttgagcagacttggtcttaattttctcgtttttcatcagatttgcgtttatatataggagcagaaggagttgaaagtgaactcttaagagcatatttgacatggaattagattgatgttatagcaactataggtaaaaaaggattttatagttgaaaaatttgaaaagctcagtattaagtatctgttatgatgtagtactgtgttaatgtagactttgggcagtttggggatcaatactattttaaaagaaaaaatccatggctaaaatactttgacataaagaactcagcaagtcttttgatcccatatgtcaaacaaatcagtttattgccctaaatctactgaaagactttgaatacatattaatacaatagtagcattttgagatgggtctatttgatcacatcacaataaaatacaattgcttcttgttcttttgtcgtggaaaggcagcaggtaatgctgtggtccactgtactaaagagtaatgcccttatgcgtagggctgccagatacagtgggcggttttttcactgtgcaacacttgggatgcaatcttacgtagactgtggtgtgaattgtgctctctcgcgttgtatacccttatagcactgttcttgtggcactacttttgtgctcctgcctctaccctaatcttgagtgtaagagtaatttttcctttaataagccctctccaccctgtttttctgctttttattttctttcactttttcagatgaagtcacactgttgctaaaccatgcataggttttctattgtttgaattatatgtggtcagaatttcagaaactggcttctttttctttacctcttatattggtgagtttggaatacttgtgtttttgcagactttttggtttaatttaaatattagtctgaaacataagcaaaagaagactaccctatcactgtattatatctgacttcaaaatcagctgtgtcgattttctgattatctgttgctttggcttgtatatcttataactcttcttagctatcatgaaaattcgttctagctgtagccttaacatcattggatatgagaaatttgaagcacttttaatttattatttagcaaagacagatgccaaattgcagcttactcttgctgagcactcccacgatcacttttgcttttggctgttgcctctctcatcttactcagacctcttttagctggatcagtggttgaaatggtatgaaaagagaatgactgtagtacctggttacagatgtgcttctctgtcagggaaatgtcaaatcaagttttcactgacactcttcctcttcaattatagttaaagagacatgttgattcaatggagaggaatagtttttggagtgtggtctttaaatactacagtaggctgaataacttttaaaaaaagaattgttggaaaaattttagtaatctgaaatgcagagaacctgagaattaaataatgtgaaaaagaggtcgggcagagcaactttaaatgcggtttagataaggggaaagatgctagaagacttggagtaggtttattcagcattattaaattaattgtataccatttgtagttaattatttaataatgttatacaagggatatttcgtatttttttctagactagtgagtgctatctaacttgaactataaacttgaagtttatgtatatgtacactgggcattttaatttgaagttcatgttagtatctaaagtgtaacaggatttatgtagatgtacactgggcattttcaaatttcatgttagtatctgaagtacaacaagatttgtattaacagctgtgagagaatgtgtaatacactgatatctctattgtgattctagttctagtatgtagatatccttatttaataggtctgctttctactgtttaagatacggaggcataacaatgccttgggcatagaagatattcagtaaatacttgttgaaagaataacactgacaggtctaggttgcttcaatgtagtagattagattggttaacaaatctgttttcagtaataatctggtgacattatttaatatattttgaacatattgaatgaaatgattgttagcaatggagcagaacatgttttatagaaattttttgttctaatatttagaagtcttcattgtaataataaaatgttagtatttatttacttatttacatcctgattagtctgtttttatttaaccctgactaggagctgatgaatggacattttttcatttattccatattaatattttagatggtctagtatttatcttttgaattttatttgtaaaaaattaaacagtatatgtaaagcaatactttaatgaagaagaatatttgaaacaattttatcttcatccataccgtcatccttaatatcagagcattttttcattttcatgttttttatgcatatttatatatatttcacataatttacatcagtgaatatacaattttatacacattttttcatgtagtatagtcataattattttcagtagccactccattagaaattataactgtactcaggaggctgaggaaagaggattgcttgggtccaggagtttaatacagactgggcaacttggcaagaccctcatttctaaataaataaataaaaatatgtcttcttaaaaagaaaatcacaactgtaatttaccagactttgagtgggcagttatgttgtttctgattgacttcattgtaaataaaattgaagtgatttttatgtatataactttctttgcattattgtccttagcctaaatttccaaggtaaaatactcagttaaaaaagatgtaaatgtttttatgaatcttattatcatactgctttccaaaaagattacatatttaaaatttgtgtccagtgtttgtgtatttgtttttccataactctttgctagtattgatcattatctcctttaaaaataataactgtacggtggtatttatgtattttttgattatcaagaagctcaacattttctcaaactatttatatcctttgcttatttacccattaggcatttattttattcttagtaaagcatatgaaaagtcctactatgtcatagttaacaaaatcatcctcctttgaaaaacaggcttatagtttattgctgtatgtgtctatatttctgaatttttcttattgtagaccattcctcaagaattttgtatccaaggcccaaaagtttgttacccaagatgatgaatgctgacatggatggtatgttcttcattttcttttttgtatactcctggttttgtggatgcttttgctttattaagcaatggaaagggcagagaaaccatgtttagaagactttgatcttggctaattacttatttatatctcatctagtgttagaaaggaccaaccaaagcagcttccattccttagctatgagaggttggcaagttgtttttatcttctttaccttggtggtattatctgcaatttggggatacaaaattttatttcacagggctcttgtataagtcaagtaagaatgaatataaaacattttgcagatttttaagtgctaccctacacaaatgtacctaatgctaattaatagtaaatttgaacctttatattacagcagttgatgctgaaaatcaagtggaactggaggaaaaaacaagacttattaatcaagtgttggaactccaacacacacttgaaggttggcttgcattttgtagtttatttgaatgacagccaattaattgaacttgtaaacatttatattgctaaattttgtttgttaggatgtataatttttaaaagaatgaacttcaaagtacacacatatatatatctatcttcctgctttggtagtttaaagaacagatacacttcagtcaagtcaaatgttgttattgtgcttccctctttgaagcctaacataatgctggctagtatgagacccccttttaagtccccataatgtgttactaagtccgctttaataaagcttattttaaagtaaaaacaatgtattagccttggagattaaaaaggaattcatctgaattttttcattttctaaatcttgcataaaattaatacactgaaacatcttttgagttttaatgaaattaagaggttgtgtttttggtgccacagtgagcagatcatgtcactcagaacctcccactgatttacattttacagagttaataaaagtcatctgtgacttccctattagctttctttttctttttcttttttttttttttttttttgagatggagttcactcttgttgcccaggttggagtgcaatggcgcaacctcggctccctgcaacctctgcctcccaggttcaagcgattctcctgtctcagcctcccgagtagctgggattacaggcacctgctaccatgcctagctaatttttttgtatttttagtagagatagggtttcactatgttggccaggctggtctcaaactcctgacctcatgatccacccgcctcggcctcccaaagtgctgggattacaggtgcgagccaccgtgcccagccggaattaacctcttatgtgatcatcaggaactgcatgtgttcaatgtcttgataatgttacaatacaagatgataagttgcttggaaactgactgcctgtattcagtatatgaattcagttgtgttaacctgatatatatcttaaacatttctagtaaagatgttatagttttatgttgataagacatgaaccaaaattcacattttaaaaacaaagtctttttaaaaaattactcaacattaatgctatttatgaagaatagcatttagtctaatgtgaaatatctttttaggaatttgtctactaatttgtactcagtttgtttaccttgctgtctctaaaatccgaattcttaaaatttaaggattgtattatttcttttaagaatgaatcctaagaattttgtaatatggaatcattgtcattgttttattgataatgggcatttttattttttatatagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaatttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttg

SEQ ID NO: 7971 - DNA, 8971 bp, Homo sapiens
acgggatgggattcttctcacggcgcacgttctgtgggcggagtgggcggagctgccggggtcagttggtccaagtgtcccggcctgaggtgtcggccggatccctccttctcccggcgcctcaagcggaaggtgagggccgtcccgggcagcggagggcctggccccaggcgactagagctgcatcctcagtacctccgagggcctggagggcggggcgggctggacgcggccctgcgcaccgggggcccgggaggagcggtctcgggcctgggcatttggtgggcggcggaggcctggctcccggcagaacccttgcgcgacctctttttctcctgttttcgttgtcaggcccaggcgttctttgggagagggacctctcgcggtccctgacgcagacatcgtgtagctttctccccgcagctcctgggtcgggagccgctttgcagctctcggctctggaattggactgcgggaggggcgtttgggtggaatgggacctggcacgcctggaccttcccgtggctgctctgcgagagcctgagagatgggaggggaggctgaggtggggagggagcctagagagccgtaaaataaggattggaccatttttccaggcggcgaaagcggcacctgggtttgtttcctgatcgtcttctcccccagagtcctgctgaacaagttttgggaagaaaggtttggaaaggagaaagaggatacattcctgaaaggcagggcttctgttatacagtgtgtcaacctcacactattacgcaacaataaggacagatgccattccaggttgccaacacgttttctatgcccgaggacccaaagctgtgcccatgtattctggtacctctattcctgattaaaatcagtgtagctagccattctctgagagtatagcttccatttaaatcctcatttggccaaacagttccttgatcttgtggaatttgaaactggatttatttaaccaggacaagtcaaagcagaacttgaacagatctgaacagacattatattgaagttccgtagcttgaagggaatggagtttattttcagttgcttagtaaagattccagaggagtttgacatcagtggtagcaaaatgtttggcaaacttaagattagggccatattaaagttttttccattgcataatggaaaaagcatggactgtgaagttagacctgggttcaaattcttggtagagacattggctgtgaaacctctgaaacagcttttctgaaagatatatagactttctgaaatttagtgtccatatctgtaaattgcagtttccttctgttgatttgatgaaataacatatgcaaagcatttagcacattaatgcacgaagacattattttagcagtcttagtagttctccagtatgacagatggtgaaatcaattttagatgcagaaaagttgagtggctgaagatggacgggtattaggaaaaagtctcaaaatctgcaggctcagatgtgacaatagttgtggtggaatggtggaaaaaacactgggcatttgttgtagtcttggccctgttgctaactacttctgtggtcttcagtaagccattgtcatctttggccttgattttgtaaaatgaagcagctggaccagatggttttctttaaattctttctgttgcccaaattagagctaaaaggtagagaagacgatagcagacatttattgaatacctactatgtactaggtactgttgccaacacattgtatctatccactcattctcacaacaaacccatgagatacgtacggttattatccacattttacaaatgaggaaacttaaggccgaggtgttaaccttgcccagggttccagagcttataaattgcagagctaggatttgaatccaggtaatctgaatccatattgttaatcattgtgccaggctgcctcttgaggagagtgatattgtggatattgtacactattagagataactgtaaaataagataggggcatatttggtaagatgatcgtctttggtcacaggtgtgtgtgcatggcaaaaattatttaattaaatgaatcttgtcccaatgtttgccacatttcctggtttgtattctctctatgcgttctgcctcctggacttaaataatcaaaaaagtaattctagattcccttccactaaccaaggctagatacccgaatttactgtgttttttgagaaacctttgaaaggtctgacctagccatacatcagagctgaagaatctcagcgaaccatgtccatttctggggtaaggtggtttaggataggcagagcagcctcagcgccccaaattcatttcagtgttcccacgcttgagcagacttggtcttaattttctcgtttttcatcagatttgcgtttatatataggagcagaaggagttgaaagtgaactcttaagagcatatttgacatggaattagattgatgttatagcaactataggtaaaaaaggattttatagttgaaaaatttgaaaagctcagtattaagtatctgttatgatgtagtactgtgttaatgtagactttgggcagtttggggatcaatactattttaaaagaaaaaatccatggctaaaatactttgacataaagaactcagcaagtcttttgatcccatatgtcaaacaaatcagtttattgccctaaatctactgaaagactttgaatatatattaatacaatagtagcattttgagatgggtctatttgatcacatcacaataaaatacaattgcttcttgttcttttgtcgtggaaaggcagcaggtaatgctgtggtccactgtactaaagagtaatgcccttatgcgtagggctgccagatacagtgggcggttttttcactgtgcaacacttgggatgcaatcttacgtagactgtggtgtgaattgtgctctctcgcgttgtatacccttatagcactgttcttgtggcactacttttgtgctcctgcctctaccctaatcttgagtgtaagagtaatttttcctttaataagccctctccaccctgtttttctgctttttattttctttcactttttcagatgaagtcacactgttgctaaaccatgcataggttttctattgtttgaattatatgtggtcagaatttcagaaactggcttctttttctttacctcttatattggtgagtttggaatacttgtgtttttgcagactttttggtttaatttaaatattagtctgaaacataagcaaaagaagactaccctatcactgtattatatctgacttcaaaatcagctgtgtcgattttctgattatctgttgctttggcttgtatatcttataactcttcttagctatcatgaaaattcgttctagctgtagccttaaaatcattggatatgagaaatttgaagcacttttaatttattatttagcaaagacagatgccaaattgcagcttactcttgctgagcactcccacgatcacttttgcttttggctgttgcctctctcatcttactcagacctcttttagctggatcagtggttgaaatggtatgaaaagagaatgactgtagtacctggttacaggtgtgcttctctgtcagggaaatgtcaaatcaagttttcactgacactcttcctcttcaattatagttaaagagacatgttgattcaatggagaggaatagtttttggagtgtggtctttaaatactacagtaggctgaataacttttaaaaaaagaattgttggaaaaattttagtaatctgaaatgcagagaacctgagaattaaataatgtgaaaaagaggtcgggcagagcaactttaaatgcggtttagataaggggacagatgctagaagacttggagtaggtttattcagcattattaaattaattgtataccatttgtagttaattatttaataatgttatacaagggatatttcatatttttttctagactagtgagtgctatctaacttgaactataaacttgaagtttatgtatatgtacactgggcattttaatttgaagttcatgttagtatctaaagtgtaacaggatttatgtagatgtacactgggcattttcaaatttcatgttagtatctgaagtacaacaagatttgtattaacagctgtgagagaatgtgtaatacactgatatctctattgtgattctagttctagtatgtagatatccttatttaataggtctgctttctactgtttaagatacggaggcataacaatgccttgggcatagaagatattcagtaaatacttgttgaaagaataacactgacaggtctaggttgcttcaatgtagtagattagattggttaacaaatctgttttcagtaataatctggtgacattatttaatatattttgaacatattgaatgaaatgattgttagcaatggagcagaacatgttttatagaaattttttgttctaatatttagaagtcttcattgtaataataaaatgttagtatttatttacttatttacatcctgattagtctgttttgatttaaccctgactaggagctgatgaatggacattttttcatttattccatattaatattttagatggtctagtatttatcttttgaattttatttgtaaaaaattaaacagtatatgtaaagcaatactttaatgaagaagaatatttgaaacaattttatcttcatccataccgtcatccttaatatcagagcattttttcattttcatgttttttatgcatatttatatatatttcacataatttacatcagtgaatatacaattttatacacattttttcatgtagtatagtcataattattttcagtagccactccattagaaattataactgtactcaggaggctgaggaaagaggattgcttgggtccaggagtttaatacagactgggcaacttggcaagaccctcatttctaaataaataaataaaaatatgtcttcttaaaaagaaaatcacaactgtaatttaccagactttgagtgggcagttatgttgtttctgattgacttcattgtaaataaaattgaagtgatttttatgtatataactttctttgcattattgtccttagcctaaatttccaaggtaaaatactcagttaaaaaagatgtaaatgtttttatgaatcttattatcatactgctttccaaaaagattacatatttaaaatttgtgtccagtgtttgtgtatttgtttttccataactctttgctagtattgatcattatctcctttaaaaataataactgtacggtggtatttatgtattttttgattatcaagaagctcaacattttctcaaactatttatatcctttgcttatttacccattaggcatttattttattcttagtaaagcatatgaaaagtcctactatgtcatagttaacaaaatcatcctcctttgaaaaacaggcttatagtttattgctgtatgtgtctatatttctgaatttttcttattgtagaccattcctcaagaattttgtatccaaggcccaaaagtttgttacccaagatgatgaatgctgacatggatggtatgttcttcattttcttttttgtatactcctggttttgtggatgcttttgctttattaagcaatggaaagggcagagaaaccatgtttagaagactttgatcttggctaattacttatttatatctcatctagtgttagaaaggaccaaccaaagcagcttccattccttagctatgagaggttggcaagttgtttttatcttctttaccttggtggtattatctgcaatttggggatacaaaattttatttcacagggctcttgtataagtcaagtaagaatgaatataaaacattttgcagatttttaagtgctaccctacacaaatgtacctaatgctaattaatagtaaatttgaacctttatattacagcagttgatgctgaaaatcaagtggaactggaggaaaaaacaagacttattaatcaagtgttggaactccaacacacacttgaaggttggcttgcattttgtagtttatttgaatgacagccaattaattgaacttgtaaaaatttatattgctaaattttgtttgttaggatgtataatttttaaaagaatgaacttcaaagtacacacatatatatatctatcttcctgctttggtagtttaaagaacagatacacttcagtcaagtcaaatgttgttattgtgcttccctctttgaagcctaacataatgctggctagtatgagacccccttttaagtccccataatgtgttactaagtccgctttaataaagcttattttaaagtaaaaacaatgtattagccttggagattaaaaaggaattcatctgaattttttcattttctaaatcttgcataaaattaatacactgaaacatcttttgagttttaatgaaattaagaggttgtgtttttggtgccacagtgagcagatcatgtcactcagaacctcccactgatttacattttacagagttaataaaagtcatctgtgacttccctattagctttctttttctttttctttttttttttttttttttttgagatggagttcactcttgttgcccaggttggagtgcaatggcgcaacctcggctccctgcaacctctgcctcccaggttcaagcgattctcctgtctcagcctcccgagtagctgggattacaggcacctgctaccatgcctagctaatttttttgtatttttagtagagatagggtttcactatgttggccaggctggtctcaaactcctgacctcatgatccacccgcctcggcctcccaaagtgctgggattacaggtgcgagccaccgtgcccagccggaattaacctcttatgtgatcatcaggaactgcatgtgttcaatgtcttgataatgttacaatacaagatgataagttgcttggaaactgactgcctgtattcagtatatgaattcagttgtgttaacctgatatatatcttaaacatttctagtaaagatgttatagttttatgttgataagacatgaaccaaaattcacattttaaaaacaaagtctttttaaaaaattactcaacattaatgctatttatgaagaatagcatttagtctaatgtgaaatatctttttaggaatttgtctactaatttgtactcagtttgtttaccttgctgtctctaaaatccgaattcttaaaatttaaggattgtattatttcttttaagaatgaatcctaagaattttgtaatatggaatcattgtcattgttttattgataatgggcatttttattttttatatagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttg

SEQ ID NO: 7972 - DNA, 1312 bp, Homo sapiens
aggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttgtgcatcttctgctcctgggtaagggtgggtcttaatggtggctgggtggaccactgcccgtccactcttcaacaggaggaacagcatgccaccatagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttctatcttacagctatttctttttacattgtacaaataacgtggccatcacatcaatgtgcctggaattttcttgaattaaaggagagagtagagtattttctataggagccaagtcccatc

SEQ ID NO: 7973 - DNA, 1312 bp, Homo sapiens
aggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccatagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttctatcttacagctatttctttttacattgtacaaataacgtggccatcacatcaatgtgcctggaattttcttgaattaaaggagagagtagagtattttctataggagccaagtcccatc

SEQ ID NO: 7974 - DNA, 20337 bp, Homo sapiens
  misc_feature (18464)..(18464): n equals a,t,g, or c
  misc_feature (18467)..(18467): n equals a,t,g, or c
ctgtttcacagcaatgctgacccggacagagttgatggagccctcaatcagaaccttttccttctcattcctgctgatggtcacaggttgtaacaggagctctttgctactcctgaaaacataatgtgacagagtacttgtactacagagggatagaatagtcagagtgaccccacgcaggtcctggaatcactatgagaccatagagtccaaggaatagaagactcacaagcaggagtgctccaagatgggggccagtgagtgtgttcttcagcagaaagagcacaggctctgaagtcagggcgaaaaggttttgaaatccagcctcctctgttactttccttgggcaagttaccctgttgggaatctcaattttctcatctgtaaaatgactctgattcctaattcactggcgaggactgagagagatcaaaaagggtcaaatgtctaatagcgtgcctggcacatagtaggagctttacaaaagatagctattttagtaactacaagttgaacatccccaatctgcaaatctgaaatccaaaatctgaaactggctgggcacagtggctcatgcctgtaatcccagcactttgagaggctgaggctggtggatcacctgaggtcaggagttcgagaccagcctggccaacatggtgatatcccatttgtactaaaaatataaaaattagctgggcatggtggcgcactcctataatcccagatactcaggaggctgaagcacgagaattgctcgaactcaggaggtggcagttgcagtgagccaagatcataccactgtactccagcctgggtgacagaatcaaactccatctcaaaaaaaaaaaaaaacctgaaagtttccgagtgctgacaagatgctcaaaggagatcctcattggagcattttggatttggaattagggatgctcaactggttaagtatctgcaaatattccacaatctgaaatacttttggtcccaagcattttggataagagatactcaacctgtacaggcaaaccaatataccatttaggaatacagagagaacacctgtcttagaggtaaggaaaggctaaaattgaacacagtttggcttcctttaattatcaatccagaaatgattcatttgcctctgagacccctatgagttcaggttacaaagtaatgcctctgaatacctagagatctctaatagtaattaattgtggtgtggtgtctctaaactgctaaccattttcaaaggcccactggaaatcgtgtacgttacacagtataacagggcatatcctaacatctttatcagttatttttaaaattaaaaattaaatcgtatcatttaatgttgtaacccagattatctcagttatgtatgtaccagaatgaattttattttattttattttattttattttatttttgagacgaagtcttgctctgctgccaggctggagtgcggtggcacgatcttggctcactgcaacctccgcctcccaggttcaagcaattctcctgcctcagcctcccgagtagctgggactacaggtgcataccaccatgcccagcttatttttgtatttttagtagagacaaggtttcaccatgttggccaggatgctctcgatctcttgacctcataatctgtctgcctcggcctcccaaagtgctgggattacaggcgtgagccactgtgcccggcctatttacttattttttgagacagggtctcacccaggctggagtgcactgtcgcaatgttggctcattgcaacctctgcttcccaggctcaagagatcctcctgcctcagcctccagagaagtgggactacaggcatgtgccaccatgcctgactatttttgcatatttttttggtagagatggagtcttgccatgttgcccaggctggtcttgaactcctgtactcaagcgatctacccacttcagcctcctaaagtgctcggattacaggggtgaaccactgcaccaggcctccagattaaattttaaaggggaaaaagatatttatgaaatggaaactagataagagaaaatcattcaaaatatgaagtatttggattagggggtcagagtgtctaggctggtaggtaaaaaaaaaatccctgatcattacattagaaaagtatggagatgggaaaaaaaaaaaaaaaaaagaaaagtatggagatggaatctcagataacaattatctgaccattccttaaactaccagtgttttcaacaatgccacaggagagacttcatcaacagccctgctctgagaagtcataccttgtgttaaccaatcttgtcttttcccctgggttctgtcctgccaacccactgaccctattttcttaactccaaattgggaatcaccattcagctggcagcaagacaaaatgtcaactgcagctttcctgactactgcaggacataagttcatggcaccttctagacagcagccatctctgtgtgctgcacccctcatccccaccttgacttgtccttccctacctgacttccacttccggcttgttgtgtcgttccacaacctgggaggagaagttctccaggcagagggcagcctgcaatgtggcccgcacggcactcaggtaggggcggagagtggcagtctataggaaataacacagaggaaagggaagatcaaaatctgtcacgccaaacccaccgatcccctattccagctcccatgaagccaggtagcactgagggtgcaaggctcttaagacactactgtgaacagaacagactaggccttcgagacgccttccaaggtgtagagtggtagttttcaacaggagacaattttgcctgccagggtacatttggtaatgtcgagacatttcctttctttcttttttaacctggggtcagaccagaggaatgctgagacattttcaattgtcatgacttggcaagaaggggaactgcaggcattcagtggacagatatccactaaacatactacaatgcactacaaagaattatcgagactcaaatatcaatagtgctaaggttgagaaagtgatctagagacacaccagtgaatgcatgattgtcgtcaatctattaggccaacaaatgtataggtgtactgtttgccacgcactgagctaactgggaattcaaagatgattaacactgtctctaccctcaaacagctcaactggatagcaaatatacagaaaataactatgatataaagatgacatgtgaaatatttagatttacaagtaatctatatttgcagaagaaactggttttgaaggtgaaatgggattaggaggagaaaaaggagaataaggacattctttttttttttttttttttgagacagagtctcgctctgttgcccaggctggagcgcggtggcacgatctcggctcactgcaagctccacctcccgggttcatgcccttctcctgcctcagcctcccaagtagctgggactacaggcgcccaccaccacacccggctaactttttgtatttttagtagagacagggtttcacggtgttagccaggatggtctcaatctcctgaccttgtaatctgcccgccttggcctcccaaagtgctgggtttacaggcgtgagccaccacaccctgccagaataaggacattcttaggagagggattagcttctagctgcactggtcagtccttgtatcagccaaattctttcccacctcagagctttacacatgcttgaccatctatctgtaggcttttctcctctttctttgcctaagtcatcctccagatctcagcttaattaaggaaggcctcttgagagagaccttgacatccccctataaagtatttattacaattgacaaaaaaatgtctttcatgtcttcttaatatttatttttgagagggagtctcgcttctgtcaccctcgctggagtgcagtggcacgatctctgctcacggcaatcgccgcctcctgggttaaagcgattctcctgcttcagcctcccgagtagctgggattacaggcgcacatcaccatgcctggctaatttttgtatttttagtagagacggagtttcaccgtgttggtcaggcttgtcttgaaatcctgacctcaggcaatccgcccacctcggctctctcaaagtgttgggattacaggcgtgagccaacgtgcctggccttttttatttttttttgagacagagtcttactctgttgtccaggctggagcgcagtggtgcaatcttggctcactgcaacctccacctcccgggttcaagtgattcacctgcctcagccatgcgaatagctgagatgacaagtgtgcaccaccgtgcctggttaatttttgtatttttagtagagatggggtttcgccatgttggccaggctggtctcaaactcctgacctcaagtgacccgcccatctcggcctcctaaagtgctgggattacagacatgaaccactgcacctgccctccttcatgcctttgtaagtgatttctcctttactaggctgtaaacctcatggtcaacagaccatatctattttattcacagctatatagcctccaacctagctcagtacctaacatatacagtgtctcactcatttcctgtagaataaataagcgaaagaaataattaagattagagtaacacaaaaggacagcaagagttccagagtagtaatgagtacaatgtttctgtatatgagaagcattttagattcactaaatgaggctgcagcggtaggctgaggtaagatcatggggaatcttgaatgccaggctaccaagtttagcttttctcttaagggggtaaggaactactggggctttctgaggaggaagttcatgactgcagctgcatgatggctctgtggagaatgatttggagagggaagtgagacatacagcagactgtatcacaagcaaagagtatcacaagcgttggactgacattagatggagtggataatggaactgaaaaaaaacttcccaggggctcacgcctgtaatcccggcactttgggaggccgaggtgggtggaccacctcaggtcaggagttcaagaccagcctggccaacatggcaaaaccccgtctctactaaaaatacaaaaaattagctgtggcgggtgcctgtaatctcagctacttgagaggctgaggcagtagaattgcttgaacccaggagactgaggttgcagtgagccgagatcacgccactgtgctccagcctgggtgacagagcgagactgtgtcttaaaaaaaaagaaaaagaaaaaccacttccaacgaactgtggtccagccattcaattaactactacttggtaataaaaaaagagtaactattgatacacacaacatggttgactctcaaatgtattatggtaagaagccacacttaaaagcctgcatactaaagaattccatttacatgacaatctgaaaaaggcaaaactacaggggggaaaaatcagtagttgtctggggtgggaaggagaggactgattacaaaagggcttgagggaactttttggggtgacggaaatgttctgtattttggttgcagtagtggttacacaacttgactttttttttttaagacacgggatcttgctatattgtccaggctgaagtgcagtggctattcacaggagtgatcacagtgtactacggcctcgaacttctgggctcaagtgatcctcctgcctcagtgtcctgagcggatggtactacaggcgcatgccaccatacccagcaagtttttgcaacgcttttttttttgagacggagtcttactctgttgcccagtctggtgtgcagtggcacgatctcgactcactgcaagctctgctttctgggttcacgccattctcctgcctcagcctcctgagtagctgggactacaggtgcccaccaccacgcccggctaattttttgcatttttagtagagaagaggtttcaccgtgttagccaggatggtctcgatctcctgacgtcgtgatccgcccgcctctgcctcccaaagtgctgggattacaagcgtgagccaccacgcctggcctttgtcaacagttatagaaagtaaacctaaaaagggtgactggctccgtgacgcctgtcctttcatgaataaaacagatgtagtctcatgtaatacctcaataaacttgaacttttaaaaatcaagaggcatgtgccccactagaaaaaaaaaatacagatttttagcagagacatgaggtcacaaaagtttgccaggatagggaacccaggaggaagaacaaatttagaatagaatatgagttttgaactagaggtctaatttcaaggtctcttcaagatatccaggcaaaccttgaaagagagctgagaagccagattaggagtcatcagaatgaagaaagttatcgaagccaggagactagatcggtatcaccagggaaggtgtgacgaagagggagatggtcatccaaagtcacaactcccaggaatgcccacacgtatgaaaaaggcccacatgtatgaaaaaggcccacatgtatgaaaaagggaggacttccaggaagggagggatgagcagtatcacagctaacatacactaaggctgacacagttcagttctgaccaggaagggcctgaatggaagcaacacgagagatcctccaatggggtggaagcagggctggaggtaccaagaatgggataaggaagtgtggccgcctgccttaagcaactgtagggtcaggaaggcagaagaggacaaagggcgtatgtcgtgaagttccactgtggataggcaggtggacttgcttcatgcctcagaggctaagaggccgactacgtaccctcgaaatgctccaaagagcctaggagaccccacttccgggttcctacagggctcaggaaaagcccctacctgcttcgaaggctgaccgtgaagccacaaggcccacttcataccagggagtacccccactcgccccttcctcacctcgggcccccgccccgtctctttttcccaccctcatcgtgtccccacaacccccggacatccctcggccccgcgcccctgcggcaaagccacatctcccaccgacccactgccctgaggccgaacagccgggggtccctggccgggggcccggctctctcaccatcgcgggcgctggctgggccggaaagcggaagtacggaagtggccagccccgcgatgcctgccctttcgcgagaagcgcagctacggtctccgcccggacttccggacggtaccatctatgctccgagcggggtagagagcccttacgaacgcttgggccttccggaagttttccacctagggctgtctcggtatttttaaattcttgcactcgagtcactatttaagctcctccaggaatgggtgcagcttccctttgtgccttcggccttcttgtcacctttgccacagcctcccccaggtatgcaatggtacagcccagcttcagattgggcaccaaattaggacaagccgaagcggacgagcccttcgtttcttccggttctgtacccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggaggtaggtactattgttatccccatttttcagattcagacttttaatggggaaacagaccgagacttcttttgtccccattttacagatggaaaaactgagactgaaaaaggtcaaataacatgttcaggggcatataagtagagaatggtaaagcctgggcttgaacccaggtctgtctggcttaccagcccacgttctaaaccactgttagtgactagagaagggagaaaggtggaatagggtaagaaaagaggccaagagtcccagagaacatggtaagaatggggtgcttggaactcaaagtcttagcagaacccaagagaaatagaagggaaggaaagagcatcagaaaggcgaggcaaggcatagcagtatagcatggtgatcagggtgcagactcaagactagcggggttcaaattgcatcttggaagcataggcacatacccacccttacagagtctcagtttctttctctgtaaaaacgagatcacaatggtccttgttcatggtgctgagtgagaaattcagtgagataaactgataaagtgctctgcacctagcttggtacccagttaagtgccctgtgagtaggaactgtgccatcaattttgtcagtaagggactgaagctgggcttccttgaggctgtccctggaggtaagaagcccttgggcttttctcagaccactttgtctcccatcaatggccctgtcctctccagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccaggtgataaccccagagaggggccagcaccagagatggactgcaacaagttatgggatgggtcattgagttagccccatatgctgagacttggggtacaggggtttgtggggagagggagagagacgcaaactgggtttgcatgacacaaaaaatacacaagaatatgcatgatcctcttaaattgcaagatttctaattcagtaagcttttattggcaccccactcatcccccattgtgttctgggtcctatgctagtcattagagaaaggtaattaggacagttatggctgtcagggagcttggcaactaggaaagtgagaaagtcaagtacataccaggtgatgtgatgttgtggttagcagtcctagggaactggaatggggaaacctggatttgaatcctggcataagcgcttgctagcattgctgtttcctagctatgtgactttgagaaagttgcctcatatctctgagtgtcagtttccctatctgcaaagtggggtgaataataggacctaccttagtgcttttgtgaggattaaaagagaattttttgcaaaaactcagcccaatgccagacactaagtaagtacttcagatgttatttatttgctactctgatgactttattcactgcataaagatgccttgagccttgtgtgccaggcgctatgctgtattctgcaaaatagagatggttaaggtgggctttctggtcctcagtagcttatggtctagttgaagagacaaggtgtgatggtcattccagtgtgaccaaacaacacgattgggtgcacgttggagctgtgaagtgccagagacttgtggaggaaggaggtgccaactggacctaaaaggatgaatggaattaacttgtccctgggaatccatggaccctccttgaggaaggctatgactcaagttgtattttagcatctaagaacctgggtaactgattgagagaaggcatctcagtagtggtgacatcgaagtgaaggtttgctgagaggactcttctgttaaacagtatgtgactggcatgggtgatacagaagtgaatcagtatagatgaacaagtgaatgagattatgagaagtatatgaataaagttctaggaggccaggcacagaaaatgagctgaattttgaaggatgagtaagagtttactaggtaaaaagaggatggggaaagacccaggagcctctgtagattctagatcctaatttattcactagaggaaagagatattctgtgttttcccttctccccctcagtgacactttctgtaaatttcagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggctagagaacatagaagggggcctcaaggttctggtggtggaggcactggtggggcaggggcgcccactcaggatctgcttctccctgcaggttctgggcttcagtggagccctactgtgctgacatcaccagcgaggaggtccgcacacttgaggagttactgaagcccccagaagatgaggctgagcattacaaggtagaaactctgggccttgatagacatgatgcggaacaagagagttcagaggtgcctgagaagtaaagctaccaaagccatgcatcatcttccttccccaaccctgcccagtctgctgtctgctccatcagtgcctccagacacctaggcccaaactcagctttctccgtgcactgcctcccctctaccccagccaaatgtcaacacgccctcaagcatctacttaagtgaagtctgcccatgttcctttatccccatcccctctgctttggtccaagccttcatcaacttctatccaaacagcctcttaactctcttcctgtttcgaggcctctggaggaacctttcttctttctttaagatataaaacttgggctgggagcagtggcttatgcctgcaatcctagcactttgggaggccggggcgggcagattgcttgagctcaggaatttgagaccagcctgggcaacatggtgaaaccccatctctaccaaaatacaaaaaattagccaggcatggcggtgtgcgcctgtagtcccagctactcgggaggctgagtcaggaggatctcttggacccgggaggtggaagttgcagtgagccgagatcacgccactgcactccagcctgggcaacagagcaagactccgtctccaaaaaaaaaaaaaagatataaaagtcacctcacgcctgtaatcccaacactttgggaggctgtggcaggcagatcatctgaggtcaggagttcaagaccagcctgaccaacatggtgaaacgccgtctctactaaaaatacaaaaattagcctggcacggtggcatgcacctgtaatcctggctactcgggaggctgagccaggaaaatcacctgaactggggaggcatcggttgcaatgagccaagatcgtgccactgtattccagcctgggtgacagaaggagattccatccattaaaaaaaaaaaagccgggtgcggtggctcaagcctgtaatcccagccctttgggaggccgaggcgggcagatcacaaggtcaggagattgagaccatcctggctaacacggtgaaaccccgtctctactaaaaatagaaaaaattagccgggcgtggtggcgggcgcctgtagtcccagctgctcgggaggctaaggcaggagaatggcgtgaacccgggaggcggagcttgcagtgagctgagattgtgccactgcactccagcctgggtgacagagcaagactctgtctcaaaaaaaaaagaagatataaaactatgttttaatgatgaaaataaataaaacatgctccattaaagaaaatttagaaaatacagaaaaatgttgagggagaatcctcccataggtgagctgtcatgatcagatgtgctcatgacatggcgctgcatccaggcctttcttcctcccgttatctacaggatcaagtccacgcatcccagtccttgctggcacagctccagtgcccctctccattttcctcggccatatccctcttcattgccgtgttgaccagtcccaccaagtatctcgccctcattccaggacaccacagcctcctcgctggtctctgggcctctggcaagctcttctctccctcttgtctccttgacagacttgactcacccttcaaggccctgatctcatgttacctccaccaaagcactctttcagattccccagcagaaagttagtcagtctctcctttgtgctgccacaacactttgatctctctctttcacttcacttatctgatttcttaaaaatttatctgaaaaagagttcatacagacagcagtaaattcaagcaatacaaaaggtaattccctgtcacccgtgacctgaaggctcctaattctctcgagaggcaattgctgtgacctgagacaatctgtgtacgtattctgcaccttctatcttgggaattatttcagattggcttctgtgtgtgtgtcttagttctttttggacctgtctcccttactagagtgtgaagtacaggttttatcttcgttgtactttcttacctacacctgacactgggcttggccttggactagggacttgagagagatataagataggtaagtgaatgaatgaatgaagcatggctggccagtgcttacccactcagggttgggtgccatcttttccacagatcccacccctggggaagcactactcccagcgctgggcccaggaggacctgctggaggagcagaaggatggggcccgggcagcggctgtggctgacaagaagaaaggcctcatggggccactgaccgaactggacactaaaggtaggcctctcacctccctgccaaccccaggtcaggacttgaattccagaacttcagcccacctcccctcctttcctgtgcccgcttagatgtggatgccctgctgaagaagtctgaggcccagcatgaacagccggaagatggatgcccctttggtgccctgacgcagcgcctcctgcaggccctggtggaggtgagcagcctaacccaaaagaggaaccatatttactttgtgttttaatgtgttatgcttattttttatcggaatttatcatacatttattaggttggtgcaaaaataggttggtgcaaaagtaaaaacctggactaatatatagcaaaagattgggaataatatataacttgtgcacctaatagaaaagtgcacagatcataaatgtacagttttcacaaatgagcttgtattaccagcctggagattacaaaatgaaacattactatatcctagaagcccctctcatgcccctgtttttctccaactttccccaaaggtagccttactccacaattacttttgctaagcatctgttggaggggctttatacacatcctcccactggaggccaggacagtggttaacgctgtgttacagataagaagattgaggctcagaaaagggaactgttcacttgaggtctcacacaccaggattcaaaccctagcttcaggggccctgtctttatacctgctggttgaccttagacacaccctcacactctttcacctcattgagactcagttttctattctggctcaaacacaagagtttatctcatggaacagtctgggtacatgttgcaggttatctaaggtaggggaaggggcaggtctctatctcatatcatcagacaggggaccccagctgacggtggccttgcagtctgcccaaggtcactctgggcgtaattgtcactccagtcccacagaataagagcaaggaggccgggcgcggtggctcacgcctgtaatcccagcactttgggaggctgaggcgggcggatcacaaggtcaggagatcgagaccatcctggctaacatgatgaaaccccgtctctactaaaaatacaaaaaaattagccgggcatagtggcagggcgcctgtagtcccaactacttgggaggctgaggcaggagaatggcatgaacccaggaggcggagcttgcagtaagccgaaattgtgccactgcactccacagcctgggtgacaaagtgagactccatctcaaaaaaaaaaaacaaaacaaaacaaggaggagtgtgtgaaggaaactttttggcccatgcctagctatggctcttatctcttctgatcactttcccctggagagaacttgtcacatgaccatacccgcctgcaagagagcctgggaagtacaactggacaggcattgcctagctgccgtggaggaaagaagagtatggcattcggacagctagcatctccgccacagcaggcctagcacactgcctggtgcgttgcagacgcttcacaaaccttagctgttcattaccatcattgagtgttaatcatttctcttctgtgttcctttttcttcacatcagtacgaaaataaaagggatttctagaatgatcaaagcaatttgggattggtatgggaaggcttcccacggtaggtgggatgggaaagataaaaggatatttctggtgtttgaagactgtcagtgtaggtcagaaaggagcaggaaagtggaacagctatttttccttccactcatttttgtggtcttctaggaaaatattatttcccctatggaggattctcctattcctgacatgtctgggaaagaatcaggggctgacggggcaagcacctcccctcgcaatcagaacaagcccttcaggtgagtggtgtcctatccacaacccacagtctggcccccgcttctgttggcttctctccatctcaacctggggaagtcctcatcagtaagaggctgggggcagttaggtgaagcctaatagcagtctcaagtgtgagtgatgacccagcgtgtctgcatgcacagactgagtgcagggttgttcagcacagaactgttcataccataaataacccaaatgtcctgctgaaggggaatggttggctaaattggcataactccatatgatgaaataacttggggctattaatcatatagctgcaagtatagagaaatatagttaaatgacatgaaaagatgtaaattatagagtgacaagtggagaaaatattagttgtagcccagtatggatggtataatactatttttacttaaaatatatttctttttttctttttctttttttttttttgagatggagtctcgctcttgtcgtttaggttggagcgcaatggcgcaatcttggctcactgcaacctccgcctcccaggttcaagcgattctcctgcctcagccaccaagtagctgtgattacaggcgcctgccaccatgtatggctcatttttgtatttttagtagagacggggtttcaccatcttggccgggctggtcttgaactcctgacctcaggtgatcctcccacctcggccttccaaagtgctgggattacaggtgtgagccaccatgcctggcttacttacaatatatttaaatatgtgcacataagggaaaaaacctggactaatatgtagcaaaagattaggaataatatataacaaaatctggaatatatataataatatataacaaaataatagtaattctctctgggttgttggcattatgggtttttccatattttttgaatagtagatacatacgttgcttgttttaaaaaccagaccagatgtgtctgtccctccctttgtatctggatagatacagagggggtgcccaaagggaaaggcaggttttcactgaccttgggaagccctgggaacctccaaggtgggcccttctccaagctggctcttgagtctgacgggcctgcctcccgctgcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggtgagcgttagcaggatgcacagtcccgggggtggccttggaggctgtggccacggctagtcacctttcaggggttttacaacaggctttccaatcctggctggcctctaaatcacctggagagcctcgaaaaaaacagcagtggccagtccaccgggtatgtcccaaacaaattctgattccacagagtggggctcaggcatctgtgactgaccgattgatttgatttgtttttgttttgtttttttttgagagggagtctcgcactgtcacccaggctggagtgcagtggcatgatctcggctcactgcaagctccgcctcccaggttcatgccattctcctgcctcagcctcctgagtagctgatactacaggcacccaccaccacgcccagctaatttttttgtatttttagtagagacggggtttcaccgtgttagccaggatggtctcgatctcctgacctcgtgatccacccgcctcggcctcccaaagtgccgggattacaggcgtgagccactgcgcctggcctagtttggttttttaattatggtaaaggcataatataaaatgtatctccatgggaggctgaggcaggagaatcagttgaacctgggaggcggaggttgcagtgagctgagactgcaccattgcattccagcctgggcaacaagagtgaaactgcatctcaaaaaaaaaaagaaaaaaaatttacgcttcttaaccatttttaagtgtacagtttagtagtgttacccatattcacattgttgtgtgatttattttttgtcttttcatgcttcttttctttttatccccaaagttttgttattaaaaatttgatacacacagaaaatctgaaagaatcatacaataaacatcagtatattctccacctagactaattaactgttaacattttgttggagatctgtgatttttatttgctcatcacaagaaattgaccagtgttttaggacatgttcttttgggaatccatcacagtgcctgccattcatttgatgtcaactcccatccatcttgttctgcattgatcacgagggtataggtgacatcttgaggaagactgtggaatagctaccctttaggtaaagagatagggaagcaacccgaacaagtctctttgcttctcacagacaagtgctgtgtcttaacttcatagagccctgacaggacagggcacattcattcatttggccttttttttttttttttgagacggtgtctcactctgttgcccaggctggagtgcagtgccatgatctcggctcactgcaacctccgcctcccgggttcaggcagttctcctgcctcagcctcctgagtagttgggattacaggcatgcactaccatgccaggctaatcatttggccattcttactgtctcttagatattgtgctgggggccagcaagagaggcagagcaagggacttgcagattactagcagatgatcagtaaagataagtgccattaaaaggagaggtagttgctgacaagctgccagggtatttaaggataagagtgactaatgtatgctgagggcctactgtgtgtcaggggctttatgtacactctctcaagtgtcttgacaacaacccaggagggaggagctattttcgttgtttaccagatgaggaaataaaggcccagtgaagcgaaatgctctgctgaaggtcacacagtcaataaacagcaagctgagacttgaacctgtggttgaatcaaagcctctttctataatagtttgttttctctgaaaggtgagaagaagaaaacacagatggaagaggcactgagggaagcagagggagagagaggaagagagagaaaagcaggcatgtgcagttacagaagtagtgggccctagctgggcctggtggctcatgcctgtaatcccagcactttgggagactgaggtgggaggcttgtttgagctcaggagttcgaaactagcctgggcaatgtagtcagacccccttctctactaaaaatttttaaaaatcagctaggcatggtggcacatgcctatagtcctactcaggaggctgatgtgggaggattgcttgatcctgggaggtagaggctgcagtgagcttgatcaggcccctgtactccagcctgggtgacagagtgagacctgtctcaaaaaaaaaaaaaaaaaaaaanaangaagtaatgggcaatgaagaaatggcttgcagctctcaggaaaccagagcacagcccttaccctgctgcagagcagctgcaaggccttaagcagcccctgacctgagcatctccttccccttctggaaaactggcaggctggactcaatcactaagtgaccttccagctccaccatcgatgaaatgtataaatcagaccctgttcagagagattgatctggtgtctcacccacctcctgtcagcctcaggctgcctagaccttagggggctctggaatgcagatgccgacgtaagcaggccttctgctggcaccggaacacctgaaacaacagtgtttaaaaacaagagtttggccccagcctgctccagatctccccctcactaactgtgggatcctgggatcatctttgagcctcattttcctcacgggtaacatatgaataatagtacatattttgcagggttgttaggattaactgaaagacagagagagagagtgggtgtgcctgtgtgtgtgtgtttgtgtgtgtgtatgtatatatatatatattttagagacagggtcttactctgttgccgaggttggtctcaactcctggcttcaagtgatcttcctgcctccatctcccaaagcgctgggattacaggcatgagctactttgcccagcctactgtgtatatttttaagacctttttttttttgaagacacagtcacgctctgttgcccagactggagtgtagtggcatgatcatagttcactgtaaccttgaactcctggcctcaagcaatcctcagctcccttggagttgggactacaggtgtgcactaccacacccagctaattttttaaattttttgtagagacagtctcactatgttgctcagactggtctcgaactcctgggctcaagtgatccttctgccttgggctcccaaagtgctgggactgcagatgtgaacccccatgtgcagccaagactttattcttctagagcagttttaagttcacaacaaaattgagagaaaggtacagagaattcccgtatctccctgtccccacatgtgcacagcctcccccgtgatcaacatgagttaatatttttcaggagcttaagatagtgccatgtaagtgtaggtcagtaactgctttttggtcacgactgtatgacacaatccacaggcatgccagcctgggctggtgggtaggctcggtcttgaagagggaggggttgttctctggaggtgggctgaccctggcacctggctggctggtccccacaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccgtggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttcaaaaaaagca

SEQ ID NO: 7975 - DNA, 1708 bp, Homo sapiens
caccctgcagctggagctggagaccctgctgtcttctgccagccggcgcctgcgtgtgcttgaggccgaaacccaggtgataaccccagagaggggccagcaccagagatggactgcaacaagttatgggatgggtcattgagttagccccatatgctgagacttggggtacaggggtttgtggggagagggagagagacgcaacttgggtttgcatgacacaaaaaatacacaagaatatgcatgatcctcttaaattgcaagatttctaattcagtaagcttttattggcaccccactcatcccccattgtgttctgggtcctatgctagtcattagagaaaggtaattaggacagttatggctgtcagggagcttggcaactaggaaagtgagaaagtcaagtacataccaggtgatgtgatgttgtggttagcagtcctagggaactggaatggggaaacctggatttgaatcctggcataagcgcttgctagcattgctgtttcctagctatgtgactttgagaaagttgcctcatatctctgagtgtcagtttccctatctgcaaagtggggtgaataataggacctaccttagtgcttttgtgaggattaaaagagaattttttgcaaaaactcagcccaatgccagacactaagtaagtacttcagatgttatttatttgctactctgatgactttattcactgcataaagatgccttgagccttgtgtgccaggcgctatgctgtattctgcaaaatagagatggttaaggtgggctttctggtcctcagtagcttatggtctagttgaagagacaaggtgtgatggtcattccagtgtgaccaaacaacacgattgggtgcacgttggagctgtgaagtgccagagacttgtggaggaaggaggtgccaactggacctaaaaggatgaatggaattaacttgtccctgggaatccatggaccctccttgaggaaggctatgactcaagttgtattttagcatctaagaacctgggtaactgattgagagaaggcatctcagtagtggtgacatcgaagtgaaggtttgctgagaggactcttctgttaaacagtatgtgactggcatgggtgatacagaagtgaatcagtatagatgaacaagtgaatgagattatgagaagtatatgaataaagttctaggaggacaggcacagaaaatgagctgaattttgaaggatgagtaagagtttactaggtaaaaagaggatggggaaagacccaggagcctctgtagattctagatcctaatttattcactagaggaaagagatattctgtgttttcccttgtccccctcagtgacactttctgtaaatttcagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggctagagaacatagaagggggcctcaaggttctggtggtggaggcactggtggggcaggggcgcccactcaggatctg

SEQ ID NO: 7976 - DNA, 16342 bp, Homo sapiens
  misc_feature (12770)..(12771): n equals a,t,g, or c
cctgacttccacttccggcttgttgtgtcgttccacaacctgggaggagaagttctccaggcagagggcagcctgcaatgtggcccgcacggcactcaggtaggggcggagagtggcagtctataggaaataacacagaggaaagggaagatcaaaatctgtcacgccaaacccaccgatcccctattccagctcccatgaagccaggtagcactgagggtgcaaggctcttaagacactactgtgaacagaacagactaggccttcgagacgccttccaaggtgtagagtggtagttttcaacaggagacaattttgcctgccagggtacatttggtaatgtcgagacatttcctttctttcttttttaacctggggtcagaccagaggaatgctgagacattttcaattgtcatgacttggcaagaacgggaactggaagcattcagtggacagatatccactaaacatactacaatgcactacatgcaatatcgagactcaaatatcaatagagctcacggagataaagggatctctacacccaccagtgaatgcatgattgccgtcaatctattatgccaacaaatgtataggtgtactgtttgccactcactgagctaactgggaattcaaagatgattaacactgtctctaccctcaaacagctcaactggatagcaaatatacagaaaataactatgatataaagatgacatgtgaaatatttagatttacaagtaatctatatttgcagaagaaactggttttgaaggtgaaatgggattaggaggagaaaaaggagaataaggacattctttttttttttttttttttgagacagagtctcgctctgttgcccaggctggagcgcggtggcacgatctcggctcactgcaagctccacctcccgggttcatgcccttctcctgcctcagcctcccaagtagctgggactacaggcgcccaccaccacacccggctaactttttgtatttttagtagagacagggtttcacggtgttagccaggatggtctcaatctcctgaccttgtaatctgcccgccttggcctcccaaagtgctgggtttacaggcgtgagccaccacaccctgccagaataaggacattcttaggagagggattagcttctagctgcactggtcagtccttgtatcagccaaattctttcccacctcagagctttacacatgcttgaccatctatctgtaagcttttctcctctttctttggctaagtcatctccagatctcagcttaattaaggaaggccttttgacagagaccttgaaattcccctataaagtattaattaccattgacaaaaaactgttttcatgtttccttaatattatctttgcaagggattttccttctggcaccctcctggaatcgaatggaagattcttgtctcagcaatacccgcgtcctgtgttaaacaactttctctgctcaatctcccggttaatctccttccacgcgctctcaaaccctccagcctgggtgacagagcgagactgtgtcttaaaaaaaaagaaaaagaaaaaccacttccaacgaactgtggtccagccattcaattaactactacttggtaataaaaaaagagtaactattgatacacacaacatggttgactctcaaatgtattatggtaagaagccacacttaaaagcctgcatactaaagaattccatttacatgacaatctgaaaaaggcaaaactacaggggggaaaaatcagtagttgtctggggtgggaaggagaggactgattacaaaagggcttgagggaactttttggggtgacggaaatgttctgtattttggttgcagtagtggttacacaacttgactttttttttttaagacacgggatcttgctatattgtccaggctgaagtgcagtggctattcacaggagtgatcacagtgtactacggcctcgaacttctgggctcaagtgatcctcctgcctcagtgtcctgagcggatggtactacaggcgcatgccaccatacccagcaagtttttgcaacgcttttttttttgagacggagtcttactctgttgcccagtctggtgtgcagtggcacgatctcgactcactgcaagctctgctttctgggttcacgccattctcctgcctcagcctcctgagtagctgggactacaggtgcccaccaccacgcccggctaattttttgcatttttagtagagaagaggtttcaccgtgttagccaggatggtctcgatctcctgacgtcgtgatccgcccgcctctgcctcccaaagtgctgggattacaagcgtgagccaccacgcctggcctttgtcaacagttatagaaagtaaacctaaaaagggtgactggctccgtgacgcctgtcctttcatgaataaaacagatgtagtctcatgtaatacctcaataaacttgaacttttaaaaatcaagaggcatgtgccccactagaaaaaaaaaatacagatttttagcagagacatgaggtcacaaaagtttgccaggatagggaacccaggaggaagaacaaatttagaatagaatatgagttttgaactagaggtctaatttcaaggtctcttcaagatatccaggcaaaccttgaaagagagctgagaagccagattaggagtcatcagaatgaagaaagttatcgaagccaggagactagatcggtatcaccagggaaggtgtgacgaagagggagatggtcatccaaagtcacaactcccaggaatgcccacacgtatgaaaaaggcccacatgtatgaaaaaggcccacatgtatgaaaaagggaggacttccaggaagggagggatgagcagtatcacagctaacatacactaaggctgacacagttcagttctgaccaggaagggcctgaatggaagcaacacgagagatcctccaatggggtggaagcagggctggaggtaccaagaatgggataaggaagtgtggccgcctgccttaagcaactgtagggtcaggaaggcagaagaggacaaagggcgtatgtcgtgaagttccactgtggataggcaggtggacttgcttcatgcctcagaggctaagaggccgactacgtaccctcgaaatgctccaaagagcctaggagaccccacttccgggttcctacagggctcaggaaaagcccctacctgcttcgaaggctgaccgtgaagccacaaggcccacttcataccagggagtacccccactcgccccttcctcacctcgggcccccgccccgtctctttttcccaccctcatcgtgtccccacaacccccggacatccctcggccccgcgcccctgcggcaaagccacatctcccaccgacccactgccctgaggccgaacagccgggggtccctggccgggggcccggctctctcaccatcgcgggcgctggctgggccggaaagcggaagtacggaagtggccagccccgcgatgcctgccctttcgcgagaagcgcagctacggtctccgcccggacttccggacggtaccatctatgctccgagcggggtagagagcccttacgaacgcttgggccttccggaagttttccacctagggctgtctcggtatttttaaattcttgcactcgagtcactatttaagctcctccaggaatgggtgcagcttccctttgtgccttcggccttgttgtcacctttgccacagcctcccccaggtatgcaatggtacagcccagcttcagattgggcaccaaattaggacaagccgaagcggacgagtctttcgtttcttccggttatgaacccccatctctttctctcgcccttcttacccgcagctcctggcgctcagtggggctaactgcagtgcggagatcctcggacgccaagctccgccttccgccccgggctgtgccccggggctcgcatgagcccgtccattcgcaccccacctctagcggctttgctcgtggcccaccttcttcccacccccggtaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacagctgaactgggctcttgacgggcatcatctcttaatcctcagaacatcccagggaggtaggtactattgttatccccatttttcagattcagacttttaatggggaaacagaccgagacttcttttgtccccattttacagatggaaaaactgagactgaaaaaggtcaaataacatgttcaggggcatataagtagagaatggtaaagcctgggcttgaacccaggtctgtctggcttaccagcccacgttctaaaccactgttagtgactagagaagggagaaaggtggaatagggtaagaaaagaggccaagagtcccagagaacatggtaagaatggggtgcttggaactcaaagtcttagcagaacccaagagaaatagaagggaaggaaagagcatcagaaaggcgaggcaaggcatagcagtatagcatggtgatcagggtgcagactcaagactagcggggttcaaattgcatcttggaagcataggcacatacccacccttacagagtctcagtttctttctctgtaaaaacgagatcacaatggtccttgttcatggtgctgagtgagaaattcagtgagataaactgataaagtgctctgcacctagcttggtacccagttaagtgccctgtgagtaggaactgtgccatcaattttgtcagtaagggactgaagctgggcttccttgaggctgtccctggaggtaagaagcccttgggcttttctcagaccactttgtctcccatcaatggccctgtcctctccagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccaggtgataaccccagagaggggccagcaccagagatggactgcaacaagttatgggatgggtcattgagttagccccatatgctgagacttggggtacaggggtttgtggggagagggagagagacgcaaactgggtttgcatgacacaaaaaatacacaagaatatgcatgatcctcttaaattgcaagatttctaattcagtaagcttttattggcaccccactcatcccccattgtgttctgggtcctatgctagtcattagagaaaggtaattaggacagttatggctgtcagggagcttggcaactaggaaagtgagaaagtcaagtacataccaggtgatgtgatgttgtggttagcagtcctagggaactggaatggggaaacctggatttgaatcctggcataagcgcttgctagcattgctgtttcctagctatgtgactttgagaaagttgcctcatatctctgagtgtcagtttccctatctgcaaagtggggtgaataataggacctaccttagtgcttttgtgaggattaaaagagaattttttgcaaaaactcagcccaatgccagacactaagtaagtacttcagatgttatttatttgctactctgatgactttattcactgcataaagatgccttgagccttgtgtgccaggcgctatgctgtattctgcaaaatagagatggttaaggtgggctttctggtcctcagtagcttatggtctagttgaagagacaaggtgtgatggtcattccagtgtgaccaaacaacacgattgggtgcacgttggagctgtgaagtgccagagacttgtggaggaaggaggtgccaactggacctaaaaggatgaatggaattaacttgtccctgggaatccatggaccctccttgaggaaggctatgactcaagttgtattttagcatctaagaacctgggtaactgattgagagaaggcatctcagtagtggtgacatcgaagtgaaggtttgctgagaggactcttctgttaaacagtatgtgactggcatgggtgatacagaagtgaatcagtatagatgaacaagtgaatgagattatgagaagtatatgaataaagttctaggaggccaggcacagaaaatgagctgaattttgaaggatgagtaagagtttactaggtaaaaagaggatggggaaagacccaggagcctctgtagattctagatcctaatttattcactagaggaaagagatattctgtgttttcccttctccccctcagtgacactttctgtaaatttcagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggctagagaacatagaagggggcctcaaggttctggtggtggaggcactggtggggcaggggcgcccactcaggatctgcttctccctgcaggttctgggcttcagtggagccctactgtgctgacatcaccagcgaggaggtccgcacacttgaggagttactgaagcccccagaagatgaggctgagcattacaaggtagaaactctgggccttgatagacatgatgcggaacaagagagttcagaggtgcctgagaagtaaagctaccaaagccatgcatcatcttccttccccaaccctgcccaggctgctgtctgctccatcagtgcctccagacacctaggcccaaactcagctttctccgggcactgactcccctctaccccagccaaatgtcaacacgccctcaagcatctacttaagtgaagtctgcccatgttcctttatccccatcccctctgctttggtccaagccttcatcaacttctatccaaacagcctcttaactctcttcctgtttcgaggcctctggaggaacctttcttctttctttaagatataaaacttgggctgggagcagcggcttatgcctgcaatcctagcactttgggaggccggggcgggcagattgcttgagctcaggaatttgagaccagcctgagcaacatggtgaaaccccatctctaccaaaatacaaaaaattagccaggcatggcggtgcgcgcctggagtcccagctactcgggaggctgagtcaggaggatctcttggacccgggagggggaaggttgcatgagccgagaacacgccactgcactccacgctgggcacaagaacaagactctctctccaaaaaaaaaaaaaagatataaaagtcacctcacgcctgtaatcccaacactttgggaggctgtggcaggcagatcatctgaggtcaggagttcaagaccagcctgaccaacatggtgaaacgccgtctctactaaaaatacaaaaattagcctggcacggtggcatgcacctgtaatcctggctactcgggaggctgagccaggaaaatcacctgaactggggaggcatcggttgcaatgagccaagatcgtgccactgtattccagcctgggtgacagaaggagattccatccattaaaaaaaaaaaagccgggtgcggtggctcaagcctgtaatcccagccctttgggaggccgaggcgggcagatcacaaggtcaggagattgagaccatcctggctaacacggtgaaaccccgtctctactaaaaatagaaaaaattagccgggcgtggtggcgggcgcctgtagtcccagctgctcgggaggctaaggcaggagaatggcgtgaacccgggaggcggagcttgcagtgagctgagattgtgccactgcactccagcctgggtgacagagcaagactctgtctcaaaaaaaaaagaagatataaaactatgttttaatgatgaaaataaataaaacatgctccattaaagaaaatttagaaaatacagaaaaatgttgagggagaatcctcccataggtgagctgtcatgatcagatgtgctcatgacatggcgctgcatccaggcctttcttcctcccgttatctacaggatcaagtccacgcatcccagtccttgctggcacagctccagtgcccctctccattttcctcggccatatccctcttcattgccgtgttgaccagtcccaccaagtatctcgccctcattccaggacaccacagcctcctcgctggtctctgggcctctggcaagctcttctctccctcttgtctccttgacagacttgactcacccttcaaggccctgatctcatgttacctccaccaaagcactctttcagattccccagcagaaagttagtcagtctctcctttgtgctgccacaacactttgatctctctctttcacttcacttatctgatttcttaaaaatttatctgaaaaagagttcatacagacagcagtaaattcaagcaatacaaaaggtaattccctgtcacccgtgacctgaaggctcctaattctctcgagaggcaattgctgtgacctgagacaatctgtgtacgtattctgcaccttctatcttgggaattatttcagattggcttctgtgtgtgtgtcttagttctttttggacctgtctcccttactagagtgtgaagtacaggttttatcttcgttgtactttcttacctacacctgacactgggcttggccttggactagggacttgagagagatataagataggtaagtgaatgaatgaatgaagcatggctggccagtgcttacccactcagggttgggtgccatcttttccacagatcccacccctggggaagcactactcccagcgctgggcccaggaggacctgctggaggagcagaaggatggggcccgggcagcggctgtggctgacaagaagaaaggcctcatggggccactgaccgaactggacactaaaggtaggcctctcacctccctgccaaccccaggtcaggacttgaattccagaacttcagcccacctcccctcctttcctgtgcccgcttagatgtggatgccctgctgaagaagtctgaggcccagcatgaacagccggaagatggatgcccctttggtgccctgacgcagcgcctcctgcaggccctggtggaggtgagcagcctaacccaaaagaggaaccatatttactttgtgttttaatgtgttatgcttattttttatcggaatttatcatacatttattaggttggtgcaaaaataggttggtgcaaaagtaaaaacctggactaatatatagcaaaagattgggaataatatataacttgtgcacctaatagaaaagtgcacagatcataaatgtacagttttcacaaatgagcttgtattaccagcctggagattacaaaatgaaacattactatatcctagaagcccctctcatgcccctgtttttctccaactttccccaaaggtagccttactccacaattacttttgctaagcatctgttggaggggctttatacacatcctcccactggaggccaggacagtggttaacgctgtgttacagataagaagattgaggctcagaaaagggaactgttcacttgaggtctcacacaccaggattcaaaccctagcttcaggggccctgtctttatacctgctggttgaccttagacacaccctcacactctttcacctcattgagactcagttttctattctggctcaaacacaagagtttatctcatggaacagtctgggtacatgttgcaggttatctaaggtaggggaaggggcaggtctctatctcatatcatcagacagggaccccagctgacggtggccttgcagtctgcacaaggtcactctgggcgtaattgtcactccagtcccacagaataagagcaaggaggccgggcgcggtggctcacgcctgtaatcccagcactttgggaggctgaggcgggcggatcacaaggtcaggagatcgagaccatcctggctaacatgatgaaaccccgtctctactaaaaatacaaaaaaattagccgggcatagtggcaggcgcctgtagtcccaactacttgggaggctgaggcaggagaatggcatgaacccaggaggcggagcttgcagtaagccgaaattgtgccactgcactccacagcctgggtgacaaagtgagactccatctcaaaaaaaaaaaacaaaacaaaacaaggaggagtgtgtgaaggaaactttttggcccatgcctagctatggctcttatctcttctgatcactttcccctggagagaacttgtcacatgaccatacccgcctgcaagagagcctgggaagtacaactggacaggcattgcctagctgccgtggaggaaagaagagtatggcattcggacagctagcatctccgccacagcaggcctagcacactgcctggtgcgttgcagacgcttcacaaaccttagctgttcattaccatcattgagtgttaatcatttctcttctgtgttcctttttcttcacatcagtacgaaaataaaagggatttctagaatgatcaaagcaatttgggattggtatgggaaggcttcccacggtaggtgggatgggaaagataaaaggatatttctggtgtttgaagactgtcagtgtaggtcagaaaggagcaggaaagtggaacagctatttttccttccactcatttttgtggtcttctaggaaaatattatttcccctatggaggattctcctattcctgacatgtctgggaaagaatcaggggctgacggggcaagcacctcccctcgcaatcagaacaagcccttcaggtgagtggtgtcctatccacaacccacagtctggcccccgcttctgttggcttctctccatctcaacctggggaagtcctcatcagtaagaggctgggggcagttaggtgaagcctaatagcagtctcaagtgtgagtgatgacccagcgtgtctgcatgcacagactgagtgcagggttggtcagcacaaaactgttcataccataaattaaccaaaaggtcctgttgaaggggaatgttggctaaattggcataactccatatgatgaaataacttggggctataaatcatatatctgcaagtatatagaaatatagttaaatgacatgaaaagatgtaaattatagagtgacaagtggagaaaatattagttgtagcccagtatggatggtataatactatttttacttaaaatatatttctttttttctttttctttttttttttttgagatggagtctcgctcttgtcgtttaggttggagcgcaatggcgcaatcttggctcactgcaacctccgcctcccaggttcaagcgattctcctgcctcagccaccaagtagctgtgattacaggcgcctgccaccatgtatggctcatttttgtatttttagtagagacggggtttcaccatcttggccgggctggtcttgaactcctgacctcaggtgatcctcccacctcggccttccaaagtgctgggattacaggtgtgagccaccatgcctggcttacttacaatatatttaaatatgtgcacataagggaaaaaacctggactaatatgtagcaaaagattaggaataatatataacaaaatctggaatatatataataatatataacaaaataatagtaattctctctgggttgttggcattatgggtttttccatattttttgaatagtagatacatacgttgcttgttttaaaaaccagaccagatgtgtctgtccctccctttgtatctggatagatacagagggggtgcccaaagggaaaggcaggttttcactgaccttgggaagccctgggaacctccaaggtgggcccttctccaagctggctcttgagtctgacgggcctgcctcccgctgcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggtgagcgttagcaggatgcacagtcccgggggtggccttggaggctgtggccacggctagtcacctttcaggggttttacaacaggctttccaatcctggctggcctctaaatcacctggagagcctcgaaaaaaacagcagtggccagtccaccgggtatgtcccaaacaaattctgattccacagagtggggctcaggcatctgtgactgaccgattgattnngattgttttttttttttttttttttgaggcggagtctcgctctgtcgcccaaggctggagtgtagtcgtgcgatctcggctcactgcaagctccgcctcccgggttcacgccattctcctgcctcagcctcccgagtagctgggactacaggcgcccgccaccacgcccggctaattttttgtatttttagtagagaccgggtttcaccgtgttagccaggatggtctcgatcttctgacctcgtgatccacccgcctcggcctcccaaagtgccgggattacaggcgtgagccactgcgcccggcctagtttggttttttaattatggtaaaggcataatataaaatgtatctccatgggaggctgaggcaggagaatcagttgaacctgggaggcggaggttgcagtgagctgagactgcaccattgcattccagcctgggcaacaagagtgaaactgcatctcaaaaaaaaaaagaaaaaaaatttacgcttcttaaccatttttaagtgtacagtttagtagtgttacccatattcacattgttgtgtgatttattttttgtcttttcatgcttcttttctttttatccccaaagttttgttattaaaaatttgatacacacagaaaatctgaaagaatcatacaataaacatcagtatattctccacctagactaattaactgttaacattttgttggagatctgtgatttttatttgctcatcacaagaaattgaccagtgttttaggacatgttcttttgggaatccatcacagtgcctgccattcatttgatgtcaactcccatccatcttgttctgcattgatcacgagggtataggtgacatcttgaggaagactgtggaatagctaccctttaggtaaagagatagggaagcaacccgaacaagtctctttgcttctcacagacaagtgctgtgtcttaacttcatagagccctgacaggacagggcacattcattcatttggccttttttttttttttttgagacggtgtctcactctgttgcccaggctggagtgcagtgccatgatctcggctcactgcaacctccgcctcccgggttcaggcagttctcctgcctcagcctcctgagtagttgggattacaggcatgcactaccatgccaggctaatcatttggccattcttactgtctcttagatattgtgctgggggccagcaagagaggcagagcaagggacttgcagattactagcagatgatcagtaaagataagtgccattaaaaggagaggtagttgctgacaagctgtcagggtatttaaggataagagtgactaatgtatgctgagggcctactgtgtgtcaggggctttatgtacactctctcaagtgtcttgacaacaacccaggagggaggagctattttcgttgtttaccagatgaggaaataaaggcccagtgaagcgaaatgctctgctgaaggtcacacagtcaataaacagcaagctgagacttgaacctgtggttgaatcaaagcctctttctataatagtttgttttctctgaaaggtgagaagaagaaaacacagatggaagaggcactgagggaagcagagggagagagaggaagagagagaaaagcaggcatgtgcagttacagaagtagtgggccctagctgggcctggtggctcatgcctgtaatcccagcactttgggagactgaggtgggaggcttgtttgagctcaggagttcgaaactagcctgggcaatgtagtcagacccccttctctactaaaaatttttaaaaatcagctaggcatggtggcacatgcctatagtcctactcaggaggctgatgtgggaggattgcttgatcctgggaggtagaggctgcagtgagcttgatcaggccactgtactccagcctgggtgacagagtgagacctgtctcaaaaaaaaaaaaaaaaaaaaaaaaagaagtaatgggcaatgaagaaatggcttgcagctctcaggaaaccagagcacagcccttaccctgctgcagagcagctgcaaggccttaagcagcccctgacctgagcatctccttccccttctggaaaactggcaggctggactcaatcactaagtgaccttccagctccaccatcgatgaaatgtataaatcagaccctgttcagagagattgatctggtgtctcacccacctcctgtcagcctcaggctgcctagaccttagggggctctggaatgcagatgccgacgtaagcaggccttctgctggcaccggaacacctgaaacaacagtgtttaaaaacaagagtttggccccagcctgctccagatctccccctcactaactgtgggatcctgggatcatctttgagcctcattttcctcacgggtaacatatgaataatagtacatattttgcagggttgttaggattaactgaaagacagagagagagagtgggtgtgcctgtgtgtgtgtgtttgtgtgtgtgtatgtatatatatatatattttagagacagggtcttactctgttgccgaggttggtctcaactcctggcttcaagtgatcttcctgcctccatctcccaaagcgctgggattacaggcatgagctactttgcccagcctactgtgtatatttttaagacctttttttttttgaagacacagtcacgctctgttgcccagactggagtgtagtggcatgatcatagttcactgtaaccttgaactcctggcctcaagcaatcctcagctcccttggagttgggactacaggtgtgcactaccacacccagctaattttttaaattttttgtagagacagtctcactatgttgctcagactggtctcgaactcctgggctcaagtgatccttctgccttgggctcccaaagtgctgggactgcagatgtgaacccccatgtgcagccaagactttattcttctagagcagttttaagttcacaacaaaattgagagaaaggtacagagaattcccgtatctccctgtccccacatgtgcacagcctcccccgtgatcaacatgagttaatatttttcaggagcttaagatagtgccatgtaagtgtaggtcagtaactgctttttggtcacgactgtatgacacaatccacaggcatgccagcctgggctggtgggtaggctcggtcttgaagagggaggggttgttctctggaggtgggctgaccctggcacctggctggctggtccccacaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggg

SEQ ID NO: 7977 - DNA, 22129 bp, Homo sapiens
aatttttgtatttttaatagagatggggtttcaccatgttggccaggctggtcttgaactcctgacctcatgatccacccacctcggcctcccaaagtgttgggattagaggcatgagccaccacgcccggctcttttttgccttttctatggctgaggtagacccaacttttcctaagcttctaatcctctttgctcccactccaagatgaaggccaactctcaattcaggcagtgggtgccaaacagctggagtagctggttctagaaacaatcccaggccattctgtaacagggtcctgggtatcgcaaactcatgggtcacagggtctcacctccacaggcttccttcgaaggataaagaagttctctgctcgcatcatcatgaagcgcatgaacttgtggcacaaaatcttctcgatctcatcagcctggggagtgcaagagagaaatgtttctctaaagctgacacccaaggccaaaaacaccttgtagcctggtcttctgactccagttttttcaaggctcccaggagacagtgaggtttggtactcggaaggatcactgaagtgggggacctggctgtcaactgaaacaagggtctaccttggggcatctcttaatgacgacccattccagagaggtaattctgacaggcttctattgcttctttcagagtctacagctgtactccaagctgccctttccattctcatttcactagtgtcacatttcccagggtgttttgcagcatcacctgggctatcagagataaccttaggtggtctctgctttaataacactgaacatccaacaatccctgaagtttctcccttctgaatgctcaacatttctttttttttttttttttttttttttctgagatggaatctcgctctgtcacccaggctggagtgcagtggtacgattttgactcactgtaagctctgcctcccgggttcaagcgattctcctgcctcagcctcccaagtagctgggattacaggcgcgtgccaccacgcctggctaatttctgtatttttagtagagacagggttttaccatgttggccaggctggtcttgaactcctgacatcaagtgatccacccgccttggtctcccaaagtgctgggattacaggcatgagccactgtgcctggccctgaactctcaacatttctaaaggaagattattgctgctggttgctagcatgcccttaacacctctcaacacttgttaacctcccattttagcaaggaaagcaggccccaggtttataagtttctgtagaaaacagtgtgtagtctgcatttaataacagtgcttcgttttcatcctgttgaaagtttagagttgccctctactggccaggcatggtggctcatgactgtaatcccagtactttgggaggttgaggcgggcccatcacctgcggtcaggagatggagaccatcctggcaaacatggtgaaactctgtctctactaaaaatacaaaaattaactgggcgtggtggcggatgcctgtaatcccagctacttgggagactgagacagaagaactgcttgaacccgggaggcagaggttgcagtgagctgagatcatgctgctgcactccagcctgggcgacaagagtgagaatccgtgtcaaaaaaaaaggaagcagaggctaggtttcctgcactctgaatctggaatctggcacactgatctctcagatggggaccccggactgaaagaggctgaaaggactgaaagaggccttacgttgggcctcctccatggtgaacttacctgtttcacagcaatgctgacccggacagagttgatggagccctcaatcagaaccttttccttctcattcctgctgatggtcacaggttgtaacaggagctctttgctactcctgaaaacataatgtgacagagtacttgtactacagagggatagaatagtcagagtgaccccacgcaggtcctggaatcactatgagaccatagagtccaaggaatagaagactcacaagcaggagtgctccaagatgggggccagtgagtgtgttcttcagcagaaagagcacaggctctgaagtcagggcgaaaaggttttgaaatccagcctcctctgttactttccttgggcaagttaccctgttggaatctcaattttctcatctgtaaaatgactctgattcctaattcactggcgaggactgagagagatcaaaaagggtcaaatgtctaatagcgtgcctggcacatagtaggagctttacaaaagatagctattttagtaactacaagttgaacatccccaatctgcaaatctgaaatccaaaatctgaaactggctgggcacagtggctcatgcctgtaatcccagcactttgagaggctgaggctggtggatcacctgaggtcaggagttcgagaccagcctggccaacatggtgatatcccatttgtactaaaaatataaaaattagctgggcatggtggcgcactcctataatcccagatactcaggaggctgaagcacgagaattgctcgaactcaggaggtggcagttgcagtgagccaagatcataccactgtactccagcctgggtgacagaatcaaactccatctcaaaaaaaaaaaaaaacctgaaagtttccgagtgctgacaagatgctcaaaggagatcctcattggagcattttggatttggaattagggatgctcaactggttaagtatctgcaaatattccacaatctgaaatacttttggtcccaagcattttggataagagatactcaacctgtacaggcaaaccaatataccatttaggaatacagagagaacacctgtcttagaggtaaggaaaggctaaaattgaacacagtttggcttcctttaattatcaatccagaaatgattcatttgcctctgagacccctatgagttcaggttacaaagtaatgcctctgaatacctagagatctctaatagtaattaattgtggtgtggtgtctctaaactgctaaccattttcaaaggcccactggaaatcgtgtacgttacacagtataacagggcatatcctaacatctttatcagttatttttaaaattaaaaattaaatcgtatcatttaatgttgtaacccagattatctcagttatgtatgtaccagaatgaattttattttattttattttattttattttatttttgagacgaagtcttgctctgctgccaggctggagtgcggtggcacgatcttggctcactgcaacctccgcctcccaggttcaagcaattctcctgcctcagcctcccgagtagctgggactacaggtgcataccaccatgcccagcttatttttgtatttttagtagagacaaggtttcaccatgttggccaggatgctctcgatctcttgacctcataatctgtctgcctcggcctcccaaagtgctgggattacaggcgtgagccactgtgcccggcctatttacttattttttgagacagggtctcacccaggctggagtgcactgtcgcaatgttggctcattgcaacctctgcttcccaggctcaagagatcctcctgcctcagcctccagagaagtgggactacaggcatgtgccaccatgcctgactatttttgcatatttttttggtagagatggagtcttgccatgttgcccaggctggtcttgaactcctgtactcaagcgatctacccacttcagcctcctaaagtgctcggattacaggggtgaaccactgcaccaggcctccagattaaattttaaaggggaaaaagatatttatgaaatggaaactagataagagaaaatcattcaaaatatgaagtatttggattagggggtcagagtgtctaggctggtaggtaaaaaaaaaatccctgatcattacattagaaaagtatggagatgggaaaaaaaaaaaaaaaaaagaaaagtatggagatggaatctcagataacaattatctgaccattccttaaactaccagtgttttcaacaatgccacaggagagacttcatcaacagccctgctctgagaagtcataccttgtgttaaccaatcttgtcttttcccctgggttctgtcctgccaacccactgaccctattttcttaactccaaattgggaatcaccattcagctggcagcaagacaaaatgtcaactgcagctttcctgactactgcaggacataagttcatggcaccttctagacagcagccatctctgtgtgctgcacccctcatccccaccttgacttgtccttccctacctgacttccacttccggcttgttgtgtcgttccacaacctgggaggagaagttctccaggcagagggcagcctgcaatgtggcccgcacggcactcaggtaggggcggagagtggcagtctataggaaataacacagaggaaagggaagatcaaaatctgtcacgccaaacccaccgatcccctattccagctcccatgaagccaggtagcactgagggtgcaaggctcttaagacactactgtgaacagaacagactaggccttcgagacgccttccaaggtgtagagtggtagttttcaacaggagacaattttgcctgccagggtacatttggtaatgtcgagacatttcctttctttcttttttaacctggggtcagaccagaggaatgctgagacattttcaattgtcatgacttggcaagaaggggaactgcaggcattcagtggacagatatccactaaacatactacaatgcactacaaagaattatcgagactcaaatatcaatagtgctaaggttgagaaagtgatctagagacacaccagtgaatgcatgattgtcgtcaatctattaggccaacaaatgtataggtgtactgtttgccacgcactgagctaactgggaattcaaagatgattaacactgtctctaccctcaaacagctcaactggatagcaaatatacagaaaataactatgatataaagatgacatgtgaaatatttagatttacaagtaatctatatttgcagaagaaactggttttgaaggtgaaatgggattaggaggagaaaaaggagaataaggacattctttttttttttttttttttgagacagagtctcgctctgttgcccaggctggagcgcggtggcacgatctcggctcactgcaagctccacctcccgggttcatgcccttctcctgcctcagcctcccaagtagctgggactacaggcgcccaccaccacacccggctaactttttgtatttttagtagagacagggtttcacggtgttagccaggatggtgctcaatctcctgaccttgtaatctgcccgccttggcctcccaaagtgctgggtttacaggcgtgagccaccacaccctgccagaataaggacattcttaggagagggattagcttctagctgcactggtcagtccttgtatcagccaaattctttcccacctcagagctttacacatgcttgaccatctatctgtaggcttttctcctctttctttgcctaagtcatcctccagatctcagcttaattaaggaaggcctcttgagagagaccttgacatccccctataaagtatttattacaattgacaaaaaaatgtctttcatgtcttcttaatatttatttttgagagggagtctcgcttctgtcaccctcgctggagtgcagtggcacgatctctgctcacggcaatcgccgcctcctgggttaaagcgattctcctgcttcagcctcccgagtagctgggattacaggcgcacatcaccatgcctggctaatttttgtatttttagtagagacggagtttcaccgtgttggtcaggcttgtcttgaaatcctgacctcaggcaatccgcccacctcggcctctcaaagtgttgggattacaggcgtgagccaacgtgcctggccttttttatttttttttgagacagagtcttactctgttgtccaggctggagcgcagtggtgcaatcttggctcactgcaacctccacctcccgggttcaagtgattcacctgcctcagccatgcgaatagctgagatgacaagtgtgcaccaccgtgcctggttaatttttgtatttttagtagagatggggtttcgccatgttggccaggctggtctcaaactcctgacctcaagtgacccgcccatctcggcctcctaaagtgctgggattacagacatgaaccactgcacctgccctccttcatgcctttgtaagtgatttctcctttactaggctgtaaacctcatggtcaacagaccatatctattttattcacagctatatagcctccaacctagctcagtacctaacatatacagtgtctcactcatttcctgtagaataaataagcgaaaggtataattaagatcagagtaacacaaaaggtcagcaagagttccagagtagtaatgagtacaatgtttctgtatatgagaagcattttagattcactaaatgaggctgcagcggtaggctgaggtaagatcatggggaatcttgaatgccaggctaccaagtttagcttttctcttaagggggtaaggaactactggggctttctgaggaggaagttcatgactgcagctgcatgatggctctgtggagaatgatttggagagggaagtgagacatacagcagactgtatcacaagcaaagagtatcacaagcgttggactgacattagatggagtggataatggaactgaaaaaaaacttcccaggggctcacgcctgtaatcccggcactttgggaggccgaggtgggtggaccacctcaggtcaggagttcaagaccagcctggccaacatggcaaaaccccgtctctactaaaaatacaaaaaattagctgtggcgggtgcctgtaatctcagctacttgagaggctgaggcagtagaattgcttgaacccaggagactgaggttgcagtgagccgagatcacgccactgtgctccagcctgggtgacagagcgagactgtgtcttaaaaaaaaagaaaaagaaaaaccacttccaacgaactgtggtccagccattcaattaactactacttggtaataaaaaaagagtaactattgatacacacaacatggttgactctcaaatgtattatggtaagaagccacacttaaaagcctgcatactaaagaattccatttacatgacaatctgaaaaaggcaaaactacaggggggaaaaatcagtagttgtctggggtgggaaggagaggactgattacaaaagggcttgagggaactttttggggtgacggaaatgttctgtattttggttgcagtagtggttacacaacttgactttttttttttaagacacgggatcttgctatattgtccaggctgaagtgcagtggctattcacaggagtgatcacagtgtactacggcctcgaacttctgggctcaagtgatcctcctgcctcagtgtcctgagcggatggtactacaggcgcatgccaccatacccagcaagtttttgcaacgcttttttttttgagacggagtcttactctgttgcccagtctggtgtgcagtggcacgatctcgactcactgcaagctctgctttctgggttcacgccattctcctgcctcagcctcctgagtagctgggactacaggtgcccaccaccacgcccggctaattttttgcatttttagtagagaagaggtttcaccgtgttagccaggatggtctcgatctcctgacgtcgtgatccgcccgcctctgcctcccaaagtgctgggattacaagcgtgagccaccacgcctggcctttgtcaacagttatagaaagtaaacctaaaaagggtgactggctccgtgacgcctgtcctttcatgaataaaacagatgtagtctcatgtaatacctcaataaacttgaacttttaaaaatcaagaggcatgtgccccactagaaaaaaaaaatacagatttttagcagagacatgaggtcacaaaagtttgccaggatagggaacccaggaggaagaacaaatttagaatagaatatgagttttgaactagaggtctaatttcaaggtctcttcaagatatccaggcaaaccttgaaagagagctgagaagccagattaggagtcatcagaatgaagaaagttatcgaagccaggagactagatcggtatcaccagggaaggtgtgacgaagagggagatggtcatccaaagtcacaactcccaggaatgcccacacgtatgaaaaaggcccacatgtatgaaaaaggcccacatgtatgaaaaagggaggacttccaggaagggagggatgagcagtatcacagctaacatacactaaggctgacacagttcagttctgaccaggaagggcctgaatggaagcaacacgagagatcctccaatggggtggaagcagggctggaggtaccaagaatgggataaggaagtgtggccgcctgccttaagcaactgtagggtcaggaaggcagaagaggacaaagggcgtatgtcgtgaagttccactgtggataggcaggtggacttgcttcatgcctcagaggctaagaggccgactacgtaccctcgaaatgctccaaagagcctaggagaccccacttccgggttcctacagggctcaggaaaagcccctacctgcttcgaaggctgaccgtgaagccacaaggcccacttcataccagggagtacccccactcgccccttcctcacctcgggcccccgccccgtctctttttcccaccctcatcgtgtccccacaacccccggacatccctcggccccgcgcccctgcggcaaagccacatctcccaccgacccactgccctgaggccgaacagccgggggtccctggccgggggcccggctctctcaccatcgcgggcgctggctgggccggaaagcggaagtacggaagtggccagccccgcgatgcctgccctttcgcgagaagcgcagctacggtctccgcccggacttccggacggtaccatctatgctccgagcggggtagagagcccttacgaacgcttgggccttccggaagttttccacctagggctgtctcggtatttttaaattcttgcactcgagtcactatttaagctcctccaggaatgggtgcagcttccctttgtgccttcggccttcttgtcacctttgccacagcctcccccaggtatgcaatggtacagcccagcttcagattgggcaccaaattaggacaagccgaagcggacgagcccttcgtttcttccggttctgtacccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggaggtaggtactattgttatccccatttttcagattcagacttttaatggggaaacagaccgagacttcttttgtccccattttacagatggaaaaactgagactgaaaaaggtcaaataacatgttcaggggcatataagtagagaatggtaaagcctgggcttgaacccaggtctgtctggcttaccagcccacgttctaaaccactgttagtgactagagaagggagaaaggtggaatagggtaagaaaagaggccaagagtcccagagaacatggtaagaatggggtgcttggaactcaaagtcttagcagaacccaagagaaatagaagggaaggaaagagcatcagaaaggcgaggcaaggcatagcagtatagcatggtgatcagggtgcagactcaagactagcggggttcaaattgcatcttggaagcataggcacatacccacccttacagagtctcagtttctttctctgtaaaaacgagatcacaatggtccttgttcatggtgctgagtgagaaattcagtgagataaactgataaagtgctctgcacctagcttggtacccagttaagtgccctgtgagtaggaactgtgccatcaattttgtcagtaagggactgaagctgggcttccttgaggctgtccctggaggtaagaagcccttgggcttttctcagaccactttgtctcccatcaatggccctgtcctctccagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccaggtgataaccccagagaggggccagcaccagagatggactgcaacaagttatgggatgggtcattgagttagccccatatgctgagacttggggtacaggggtttgtggggagagggagagagacgcaaactgggtttgcatgacacaaaaaatacacaagaatatgcatgatcctcttaaattgcaagatttctaattcagtaagcttttattggcaccccactcatcccccattgtgttctgggtcctatgctagtcattagagaaaggtaattaggacagttatggctgtcagggagcttggcaactaggaaagtgagaaagtcaagtacataccaggtgatgtgatgttgtggttagcagtcctagggaactggaatggggaaacctggatttgaatcctggcataagcgcttgctagcattgctgtttcctagctatgtgactttgagaaagttgcctcatatctctgagtgtcagtttccctatctgcaaagtggggtgaataataggacctaccttagtgcttttgtgaggattaaaagagaattttttgcaaaaactcagcccaatgccagacactaagtaagtacttcagatgttatttatttgctactctgatgactttattcactgcataaagatgccttgagccttgtgtgccaggcgctatgctgtattctgcaaaatagagatggttaaggtgggctttctggtcctcagtagcttatggtctagttgaagagacaaggtgtgatggtcattccagtgtgaccaaacaacacgattgggtgcacgttggagctgtgaagtgccagagacttgtggaggaaggaggtgccaactggacctaaaaggatgaatggaattaacttgtccctgggaatccatggaccctccttgaggaaggctatgactcaagttgtattttagcatctaagaacctgggtaactgattgagagaaggcatctcagtagtggtgacatcgaagtgaaggtttgctgagaggactcttctgttaaacagtatgtgactggcatgggtgatacagaagtgaatcagtatagatgaacaagtgaatgagattatgagaagtatatgaataaagttctaggaggccaggcacagaaaatgagctgaattttgaaggatgagtaagagtttactaggtaaaaagaggatggggaaagacccaggagcctctgtagattctagatcctaatttattcactagaggaaagagatattctgtgttttcccttctccccctcagtgacactttctgtaaatttcagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggctagagaacatagaagggggcctcaaggttctggtggtggaggcactggtggggcaggggcgcccactcaggatctgcttctccctgcaggttctgggcttcagtggagccctactgtgctgacatcaccagcgaggaggtccgcacacttgaggagttactgaagcccccagaagatgaggctgagcattacaaggtagaaactctgggccttgatagacatgatgcggaacaagagagttcagaggtgcctgagaagtaaagctaccaaagccatgcatcatcttccttccccaaccctgcccagtctgctgtctgctccatcagtgcctccagacacctaggcccaaactcagctttctccgtgcactgcctcccctctaccccagccaaatgtcaacacgccctcaagcatctacttaagtgaagtctgcccatgttcctttatccccatcccctctgctttggtccaagccttcatcaacttctatccaaacagcctcttaactctcttcctgtttcgaggcctctggaggaacctttcttctttctttaagatataaaacttgggctgggagcagtggcttatgcctgcaatcctagcactttgggaggccggggcgggcagattgcttgagctcaggaatttgagaccagcctgggcaacatggtgaaaccccatctctaccaaaatacaaaaaattagccaggcatggcggtgtgcgcctgtagtcccagctactcgggaggctgagtcaggaggatctcttggacccgggaggtggaagttgcagtgagccgagatcacgccactgcactccagcctgggcaacagagcaagactccgtctccaaaaaaaaaaaaaagatataaaagtcacctcacgcctgtaatcccaacactttgggaggctgtggcaggcagatcatctgaggtcaggagttcaagaccagcctgaccaacatggtgaaacgccgtctctactaaaaatacaaaaattagcctggcacggtggcatgcacctgtaatcctggctactcgggaggctgagccaggaaaatcacctgaactggggaggcatcggttgcaatgagccaagatcgtgccactgtattccagcctgggtgacagaaggagattccatccattaaaaaaaaaaaagccgggtgcggtggctcaagcctgtaatcccagccctttgggaggccgaggcgggcagatcacaaggtcaggagattgagaccatcctggctaacacggtgaaaccccgtctctactaaaaatagaaaaaattagccgggcgtggtggcgggcgcctgtagtcccagctgctcgggaggctaaggcaggagaatggcgtgaacccgggaggcggagcttgcagtgagctgagattgtgccactgcactccagcctgggtgacagagcaagactctgtctcaaaaaaaaaagaagatataaaactatgttttaatgatgaaaataaataaaacatgctccattaaagaaaatttagaaaatacagaaaaatgttgagggagaatcctcccataggtgagctgtcatgatcagatgtgctcatgacatggcgctgcatccaggcctttcttcctcccgttatctacaggatcaagtccacgcatcccagtccttgctggcacagctccagtgcccctctccattttcctcggccatatccctcttcattgccgtgttgaccagtcccaccaagtatctcgccctcattccaggacaccacagcctcctcgctggtctctgggcctctggcaagctcttctctccctcttgtctccttgacagacttgactcacccttcaaggccctgatctcatgttacctccaccaaagcactctttcagattccccagcagaaagttagtcagtctctcctttgtgctgccacaacactttgatctctctctttcacttcacttatctgatttcttaaaaatttatctgaaaaagagttcatacagacagcagtaaattcaagcaatacaaaaggtaattccctgtcacccgtgacctgaaggctcctaattctctcgagaggcaattgctgtgacctgagacaatctgtgtacgtattctgcaccttctatcttgggaattatttcagattggcttctgtgtgtgtgtcttagttctttttggacctgtctcccttactagagtgtgaagtacaggttttatcttcgttgtactttcttacctacacctgacactgggcttggccttggactagggacttgagagagatataagataggtaagtgaatgaatgaatgaagcatggctggccagtgcttacccactcagggttgggtgccatcttttccacagatcccacccctggggaagcactactcccagcgctgggcccaggaggacctgctggaggagcagaaggatggggcccgggcagcggctgtggctgacaagaagaaaggcctcatggggccactgaccgaactggacactaaaggtaggcctctcacctccctgccaaccccaggtcaggacttgaattccagaacttcagcccacctcccctcctttcctgtgcccgcttagatgtggatgccctgctgaagaagtctgaggcccagcatgaacagccggaagatggatgcccctttggtgccctgacgcagcgcctcctgcaggccctggtggaggtgagcagcctaacccaaaagaggaaccatatttactttgtgttttaatgtgttatgcttattttttatcggaatttatcatacatttattaggttggtgcaaaaataggttggtgcaaaagtaaaaacctggactaatatatagcaaaagattgggaataatatataacttgtgcacctaatagaaaagtgcacagatcataaatgtacagttttcacaaatgagcttgtattaccagcctggagattacaaaatgaaacattactatatcctagaagcccctctcatgcccctgtttttctccaactttccccaaaggtagccttactccacaattacttttgctaagcatctgttggaggggctttatacacatcctcccactggaggccaggacagtggttaacgctgtgttacagataagaagattgaggctcagaaaagggaactgttcacttgaggtctcacacaccaggattcaaaccctagcttcaggggccctgtctttatacctgctggttgaccttagacacaccctcacactctttcacctcattgagactcagttttctattctggctcaaacacaagagtttatctcatggaacagtctgggtacatgttgcaggttatctaaggtaggggaaggggcaggtctctatctcatatcatcagacagggaccccagctgacggtggccttgcagtctgcacaaggtcactctgggcgtaattgtcactccagtcccacagaataagagcaaggaggccgggcgcggtggctcacgcctgtaatcccagcactttgggaggctgaggcgggcggatcacaaggtcaggagatcgagaccatcctggctaacatgatgaaaccccgtctctactaaaaatacaaaaaaattagccgggcatagtggcaggcgcctgtagtcccaactacttgggaggctgaggcaggagaatggcatgaacccaggaggcggagcttgcagtaagccgaaattgtgccactgcactccacagcctgggtgacaaagtgagactccatctcaaaaaaaaaaaacaaaacaaaacaaggaggagtgtgtgaaggaaactttttggcccatgcctagctatggctcttatctcttctgatcactttcccctggagagaacttgtcacatgaccatacccgcctgcaagagagcctgggaagtacaactggacaggcattgcctagctgccgtggaggaaagaagagtatggcattcggacagctagcatctccgccacagcaggcctagcacactgcctggtgcgttgcagacgcttcacaaaccttagctgttcattaccatcattgagtgttaatcatttctcttctgtgttcctttttcttcacatcagtacgaaaataaaagggatttctagaatgatcaaagcaatttgggattggtatgggaaggcttcccacggtaggtgggatgggaaagataaaaggatatttctggtgtttgaagactgtcagtgtaggtcagaaaggagcaggaaagtggaacagctatttttccttccactcatttttgtggtcttctaggaaaatattatttcccctatggaggattctcctattcctgacatgtctgggaaagaatcaggggctgacggggcaagcacctcccctcgcaatcagaacaagcccttcaggtgagtggtgtcctatccacaacccacagtctggcccccgcttctgttggcttctctccatctcaacctggggaagtcctcatcagtaagaggctgggggcagttaggtgaagcctaatagcagtctcaagtgtgagtgatgacccagcgtgtctgcatgcacagactgagtgcagggttgttcagcacagaactgttcataccataaataacccaaatgtcctgctgaaggggaatggttggctaaattggcataactccatatgatgaaataacttggggctattaatcatatagctgcaagtatagagaaatatagttaaatgacatgaaaagatgtaaattatagagtgacaagtggagaaaatattagttgtagcccagtatggatggtataatactatttttacttaaaatatatttctttttttctttttctttttttttttttgagatggagtctcgctcttgtcgtttaggttggagcgcaatggcgcaatcttggctcactgcaacctccgcctcccaggttcaagcgattctcctgcctcagccaccaagtagctgtgattacaggcgcctgccaccatgtatggctcatttttgtatttttagtagagacggggtttcaccatcttggccgggctggtcttgaactcctgacctcaggtgatcctcccacctcggccttccaaagtgctgggattacaggtgtgagccaccatgcctggcttacttacaatatatttaaatatgtgcacataagggaaaaaacctggactaatatgtagcaaaagattaggaataatatataacaaaatctggaatatatataataatatataacaaaataatagtaattctctctgggttgttggcattatgggtttttccatattttttgaatagtagatacatacgttgcttgttttaaaaaccagaccagatgtgtctgtccctccctttgtatctggatagatacagagggggtgcccaaagggaaaggcaggttttcactgaccttgggaagccctgggaacctccaaggtgggcccttctccaagctggctcttgagtctgacgggcctgcctcccgctgcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggtgagcgttagcaggatgcacagtcccgggggtggccttggaggctgtggccacggctagtcacctttcaggggttttacaacaggctttccaatcctggctggcctctaaatcacctggagagcctcgaaaaaaacagcagtggccagtccaccgggtatgtcccaaacaaattctgattccacagagtggggctcaggcatctgtgactgaccgattgatttgatttgtttttgttttgtttttttttgagagggagtctcgcactgtcacccaggctggagtgcagtggcatgatctcggctcactgcaagctccgcctcccaggttcatgccattctcctgcctcagcctcctgagtagctgatactacaggcacccaccaccacgcccagctaatttttttgtatttttagtagagacggggtttcaccgtgttagccaggatggtctcgatctcctgacctcgtgatccacccgcctcggcctcccaaagtgccgggattacaggcgtgagccactgcgcctggcctagtttggttttttaattatggtaaaggcataatataaaatgtatctccatgggaggctgaggcaggagaatcagttgaacctgggaggcggaggttgcagtgagctgagactgcaccattgcattccagcctgggcaacaagagtgaaactgcatctcaaaaaaaaaaagaaaaaaaatttacgcttcttaaccatttttaagtgtacagtttagtagtgttacccatattcacattgttgtgtgatttattttttgtcttttcatgcttcttttctttttatccccaaagttttgttattaaaaatttgatacacacagaaaatctgaaagaatcatacaataaacatcagtatattctccacctagactaattaactgttaacattttgttggagatctgtgatttttatttgctcatcacaagaaattgaccagtgttttaggacatgttcttttgggaatccatcacagtgcctgccattcatttgatgtcaactcccatccatcttgttctgcattgatcacgagggtataggtgacatcttgaggaagactgtggaatagctaccctttaggtaaagagatagggaagcaacccgaacaagtctctttgcttctcacagacaagtgctgtgtcttaacttcatagagccctgacaggacagggcacattcattcatttggccttttttttttttttttgagacggtgtctcactctgttgcccaggctggagtgcagtgccatgatctcggctcactgcaacctccgcctcccgggttcaggcagttctcctgcctcagcctcctgagtagttgggattacaggcatgcactaccatgccaggctaatcatttggccattcttactgtctcttagatattgtgctgggggccagcaagagaggcagagcaagggacttgcagattactagcagatgatcagtaaagataagtgccattaaaaggagaggtagttgctgacaagctgccagggtatttaaggataagagtgactaatgtatgctgagggcctactgtgtgtcaggggctttatgtacactctctcaagtgtcttgacaacaacccaggagggaggagctattttcgttgtttaccagatgaggaaataaaggcccagtgaagcgaaatgctctgctgaaggtcacacagtcaataaacagcaagctgagacttgaacctgtggttgaatcaaagcctctttctataatagtttgttttctctgaaaggtgagaagaagaaaacacagatggaagaggcactgagggaagcagagggagagagaggaagagagagaaaagcaggcatgtgcagttacagaagtagtgggccctagctgggcctggtggctcatgcctgtaatcccagcactttgggagactgaggtgggaggcttgtttgagctcaggagttcgaaactagcctgggcaatgtagtcagacccccttctctactaaaaatttttaaaaatcagctaggcatggtggcacatgcctatagtcctactcaggaggctgatgtgggaggattgcttgatcctgggaggtagaggctgcagtgagcttgatcaggccactgtactccagcctgggtgacagagtgagacctgtctcaaaaaaaaaaaaaaaaaaaaaaaaagaagtaatgggcaatgaagaaatggcttgcagctctcaggaaaccagagcacagcccttaccctgctgcagagcagctgcaaggccttaagcagcccctgacctgagcatctccttccccttctggaaaactggcaggctggactcaatcactaagtgaccttccagctccaccatcgatgaaatgtataaatcagaccctgttcagagagattgatctggtgtctcacccacctcctgtcagcctcaggctgcctagaccttagggggctctggaatgcagatgccgacgtaagcaggccttctgctggcaccggaacacctgaaacaacagtgtttaaaaacaagagtttggccccagcctgctccagatctccccctcactaactgtgggatcctgggatcatctttgagcctcattttcctcacgggtaacatatgaataatagtacatattttgcagggttgttaggattaactgaaagacagagagagagagtgggtgtgcctgtgtgtgtgtgtttgtgtgtgtgtatgtatatatatatatattttagagacagggtcttactctgttgccgaggttggtctcaactcctggcttcaagtgatcttcctgcctccatctcccaaagcgctgggattacaggcatgagctactttgcccagcctactgtgtatatttttaagacctttttttttttgaagacacagtcacgctctgttgcccagactggagtgtagtggcatgatcatagttcactgtaaccttgaactcctggcctcaagcaatcctcagctcccttggagttgggactacaggtgtgcactaccacacccagctaattttttaaattttttgtagagacagtctcactatgttgctcagactggtctcgaactcctgggctcaagtgatccttctgccttgggctcccaaagtgctgggactgcagatgtgaacccccatgtgcagccaagactttattcttctagagcagttttaagttcacaacaaaattgagagaaaggtacagagaattcccgtatctccctgtccccacatgtgcacagcctcccccgtgatcaacatgagttaatatttttcaggagcttaagatagtgccatgtaagtgtaggtcagtaactgctttttggtcacgactgtatgacacaatccacaggcatgccagcctgggctggtgggtaggctcggtcttgaagagggaggggttgttctctggaggtgggctgaccctggcacctggctggctggtccccacaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccgtggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttcaaaaaaagca

SEQ ID NO: 7978 - DNA, 690 bp, Homo sapiens
cagtggggaggaaggaaccagtgtgggtggtaaggtttgtggggggtatgcttggtggctctcagcccatggccactaacccatggcattcagtcagggagaactttctgagtacctctttctgaggatacttgtggctgcacgtaacaatgcccccccagctcaaagtggattcacagtaaggaaatgtgttggctgcaggatgggcagtcctgggacagagtggccttcacggttagccaatctagcaattcttcagggtcatcaagggtccaggtttcttttttttttaatttaagttctagggtacatgtgtacaacgtgcaggtttgttacatatgtatacatgtgccatgttggtgtgctgcacccattaactcgtcatttacattaggtatatctcctaatgctttccctcccccctcccccaagggtccaggtttcttaggggtcaccacactgccctccacagtgtcgacctctgcctaaggtgagtccttctctggctgtagtgtggcagtggagcagttggggccagatgcttcctcatttacatccagcacaggagggagccggagccagcgggcttccatggcccatctacagaagcaagaagccttttcccagataccatcatgtttcagtggcccaaactcagtctcacatgcccattcctcagtcactgtggca

SEQ ID NO: 7979 - DNA, 627 bp, Homo sapiens
acagagcaagactccgtctccaaaaaaaaaaaaaagatataaaagtcacctcacgcctgtaatcccaacactttgggaggctgtggcaggcagatcatctgaggtcaggagttcaagaccagcctgaccaacatggtgaaacgccgtctctactaaaaatacaaaaattagcctggcacggtggcatgcacctgtaatcctggctactcgggaggctgagccaggaaaatcacctgaactggggaggcatcggttgcaatgagccaagatcgtgccactgtattccagcctgggtgacagaaggagattccatccattaaaaaaaaaaaagccgggtgcagtggctcaagcctgtaatcccagccctttgggaggccgaggcgggcagatcacaaggtcaggagattgagaccatcctggctaacacggtgaaaccccgtctctactaaaaatagaaaaaattagccgggcgtggtggcgggcgcctgtagtcccagctgctcgggaggctacggcaggagaatggcgtgaacccgggaggcggagcttgcagtgagctgagattgcgccactgcactccagcctgggtgacagagcaagactctgtctcaaaaaaaaaagaagata

SEQ ID NO: 7980 - DNA, 423 bp, Homo sapiens
ggctggagtgcactgtcgcaatgttggctcattgcaacctctgcttcccaggctcaagagatcctcctgcctcagcctccagagaagtgggactacaggcatgtgccaccatgcctgactatttttgcatatttttttggtagagatggagtcttgccatgttgcccaggctggtcttgaactcctgtactcaagcgatctacccacttcagcctcctaaagtgctcggattacaggggtgaaccactgcaccaggcctccagattaaattttaaaggggaaaaagatatttatgaaatggaaactagataagagaaaatcattcaaaatatgaagtatttggattagggggtcagagtgtctaggctggtaggtaaaaaaaaaatccctgatcattacattagaaaagtatggagatgggaa

SEQ ID NO: 7981 - DNA, 690 bp, Homo sapiens; identical to SEQ ID NO: 7978

SEQ ID NO: 7982 - DNA, 13646 bp, Homo sapiens
gaggagagcgtctgcctgaatctcatcctgcagaaggtatggggtgggatgggtggggctgcggattggccctgtgggatggctgacccctccctgcacgctgacccgtgctctcttccagctggactacatggtgacctgtgcggtgtgcacacgtgctgacggcggggacattcacatccataagaagaaatctcaggtgagccctggcacgagagcccccagcctcctaactgccagttcaggctgggcgtggcagagagagacaagtcctcctgcttgcttctctgccctggaggtgaggggtctgactccagaaatctgctcagctcctgggatcccgtatcccattcgaggagcacagaaccagcttatcccccacatctcctggtaggtctctggctttggactggctctgggccgggtggcctccctatactggcttggactggctctgggcctgtgtgccgggtggggcctcacttgtcctccaaatctgctttcttccagcaagtgttcgcgtcccccagtaaacaccccatggacagcaagggggaggagtccaagatcagctaccccaacatcttcttcatgattgacagcttcgaggaggtgagctctgcacagggcctctctccttagcttccccttctcgtgagatgggtgttaggcgcttctccccgcggccttagccttgcagaaaggcatgggtggcttggagccgggaagagtccggctgaggcagatgtggctctctctcttcccagtgtttgcttgtgggcaggtgaatttccccggcgcagcctccgtttcctcctctgtaaaatcagtgtcatgatcatctgtcctacttactgtcagggctgaagactaaaaggctcctgagtgggaggacgcctcataaactcttgcaagaagcactgcccgggcgggaggagccattattaatgctagtaaatgataaagaagcgcctccacgcctgcactgacttggaatcctaggatgtcaaagagggatggggtttccggagttatctgggccaagcctttgttttaaggtttgggaaacgggcttgggcagaaggagactcaccgagaaacacagggcactgggagggcggggagggagccggtcgcagctcactccctgctctgcccatttgtgtctctcctctgttgaggccctggtcggggtccttgtgcgcatccaaggtgctcagggccctgaggacttaggaggaaggcgtgggcgtctgcaggaaaatcgcaggctcagggaggtcatgtcccctccccaggcacacgtagctcctagagggcagagctgagatttgcgtctaagtctttgtggcctcggagctcacagtctgtgcaccaggtcctgggagcaatgactcgggaaggtggcaggatggggcctgtggcaccttagtctggtgttgtcaccccaggtgggcagtcaccctgccaccacactgagcctttggccacacaggagcctcaaagatgtggcaggcagggctgggcacccctaggcggtgtggaggggcccagacggtggctgacggtcctggtgaaccgtgatgagggtgtgcgtcttctgccagtcccagagtctccgtaagcgtccctgtcctcccctgctgctcagcccctgccccagtgtgaggctgttcttgtcctgtggggctcggagggcatggggccacaggagtgtgtgacagccggttgtcccctgcaaaatggggttttctgagcagccctccctgccagttgggccaggctgtggtgtgggcggtgggagctgatggtcacgtccctgtctctttgtgtcctggcccaggtgttcagcgacatgaccgtaggggaaggagagatggtctgtgtggagctggtggctagtgacaaaaccaacacgttccagggggtcatctttcagggctccatccgctacgaggcgctcaagaaggtgtatgacaaccgggtgagtgcggggcggcctcacgggtgttcttctgggcccggggacggcggctccacagcccaccgtggtccataccatggggccccccagcctgcttgtgcatggtagcggccgccaggggtacctgcagcccctccgggctccttctaggcgctccctggtcctcttaacgtcattcttcatggtcggcctcagcccatgcgggccacttgccttcatctgaaatgtgagcgggaacttcctcctcagtctctagttccctgggaagtgatggctgatggtgtcgctgtcacctcctcactgtcacttgcttcctgcgactggccctgggagtgctccgagtcgcccccaactaagcaagcagatgtgggcaggcccctctcccccagcgggcaccatccgcagccagccttgctgccagcctggggccctgtcctcagcctggtccgtggttcatggggcggtgggaggggcaccaggaggggcaccaggcagagatgtgggtccattccagctgccccgcctgccagctcagacgctccctcccgggcagcccccgctccttgagggatggtcgccctggctgttcatgtcctggggaggggccccatggagccatcgccacctccctgactcaggctgccccgcgccggcccccaggtgagcgtggccgcccgcatggcacagaagatgtcgtttggcttctacaagtacagcaacatggagtttgtgcgcatgaagggcccccagggcaagggccacgccgagatggcggtcagccgagtgtctacaggtgacacatccccctgtgggactgaagaggactccagcccagcttcgcccatgcacgagcgggtaagggctgcacagctgggggcgggggctcccatccgtcaagttcactttccaccgtctcccccgtgctcacggccccctggggacataggtgttgtcatccccaaccaccagtgcgcaggccgaggtgccgagcgtgcggaggcccggaccacccagcccttctctttgcctagcggtttgtaggaggcactgccgcaggggaggcgttcctgccttgcagacctggagggctgtgcctggccaaggtcacaccgcaggctggtgctgggccagagctctttctgcctccctgagatgccacaaagccaggctgagtccacagagccagtgggcagaagagactggctggggacccaggcccggccctggcgcctgcctgggtggacctgctgggtgagcgtgggcacgtggccggccttccccggtgagtcagatggggatgatggtgactgagggtcagccagcgcatgcagaggcctaggccacccagctctttgccccgcggtttgtaggaggttctgctgcaggagaggcgttcctgcctcgcacagccggaaaccagacttgccagcttgccccaggtcacaaggtctcttgggatagcactgggcttggggccctgctctgcctaggccactctccttccccagggcgggaggctgaggtcagcagcagctttgttcccagaagcctttggtggggcacaggcaggagaaggtctccagcccactggctgctttgctctacctggttcttccagagggactgcccagagctgtagttcttggaagagtacaggtgtgctgggcaggggggtgcccttggcacaggtccaggggcagtcttgcccagccattgtccaggagagacgccacccacagccagaatcctgctctgctgctctcataaccttgggtgtgtctcttttcctctccaagcctcagttttctcatctagaaacagggcacgaggatacctgctccttcagtatttgggaggctttgaggaatccggggcttggccctcaggaggattcccaggtggcagctgcagtagttgctgttgacctacttggaaagcagaggcgtgggaatgtaaacgatgcattaccgcaggcatgcctgagatgagggagtgtgcgtttgttatacttttagttcgagaaagatctgaatcatgcatatctccgggtggtcagatgttggttttctttctcttctgtatatctttttttgggggggaggtatcttctgcaatgaatgtgttttgcaagccaaagacagcaagtgctattttttgcaaagatgggtgagaattccaggcaggggcctctcttgtctttggaatgaggtggtttatatttctgagtttgtttccgagataaagggcctggttcttctccctggtcctaaattatgccctgggactctgacaaaatgtgtgtgtgaaagtccttacgaagatgtggcccgagctctgggctggacaaacccgggtgccacctccagccacagcctgagggctgagtgactacaggtcactagacctgcctgagccttggttttcccatctgtccagcgggagtggctgtgaggggtgtgaaagtccctggtgccttagcagctgggcagccctgggattcaggaggagggatgtgctagggtcacacagggtcagcagcagggctggcccctggggactgccgcctgtgcgcctgctattacctgtctccttctctggcggggtcgtctggagccagtgcgtgacacatgctgactctgtgtattgtggttgctgctgtttgtttcttttatcttttaaaaaccttccccggcttgtgggaacaccgtctggagcccagcagctgccaggactttggtggatgtcggagccgtgacgaggaggctgacggggctcccgaagtctcagtcccagctcatcctgctcctcagattattgttggcatggggaggagggaggagatgggccaagttccctctggctggaacgcccttcccccccttcttcacctggcgaactcctactcgtccttcaagacccagctccagcggcatctcctccaggaagccttccctgatttcccaggctgtggatcccttttgcctctgtgcttcatgtatcctgtgcttctctttctctgtctccacagccagcatgctgtctatggttgtcactctctgagtctgtcaccccagcagactgtgagctccttgagggcagggacctgcaatgtgcctgtctgtccttagtgctgtgcctgcctggccctgagtgggtgtgaatgtttggtgaacagaaccaaacgtgattagaagtggggagaagacagaggcatagagctacttagcacagtatttcctgtgaagggtgctgggaatgagagggatggggccacgtcagccctgagaagtaggatgaggagcgtggccctgggggacagaagacagggctgctgccgtcctgcttggtgaccacaggcaagccagggtctcggtccctgccttagtttccccatgtgtcagatgggctgacgctagcccctgtctcacggagctggaggctcagagggtctgtgtgtggggccagtgctcactcagcgtcagcagctgttgttactttgtgcttgaacaccccctacccactgtttgaggcccagaggaggggggtctttctgccatttgcggcagcagcctggcccctcctcgggtagcactggtggccaggtgtcctgctggcccctgggctggaacgcatcttccagtctctaggccccacctagcacgggccggctgggcctgggtcctcctgggccagcggcctcttccctgggagctgtgtcaggttgtttgagggtgggataggaggggcgttgggacccccggggagggggctgttctgctactctggtgactttggctgcttgttcccaggtgacctccttcagcacaccccccaccccagaacggaacaaccggcctgccttcttctccccatccctcaagaggaaggtgccccggaaccggatcgctgagatgaagaagtcgcactcggccaacgacagcgaggagttcttccgggaggacgacggtggaggtgaccccccactccgtgccctagggtccccgtgcccttcagtctcttcttgatccagaccagtcattcattcatttattcattcattcatttgttcattcagcagcacttagagagtgggtgccatgtgccaggcagccctccaggagctgaggggtagagctggggacaggcagaaatggctgcctctgggggtcccgtcctggtgggctcaggcgtctccttggcagagtgcttggagcgcagatgtgcagcagttggtcagtttcaggggatttcccacctttctaaggcttttcagcctgcttaaggaagaaagcggatgggtgatctgatggctccgcacacacggggtgtggcgggagagaggagggcttccctcccttgcgctgccttgggccagctcgccctcagggtgaggcctggccctcctggctctgtgcagcctcccagaaccacgtgctctttggtgacacagtcgccacctcgtgcagcctacccccggggccttcctgtgcccctgtcccctggactccggttgtctgtatctgggtgttaccatgccccttagtcctgcccaggcacagtctgcactctctcctgagcacccgtgcctgctccctgtcctcgctcagtgaccttccagaatacaggagttgttcccagagcccccagggaggcctctgaggggttttaagcaagggagtgacacaatcagattagcatatttaaaatgccactcagcagtctctgtgggaaatggctcctggggacaggcgtggccgtcacagacaggttgggaagttctgccatgctctgctggcatggaccacgtgccttcctcactgtcatcctcaggacccagcgggcgcctggctccgcactgtgtgcgtgtctgttgagtgtatggaagtgaaggattggccaggcacagtggctcacccctgtaattccagcacttagcgagaccgaggcgggtggatcacctgaggtcaggagttcgagaccagcctggccaacatggtgaaaccctgtctctactaaaaatacaaaaaattagccgggcatggtggtgggcgcctgtaatcccagctactcaggaggctgaggcaggagaatctcttgaacctgggaggcagaggttgcggtgagccgagatcgtgccactgcactcgagcctgggcaagagtgagattccatctcaaaacaaacaaaaaaaaacgacgtgaaggattcgctgacaactcccactgagcacctcccccagcagggagcagggctgcagcattgatcagaagaggtggcagtctttgtcctgaccactgggaccaagaagcaggggtgtcccacctgctcaaggccctggcctgggtcagggactccagcactggcctcgacctgctcttgtgtgaacttgggcaagccccttccccacctgggcccgttcccgaatcagtaagaagtactgatcactgccctagtctgcctctctggggcaggttcccccagcctggaccgcaggactgggtaatggtgcaggtcggctcagccttgctgctcccatgctctgcaggtggcggtgcctagttccagggacagggcctgcagaagcagagaattacacagtgtgtgtgccagaacccccggaggagactaagcttgtgacagagaagagagagatgaggggggtggccaaagtcttcctggagttggaggcctgggtctgggccagaggaagcagggaggggtgttacaggcgaggaggcagcagctctggagcgtgtgggtgctggtgtgggggtgttggtaaggagcgtcctggcctcagcagagtttggcctcagcctggactgggagctggcctcctgctgctcccgccgcgtcccatgctgtgggggccttgacctggccttctttcctccagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacaggtaatgctggcggatgtggggaagcagccgcaccttctcacagccagctctgcctccagggccttggtacttgtgagccacccggagtcatcccgccctgtcctgtcggttggttgggtttctttgcagggctcttggcctctttgtctcagactttgggtggagccgtagctttcccagagctgaagtcctccctttgttcacctttctggcgcacctgctgtcccctcttgagtggccacagatgcccaggtgtgtgttactcacgggcgaggggaggctctcaggccacctcgctgacccaggcctgcagcagctgtgacaggcagtggctctggcccccacaccagcttgcacctgaggccctgcagggtgtgccgttgctgcgagcccatttcccagtctgcagggtgaggatggtggagacacgtctcctctgcagtctgtgaggcctggagaggagatgcatgagtggctgaggcgggcttccttcagaagtggcactgccgtgaccatagcactcaccgctgttgagggttactgtttcacctgcttccctcctgccggccctagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttcattctgcctcagtttgcccacctgtgaaatggggctgataccacctacctcactgaagtcccagggttcaagtgtgtggctgggtcagggcgtggtcacccgtcattctgcataggtcgggttggatgttagactcctgggatgccctcctccccctcgccctttgtaataacctaatctgagaccgtgcttggtggggggatgtgaactttctctctcccccagcagtgtctgctcaggcctgacagctcagctctgcacgatttcatgttcctaaacccatgtcttagggcagcacagagccaggtcatgtcatgccccaaagtgtggggacagagcctcagggagccccgagcatggtccagccccatttgagtgctctccggggatgccaaatgctgcttccaagtttgagtccatgtggctaaaatacacccatttcttcaggaactcttcccctggttgttctggggatcttgggagaaacacagccctgacagctcgtccgtgggaagatgaggcagtccaggttgtgaggagcacagcggcccgccctctgttctcagaggtgaggggcgggagaaggttgtctcctctggggccagcatttggccaagctcggaggcttggccagcactgctggatggctcagagcaagctgggctccccgtctgtaagatggcaaaaatgctgcccccctcacagggtgaccatgaggaccagtcacagtgatgtgtgaaagggctcgctggtcacagaaacgtgtacaaatcatgctattttagagatcagccctcaatttgtaaggcatgtgaacagggcacgcggtgggctggtggtttcatagccgacacacagcgcctaccatgtgcagctgcctgtccgaccccatcttacagacgagaaaaccagcacacaggcaccaaggaactgtccggaactaacagcaggggccggcgatgggagtcaaacccaggcacgcggcctggcctgcatgctgagccacatggtgctgtccggacagatggacagacactcggtggagtctgcctttctcaggccctaaatccctctccaaagggtacttgcgatgccggatttaaaacttgctcagagccacttagccacttgagaaccagacagtaaggtgttactcccaggtttgtttttccaaagtaacagatgacatgtggaataaagtaatagagtaacaagtggcagggccagaaccagggtccccaaagtcctggtgttggcacatttgtacttcttgtaagaccatctttaatttttctgggaacacacctgccttttgtgtaatgcggggaagactaatgcatggtgacacctagttttcctcaacaggacacttgatcccaaaacccctttaagaccttaggtttcctcagcggaaaactgtactttaatcccaaaccccctttaagacatattggggctgggcgcagtggctcacgcctgtaatcccagcactttgggaggctgagatgggtggatcacctgagatcaggagttcaagaccagcctgactaacatgctgaaaccccatgtctactaaagatagaaaaattagctggacatggtggcaggcacctgtaatcccagctactcggaaggctgaggaaggagaatcacttgaacctagtaggcagaggttgcagtgagccgagatcacgccattgcattctagcctgggcaacgagagcgaaactctgtctcaaaaaaaaaaaaaaaaaaaaaaaaaaaaaaaaaaaaaaagatacattggtctttaaacccaaaccccctttaaggcatgttggtctcaaggggatttgggattgaagcacagctttctgttgaggaaacctaggtgtcactttttagaacattaaaaagaaagttgtagggtgggcttttccatttaaaggaatgtgatgatcctaggttctgatgagtgataggtggtctccgtttataccctttcttcttttggcacctgtaagttccggtagtggccatcttacattctcatgtcctgctggaagtgcctagttgcctgcaaagccagctaaggcttattatttcaaaagaagattatttaaaacatgagtgacaggtagtcagaagagaacaaaaggacgcaagatactctatagccaagtcagcttggaggcaggatgggttgctgagtgaagtcgccgctcacttttggattcttatggactgtgagttagtcttccctctacacggagtcacaggaagggtataaatgcatgttcctgaggtgccctcccccaaagaatgtacctgcactcaaaccaggatctgtttttgctgttttaatcataaatagactagttagtagaagacttttgaagaacaaagtaaaacttttttttttcattaaaagatgtcccagaggaaaggccctgtgcagccagtatattctaatgactgcctggaccatgtcctaatatggtggttttaagttgttggccaaaatcctttaaagacatacgaaacatctgccaactttttagcgaacttaacaggtttcactgacgttttcctcaatttttgaatttaggtgggatttgctttcatgtcctgtttcaaaaaccaagtgtctcttgacagcccactggttcttcctgtcctcttgctctagtctgtatcagaaagcagaatgactgtacttttgttttacaaacaaccacctgataggacggacactccacgagataaggaaaggcacgtgcccttgagcttgaatggaagcagcctctggagggggcagccactgcccttcgagggagagcagctcttcagcagtggccagagtgccacgtgactctgcagatgacccctgggagccgggtgatgggcacctgctggggcttttgttttttctttttcactggctggcttgatcctcagtggcaaaaggacccctgagccccttctccgagccctggagcactcctcgggacaccgagtggcctcagggctgggttcagagctcctcccgcagggggagcctcagaagtggaggcagctgctgatgggtgagtttacaacttcttatcctgcctaaggcgagtaggcgtttttattccgtttccagtccttgagctcagcagatcaaaataacagtgaccctgcaaccccacagagcccgcgacacgctcgctttcttccccgccctgcccctttagtccccgctctggaaggccaggcagtttaggtgtaaataggtatcttttatggtttccaaatgaattatttgtgtgagagtaattaaatctgtaagaaaacctgttgagattcttcactatgaattatgacttctacaacatgtattttagcaaaaacacgatgctggcctccactggatagctcagtatgctgattgccagtgatagttctgtacgcgttaccaacagcgtctttattaaccctcttccacatccagtggaaatcattgctaggcggtatttgttggttggctgttagctttgctttatgatttcatgtttcttttaaaggttgttttgcatgttgaatattaaattttttttttctgtgtcttcctctaatctttttctgtaatgggaatttcagggtaaatacagatattatagcaaag

SEQ ID NO: 7983 - DNA, 7770 bp, Homo sapiens
ccggaaccggatcgctgagatgaagaagtcgcactcggccaacgacagcgaggagttcttccgggaggacgacggtggaggtgaccccccactccgtgccctagggtccccgtgcccttcagtctcttcttgatccagaccagtcattcattcatttattcattcattcatttgttcattcagcagcacttagagagtgggtgccatgtgccaggcagccctccaggagctgaggggtagagctggggacaggcagaaatggctgcctctgggggtcccgtcctggtgggctcaggcgtctccttggcagagtgcttggagcgcagatgtgcagcagttggtcagtttcaggggatttcccacctttctaaggcttttcagcctgcttaaggaagaaagcggatgggtgatctgatggctccgcacacacggggtgtggcgggagagaggagggcttccctcccttgcgctgccttgggccagctcgccctcagggtgaggcctggccctcctggctctgtgcagcctcccagaaccacgtgctctttggtgacacagtcgccacctcgtgcagcctacccccggggccttcctgtgcccctgtcccctggactccggttgtctgtatctgggtgttaccatgccccttagtcctgcccaggcacagtctgcactctctcctgagcacccgtgcctgctccctgtcctcgctcagtgaccttccagaatacaggagttgttcccagagcccccagggaggcctctgaggggttttaagcaagggagtgacacaatcagattagcatatttaaaatgccactcagcagtctctgtgggaaatggctcctggggacaggcgtggccgtcacagacaggttgggaagttctgccatgctctgctggcatggaccacgtgccttcctcactgtcatcctcaggacccagcgggcgcctggctccgcactgtgtgcgtgtctgttgagtgtatggaagtgaaggattggccaggcacagtggctcacccctgtaattccagcacttagcgagaccgaggcgggtggatcacctgaggtcaggagttcgagaccagcctggccaacatggtgaaaccctgtctctactaaaaatacaaaaaattagccgggcatggtggtgggcgcctgtaatcccagctactcaggaggctgaggcaggagaatctcttgaacctgggaggcagaggttgcggtgagccgagatcgtgccactgcactcgagcctgggcaagagtgagattccatctcaaaacaaacaaaaaaaaacgacgtgaaggattcgctgacaactcccactgagcacctcccccagcagggagcagggctgcagcattgatcagaagaggtggcagtctttgtcctgaccactgggaccaagaacaggggtgtcccacctgctcaaggccctggcctgggtcagggactccagcactggcctcgacctgctcttgtgtgaacttgggcaagccccttccccacctgggcccgttcccgaatcagtaagaagtactgatcactgccctagtctgcctctctggggcaggttcccccaggcctagactgcaggactgggtaatggtgcaggtcggctcagccttgctgctcccatgctctgcaggtggcggtgcctagttccagggacagggcctgcagaagcagagaattacacagtgtgtgtgccagaacccccggaggagactaagcttgtgacagagaagagagagatgaggggggtggccaaagtcttcctggagttggaggcctgggtctgggccagaggaagcagggaggggtgttacaggcgaggaggcagcagctctggagcgtgtgggtgctggtgtgggggtgttggtaaggagcgtcctggcctcagcagagtttggcctcagcctggactgggagctggcctcctgctgctcccgccgcgtcccatgctgtgggggccttgacctggccttctttcctccagccgatctgcacaatgcaaccaacctgcggtctcggtccctgtcgggcacaggacggtccctggtcgggtcctggctgaagctgaacagagcagatggaaacttccttctctatgcacacttaacctacgtcacgttgccgctgcatcggattttaacaggtaatgctggcggatgtggggaagcagccgcaccttctcacagccagctctgcctccagggccttggtacttgtgagccacccggagtcatcccgccctgtcctgtcggttggttgggtttctttgcagggctcttggcctctttgtctcagactttgggtggagccgtagctttcccagagctgaagtcctccctttgttcacctttctggcgcacctgctgtcccctcttgagtggccacagatgcccaggtgtgtgttactcacgggcgaggggaggctctcaggccacctcgctgacccaggcctgcagcagctgtgacaggcagtggctctggcccccacaccagcttgcacctgaggccctgcagggtgtgccgttgctgcgagcccatttcccagtctgcagggtgaggatggtggagacacgtctcctctgcagtctgtgaggcctggagaggagatgcatgagtggctgaggcgggcttccttcagaagtggcactgccgtgaccatagcactcaccgctgttgagggttactgtttcacctgcttccctcctgccggccctagacatcctggaagttcggcagaagcccatcctgatgacctagccgcgtgcggagcctgcgcagagccccggccgggcccagccctcggagtgctgccaagtgcctacctgtccaccgccaccggggtctgcgatggcacgccagtgctggagccgcagccaggcgaggccactcgactcccggggccggggccgactccacgaacaccagcccaaactgaagtgcctcttccctcccctgctggcgctgctccgccctgtgccccccgcccatcgccccccacccatctctggagagccctctgcacccaaagaggactagagatgccgagcggccatgagagagagcggaaggagcagctgatgcccagagcggggccagagcggcgggtctatgttcacgtccccccagcagcaggcggaaccacccagccagggcactcagtgcattggactgtccacatgttcttgaggaaagccggtggaagattctggaatgccgtgcggatgaacttcagcacccgagtcagtcccagctcatcctccccagtttaccactttgttctaataggagatgggaacacgagaagtttgatggctttgccctgggctgggaatacctcacccacgcccagttccagaaaggcctccagctgagcagacggccccgatcccgccagaacggccttttgcttccagccaaagaacaccgccaacacgcacacctccaacctgggacatcccacgctgggcctcgcacggaggaacctgcagaatttggattctgagggtagtcgggaggcctcggtagccaggcagaacaggatatctgccaaagggtgtctgatgtggggtggggctggcatcctcccaggaaggttctaggtgggaccccgtcttctgggggcgggggtgtcttttcatcttccctggtttcctagaactcacttcctttgacggcgtgtgttggtcccatctctcagaccagctcactgaggcagaggagttgctcagaggctcacatgggcacccccattggttcgtgtgagcagctgcccagccccaggcctgccctcggcctggtccagcatgaaggcgtttccatctgcaaggatgcacggtaccctccccgagagcaggcctgtcccctacccaactgggaataaactggaagctgggtctctttgttgctatgtttttttgtttgaagttcccaggaatatttgaggggttccggtgatgtgtttagggatcttctctgtgggggaaaaggaagaggagggtcttgttctcccatctgtttattctttgggctctgggaacaggggactactttggggctttctccagacttttgtatgttgttattaaaagcgagctattgcatttcattctgcctcagtttgcccacctgtgaaatggggctgataccacctacctcactgaagtcccagggttcaagtgtgtggctgggtcagggcgtggtcacccgtcattctgcataggtcgggttggatgttagactcctgggatgccctcctccccctcgccctttgtaataacctaatctgagaccgtgcttggtggggggatgtgaactttctctctcccccagcagtgtctgctcaggcctgacagctcagctctgcacgatttcatgttcctaaacccatgtcttagggcagcacagagccaggtcatgtcatgccccaaagtgtggggacagagcctcagggagccccgagcatggtccagccccatttgagtgctctccggggatgccaaatgctgcttccaagtttgagtccatgtggctaaaatacacccatttcttcaggaactcttcccctggttgttctggggatcttgggagaaacacagccctgacagctcgtccgtgggaagatgaggcagtccaggttgtgaggagcacagcggcccgccctctgttctcagaggtgaggggcgggagaaggttgtctcctctggggccagcatttggccaagctcggaggcttggccagcactgctggatggctcagagcaagctgggctccccgtctgtaagatggcaaaaatgctgcccccctcacagggtgaccatgaggaccagtcacagtgatgtgtgaaagggctcgctggtcacagaaacgtgtacaaatcatgctattttagagatcagccctcaatttgtaaggcatgtgaacagggcacgcggtgggctggtggtttcatagccgacacacagcgcctaccatgtgcagctgcctgtccgaccccatcttacagacgagaaaaccagcacacaggcaccaaggaactgtccggaactaacagcaggggccggcgatgggagtcaaacccaggcacgcggcctggcctgcatgctgagccacatggtgctgtccggacagatggacagacactcggtggagtctgcctttctcaggccctaaatccctctccaaagggtacttgcgatgccggatttaaaacttgctcagagccacttagccacttgagaaccagacagtaaggtgttactcccaggtttgtttttccaaagtaacagatgacatgtggaataaagtaatagagtaacaagtggcagggccagaaccagggtccccaaagtcctggtgttggcacatttgtacttcttgtaagaccatctttaatttttctgggaacacacctgccttttgtgtaatgcggggaagactaatgcatggtgacacctagttttcctcaacaggacacttgatcccaaaacccctttaagaccttaggtttcctcagcggaaaactgtactttaatcccaaaccccctttaagacatattggggctgggcgcagtggctcacgcctgtaatcccagcactttgggaggctgagatgggtggatcacctgagatcaggagttcaagaccagcctgactaacatgctgaaaccccatgtctactaaagatagaaaaattagctggacatggtggcaggcacctgtaatcccagctactcggaaggctgaggaaggagaatcacttgaacctagtaggcagaggttgcagtgagccgagatccccccattgcattttagcctgggcaacgagagcgaaattttgtctcaaaaaaaaaaaaaaaaaaaaaaaaaaaaaaaaaaaaaaagatacattggtctttaaacccaaaccccctttaaggcatgttggtctcaaggggatttgggattgaagcacagctttctgttgaggaaacctaggtgtcactttttagaacattaaaaagaaagttgtagggtgggcttttccatttaaaggaatgtgatgatcctaggttctgatgagtgataggtggtctccgtttataccctttcttcttttggcacctgtaagttccggtagtggccatcttacattctcatgtcctgctggaagtgcctagttgcctgcaaagccagctaaggcttattatttcaaaagaagattatttaaaacatgagtgacaggtagtcagaagagaacaaaaggacgcaagatactctatagccaagtcagcttggaggcaggatgggttgctgagtgaagtcgccgctcacttttggattcttatggactgtgagttagtcttccctctacacggagtcacaggaagggtataaatgcatgttcctgaggtgccctcccccaaagaatgtacctgcactcaaaccaggatctgtttttgctgttttaatcataaatagactagttagtagaagacttttgaagaacaaagtaaaacttttttttttcattaaaagatgtcccagaggaaaggccctgtgcagccagtatattctaatgactgcctggaccatgtcctaatatggtggttttaagttgttggccaaaatcctttaaagacatacgaaacatctgccaactttttagcgaacttaacaggtttcactgacgttttcctcaatttttgaatttaggtgggatttgctttcatgtcctgtttcaaaaaccaagtgtctcttgacagcccactggttcttcctgtcctcttgctctagtctgtatcagaaagcagaatgactgtacttttgttttacaaacaaccacctgataggacggacactccacgagataaggaaaggcacgtgcccttgagcttgaatggaagcagcctctggagggggcagccactgcccttcgagggagagcagctcttcagcagtggccagagtgccacgtgactctgcagatgacccctgggagccgggtgatgggcacctgctggggcttttgttttttctttttcactggctggcttgatcctcagtggcaaaaggacccctgagccccttctccgagccctggagcactcctcgggacaccgagtggcctcagggctgggttcagagctcctcccgcagggggagcctcagaagtggaggcagctgctgatgggtgagtttacaacttcttatcctgcctaaggcgagtaggcgtttttattccgtttccagtccttgagctcagcagatcaaaataacagtgaccctgcaaccccacagagcccgcgacacgctcgctttcttccccgccctgcccctttagtccccgctctggaaggccaggcagtttaggtgtaaataggtatcttttatggtttccaaatgaattatttgtgtgagagtaattaaatctgtaagaaaacctgttgagattcttcactatgaattatgacttctacaacatgtattttagcaaaaacacgatgctggcctccactggatagctcagtatgctgattgccagtgatagttctgtacgcgttaccaacagcgtctttattaaccctctcccacatccagtggaaatcattgctaggcggtatttgttggttggctgttagctttgctttatgatttcatgtttcttttaaaggttgttttgcatgttgaatattaaattttttttttctgtgtcttcctctaatctttttctgtaatgggaatttcagggtaaatacagatattatagcaaag

SEQ ID NO: 7984 - DNA, 139 bp, Homo sapiens
tcacacaaactacttttttgaactagagtgtgttggaggcagagaaaaatcaccctgtgtgctggctttgcctgccgtgagccagtgaggagtccgagaagaggtgggcaggtcagtgatgggtttggccagagatgcc

SEQ ID NO: 7985 - DNA, 661 bp, Homo sapiens
ccagtctcccaggagaggtgtagacatgctttggtttctctctgatatgtatttattattgatcttcagtaaatttgactctgatctgttaacatggggctaatgatacctgcattgcagggttgctttaaaaggattaataatttgtaaaatgtgtagcccagaccccgccgtccactaagagctcagtaggtgtcactattatcattgatgccacttagcaaatatgagctctttaaatcattatgacaactttgaggggaagatgcccttagtccattgtacagatgaagaaactgaggcttagtgaggagaatggatggcccctgggtcccatctcccgtcgctagagaactggggagcaagaattggagttctggccgggcatggtggctcacacctgtaatcccagtactttgggaggtcgaggcaggaggatcacctgagcccaggagttcaagaccagcctggacaacatggcgaaacgccacatctacaaaaagttttaaaaattagccgggtgtggtagcacgtgcctgtggtccctgttgcttgggaggctgaagtgagaggatcatttgagcccaggaggttgaggctacagtgagctgtcattgcaccactgctctctagcctgggcagcggtgtgagaccctgtctc

SEQ ID NO: 7986 - DNA, 139 bp, Homo sapiens; identical to SEQ ID NO: 7984

SEQ ID NO: 7987 - DNA, 86 bp, Homo sapiens
  misc_feature (21)..(21): n equals a,t,g, or c
  misc_feature (65)..(65): n equals a,t,g, or c
  misc_feature (74)..(74): n equals a,t,g, or c
  misc_feature (76)..(76): n equals a,t,g, or c
  misc_feature (85)..(85): n equals a,t,g, or c
taaaaaaaaaaaaaaaaaaanaaaaaaaaaaaaaaaaaaaaaaaaaaaaaaaaaaaaaaaaaaanaaaaaaaananaaaaaaaana

SEQ ID NO: 7988 - DNA, 130 bp, Homo sapiens; identical to SEQ ID NO: 7216

SEQ ID NO: 7989 - DNA, 165 bp, Homo sapiens
gggggggttggtttaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaa

SEQ ID NO: 7990 - DNA, 143 bp, Homo sapiens; identical to SEQ ID NO: 7217

SEQ ID NO: 7991 - DNA, 116 bp, Homo sapiens
aaaaaaaataaaaaaaaaaaaaaaaataaaaaaaaaaaaaaaaaacaaaaaaaaaaaaaaaaaaaaaaaaaaaaaaaaaaacaacacaaaaaaaaaaaaaaaccaaaaacaaacag

SEQ ID NO: 7992 - DNA, 151 bp, Homo sapiens; identical to SEQ ID NO: 7218

SEQ ID NO: 7993 - DNA, 125 bp, Homo sapiens
  misc_feature (33)..(33): n equals a,t,g, or c
  misc_feature (49)..(49): n equals a,t,g, or c
  misc_feature (61)..(61): n equals a,t,g, or c
  misc_feature (90)..(91): n equals a,t,g, or c
  misc_feature (116)..(117): n equals a,t,g, or c
gttgtggaaaaaaaaaaaaaaaaaaaaaaaaanaaaaaaaaaaaaaaanaaaaaaaaaaanaaaaaaaaaaaaaaaaaaaaaaaaaaaannaaaaaaaaaaaaaaaaaaaaaaaannaaaaaaaa

SEQ ID NO: 7994 - DNA, 151 bp, Homo sapiens; identical to SEQ ID NO: 7219
  misc_feature (4)..(4): n equals a,t,g, or c
  misc_feature (45)..(45): n equals a,t,g, or c
  misc_feature (89)..(89): n equals a,t,g, or c

SEQ ID NO: 7995 - DNA, 118 bp, Homo sapiens; identical to SEQ ID NO: 7220

SEQ ID NO: 7996 - DNA, 195 bp, Homo sapiens
  misc_feature (3)..(3): n equals a,t,g, or c
  misc_feature (30)..(30): n equals a,t,g, or c
  misc_feature (32)..(32): n equals a,t,g, or c
  misc_feature (37)..(37): n equals a,t,g, or c
gcncccaatacgcaaaccgcctctccccgngngttgnccaattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgaacggataaca

SEQ ID NO: 7997 - DNA, 1276 bp, Homo sapiens
ttttttttttttttgttgttgttgagatggagtctcgctctgtcacccaggctggagtacagtggcatgatctcggctcactgcaacctccgcctcccaggttcaagcgattctcctacctcagcctcctgattagctgagattacaggcgcccaccaccacgcctggctaatttttgtatttttagtagagatggggtttcaccatgttgaccaggctgttctcaaactcctgacctcaggtgatctgctcaccttggcctcccaaagtgctgggattacaggcatgagccaccatgcctggccaggcactgtgggttctacaggatgggtctgtaatgtcacggtgagggctctctctagtagtagatctggagtgaggtgtgtcttgggttgaggaggtggcttgactttcgaatgtaaaactgactgtgccttagcatcaccctgtccagtgcccctggggcagctggtagtgtccagaagaatggacacctgctccagatttagatgcccatctgggcttttgtttgatttgcggcgttcctgtcttctgtaaagctagtgagttgtcccaagagactgatgccacagcttgttcgcagtttacacaaactcagctttaaaattccaaatagaatctgacttgcaaactctagctgcagcatgtggagcttctagatgtttactaccttgaatggttgtcagtgtcactgaaccacaggggagaggagtatggggtagagcaatggtctgggccaaggaatggtgagcttagggtcttcctctgactccttactcctcaaggaggcagttagggtccctcttaagcaggcttctatttcttaccactaaattggtttcctttttcatccagaagttagaactccccagatattcacactataggatctgaattccgagattctaaaatatcttaaaccacaagagagaaaatctagttctgcctcagccccagtcagcaggccatctgtcccttcctctcctctgagtcagacagctctggcaagcaaggctccttggctagttcctaatgcactgacaggagccctcccattaaggacgacttctactcaaaatgcgactctccctctgaacttcagatgcctctgttagcaggaaaaggcattgattggattggatatatttatgtgactgcgggcatttgtggctgtagaatccgtgaccgtaatgttatatgtaatgggaactatcttataaacttgaaaaaaataaagtttttattttctatagtt

SEQ ID NO: 7998 - DNA, 487 bp, Homo sapiens
gagtggtacccccaccatgcacgcaagcacacacacacagatacttccctctccacccttttgggagctctttattttagaatgtaacttgaactcacttttatcattggcctttttcctcttactctgacttcctagcttagctctttccaaaaggaacttgaacttggccaagagaggtaaggaggctgagcagagcagtctttgctcattcctggttgttgccaccctcatttaaatggaagagagaaaacaggagcttcttggctgtttgccaaaatgaattgtccagggaacacagtgctctctgtaattaccctgcctttttctccaccccaacacaaaaatctggaaaggaaaataagtgggtaggattaagagctgttagaagctgaggaccaaaggacactgtgggtccattcatcaagggggagaccctcttcattagagtcctcatgaaattagccaaatgatgagtccttcccta

SEQ ID NO: 7999 - DNA, 8093 bp, Homo sapiens
caaaggcataagttgggagcgactgagccactccaggaggaggtgtgggcccacggcgtgttggaggtggagccacaggacctgtccataggttggatgctgtgtgggtgacagagagaaaccggggctcacggcctgggcagcgggacgggcggagtcgtcctcacctgtgctggggaccctgtgggagcagcaggcttccgagcacgtgctggaccccggcgtctccggctgcaccgagtggtcaggacattgaggccgggtcagggagcgtgagataccgggacgagcgggcccagggctgagcccagcggcgtccgggtgggcggtggcgttgagatgggaattgggaattgcaccggtggtctcaggaggatggaaaacccaagcagcagctgcaccaggaccgaggcaaagggaccgcagtttaacagaaaacccaaaacgagagcgagaaaacggccaaacacccgtgcgagtgagacgtccatgagccttcccggcaaaacgcccaataagggagaaggggcaggcgcggcgggggccggggttccctgaagtccccttcgtttccagaatccctaaagatcattccgccccccagggaggaaacccaagctccgccgagcgcggcgggtctgtgccttcgcttcgcttccagcctctcgcttccttctgacccgaccccgagttctttctccggacggtgtcgagaacccgggcgccggctggggctggagtctcgctggcctcggagcgcccccgagccctcgggcgacagcgaggcgaggacccaggtggaggcggccgggggcgcgggcggagggaggaggcgcgggagggaacccccggcccgcgggccccacccacagccgccccgggacgcagctcggggtccaggctcgagctttgctcactcagggcgcttcgtgcagggaacgccaggcccccggacgcgacccacgcggccgctgccagcggggaccgaggggagccggggccgcggccgcgagtccacgtcccgcccccgggcccggcccagcgaccgcccccgccgcccagggaccgcccccgcctcccagcgaccgcccgggccctcggggcggggaccgcggaccttcctggtggcgcggcagccgggcggctcctccttcctcccggccctggcgtggagcagagggacacaggttcccacgctggcgcccggcgaccgggtggggctgcggtgagtcccataggcccccgccccgcagctcccggccgccccggcccgtccccccagcccccggtcgccccatcctccctcccccacccgcgcctgccccagccgcctacacccccgagacccccacccgcccggcgccccggcagccccggactccctcccccatcccgcccagcgctccccccaccctccacacacgcccgcccccacgtgccaccaacagacgcaggtcccgaccacagagggtgggggcaagaccggggttgtggggggtgcgtttggaaagcagggttaggactggaattctaaggtagcaggagggagagacacactcaggggctcagctgggttcctggagatcaacctttggggtctgagcccctctgagagtcgagctcctttcctgcgaggccccgtctaggaggggcctcaggaaaatcggggctgcccagctggttccgcaactccccccagttctgagggaggcttcaggggattacagacggtctcaagagggaggcccagccagtcccgcggcccctgacaccccatcaggccgctcaggcccagcagctccatggaggacgccggcgaggaccccaccacgtttgctgcccactctctgcccagtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggtagcgccacctggcctgcctcacccctgccccaggcattgttccaggtcggtggggcaaccacagcatcgaatcccaccagcacctcctgagtttacacaggaagtctcactaagacaggaggccccagaggcccgcagggtccccccttccctccacctggaggcctcctgtgcagctgtagcgggaacgagcagccgagggcccagagggatccgcctcattgtggggagaggcagcggtcgggtggtccactcctgccccagagaggccatagcttggcaacccacctgccttcgcttctgcctccccaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtaaggagggggctggatttgcagccagggagtccagggagggagctcatccctgaggcatggccacgctctcacaggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggtgagcactgtacacccagcaccagccacacagcaggcgacacatggaggtccacggtctctgccctccctgggaccagggctatggttggggaagcacagggactgtggcaaaagggaagaggcctggaaggtgtgcaggagtttggtagaggagtgatctaggtgaggggaatggaaggtgcagagaccagagctgagagggcctgaggcactttccagagcgtggggaggggcctccaccaaggcgagaagggctgcaggtccagatcaccagcgtttgtagacagtagtgtggcgcttggagtttacctgagggccagtggagctccagggacctatcaggacggggacctgtggggactgggaaggcctgtggggctgcgtggagcccggtactggaggccgacgggggtgacggggacgctgagggcacagagcggaggggcatgatggctgctgggcgtggaggtgtcgagagtgactgtgctggggctgctccatcgttgtctgagcctcccggtgctgccgctgtggccgtttctttgatgaggctctcagaggccgagtcattcactgccagcctgaagctgcccatgcgcatattcgggctggagcctctgaggccacacaaacgccggctggggaggcgaagtgtggggctgagcaccagaactccaggagcgtctgggctggagacagaactgggtgggcaggtggggagggcctgcagatctgagtgggcagccgaggaggaacccagaagacgccagcgatggagctctgccggggcggaatgtggccaggaggggcgggagcagtgacggcctgtccggcgctagaacgagggaccgtgctctcaggacctctggatgttcccgagtatcctgatgttccacccagaagccgccagggccatcctggagtaccgcatccgcacgctggacggggccctggagaacgcccagaacctgggctaccaggtgaggggacctggggcactggcccgtagggccctgcagggcctgcagcccccacacccctcccaggcctgtatccctctccccaggccccctctggacaaagctgggacatcctagattccccaccctgaggcttgtggggcctcagcagtgccctgcagcccgcacctgagagagaggaggtgggaaccgcagcgggctgggaccctgctttggcccaggaccccctggggtgcccttgctgccctgcaccagggtcagcactcggtgagaactgggcagaagccacctggccccgtgaggacgtgcagtgggccttctagcagtagcacccgccagggtacctggcgcaggccgagccccccctcctccagggcgagggcacgggaaagttggggggccaccgctcccctccaacaaggtcaagtctgccccctcccaacccctcagggagccaagtttgcctgggagagtgcagactccggcctagaggtttgccctgaggacatttacggagtccaggaggtccacgtcaacggggccgtggtgttggccttcgagctgtactaccataccacccaggtgaggtgctgcgtgcccaccattcctgcaagtgtggccaggcagctggtgtagcccccactcctcgtggcttcctgtttggggctggtcctgggaagctggctgaggacaggtgtctcaatgccaggccttgcttctgggcacagacaggccactaggaatgagagtgactggggccctggcctctgtgcctcctcctgctccccaggacctgcagctatttcgagaggctggtggctgggacgtggtcagggctgtggccgagttttggtgcagtcgtgttgagtggagccccagggaggaaaagtaccacctgaggggtgaggccatggtggggaggggctcggggaggaatggtggatgctcccagactcagcagatgattttcagacacctcacgtgtgccagccccacgctgaccaccggcgtggagggaaggcctctgagactctgcactgagcaccatcttggacttgtgtgtccaggagtcatgtcccccgacgagtaccattcaggggtcaacaactctgtgtacaccaacgtcctggtccagaacaggtcagacacaagatcccctcacctcaccccacccccgccccagctggagacctgccccggtgcccccactaggcaggcagcagctggaagtgtaggggttgcagcctcccccacctacctccacctccagcctgcgctttgctgctgccctggcccaggacctgggtcttcccatccccagccagtggctggcggtggctgacaagatcaaggtaccctttgacgtggagcagaacttccacccggagttcgatgggtatgagcctggtgagtggaccccttcaagggctcctcccctgccgtcgagaccctcgagtctgtcctggaacaccttccagtcagcggcacctccctgtaggagaggtggtgaagcaggcagacgtcgtgctcctgggatacccagtccccttctccctgagtcctgatgttcgcaggaaaaatctggagatttacgaggctgtgacgtccccccagggccccgccatgacctgggtgagcaccctggggctgtggagttcctaccccattggcctcagtcttctctgcccacgcagtgggcctcacccctgtgtgtcctcttacctctgaccccagagcatgtttgctgtgggctggatggagctgaaggacgcagtgcgggcccggggcctcctggacaggagctttgccaacatggctgaacccttcaaggtcagcctggccacacctgcctcccactgggccccttgtggtgggagtggagcccagcctcagagcaggcacagcagggtgcacccctggagcttcctgccggatcttgggacagcagcccagagaggacggtgacctgggggtcctggtgtcagctgcccttgcccctgcaggtgtggacggagaatgcagacgggtcaggcgctgtgaacttcctgacaggcatggggggcttcctgcaggcggtggtcttcgggtgcacggggttcaggtaagtgcagaggctggcagagggcagcccatgcccccacctgccacctcacaagcctctcctcccacagggtcacccgagcgggtgtgacctttgaccctgtgtgtctgtcggggatctccagagtgagcgtctccggcatcttctaccaggggaacaagctcaacttctctttttccgaggactccgtgaccgtggaggtcacagctcgagcagggccctgggctcctcacctggaggctgagctgtggccatcccagtcccggctctccctgttgccaggtagaacagcccccaacagcccaggtgcctgcgaccccaggctgcccctcacccccaggctgcctctctccctgcaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggggtgggatggctctcttccctcagccacgccgcttgtgaggacagaggtgggggagtgggaagtgggaagtcaccagagaacaggagagggatttgagggcgagaccccagcgctctccacggaccagccagagggactggagccaggtgtgcatgggttcaaggccctggccctgcccagcctttgtcttgggagctcagccccagggttcggtcgtcagcagtttcccaagaacaagatgtgatggcatctgctgctgaaaccctgatgaggaccaggccccctgcaccgctgtcagcctgaggaattaaagctttggtgctggggagagcattattcctctgaggagccgctgtgcttccttctgaagtgagggccgtgccccgggtcccatttctcctttcacttgagtcgggaagcacagcaactttaaggctcgcgcccagcaacatggctcccctcgcatctgcatctccctcctgctctggtgttgccgctgcaccctgtcctcggaggacagcagaggtttggacggagactcagggagggagggaaggaggcaaggacgcctgtggaaacatctttcaggcagctctagggtctgggggccaggatgcctgggtctcccaaggcctgtctgctgtctctgccaccctcagcggctgccagaagcagcgtgtgggggaggcatgtgctgcagcacacctgcggccgagaccagcactcagaggtcggctcccctgacaggaaccgtgtagggtgca

SEQ ID NO: 8000 - DNA, 245 bp, Homo sapiens
tgacgactgggcatttgaaaacccgaaggagtgagggggcaagccccaaagaggtcttgagaaaaagggcttcaggcaattatgctgccagagcaagccaggcggggagcttggaaagctccagaagcagcaaggaagccaggtagcgacagcggagtaggggagggggaggagatgaggtcagggaacccaggcaggtgcaggaaggggtttgcgggtggagcttgcgtgcttggaaagctcca

SEQ ID NO: 8001 - DNA, 947 bp, Homo sapiens
ccagagccagggtgatgtgggcacaggtgtcaagtcagggtggtcggtagccttgcgcccgcaggagagatatggcctgaagcctgctgcacgtgcgtgccacacgcgtgtggggccacctctgcacatcctgaggtgacccttttgggggggtcgtgatggtcagtgcacgtgtgccggcagggctggtcagggttcatcgcctgcccaggagcctgagcctgaggcagggaggtgctggtgaccgttcccccaaggtggctcacccacagcaccgggaatggaccaggtcgtccctgcccctcagtaagcctggggactggcagaccgtctcttttctggggacacgtatccagccacacatgggctgaccccctcccagtctctgcacccgacacagtttgatcccttctcaggccaatcctgaggctcagggctggcacactgtctctatcccaaggcaagcacaggtgggcacactgcccttgtccttggtccactgtgggactggtcctgtctgtctccagcgcccagcatggcctccacacacctctgcctccagggctggctgggcctgccctcagagtccctgccacgccagccgttggctgcaggcatatcacagataggggatgctgcccagggctccgagtagaccaaaagattcctgcccacagcccaggaagagcaggcaggcaacggcgattccccgggaagggaagggccccggagtggggtgctcagaaccctgggccactgtgctgttaaccaccacctcccggcaatggctggcctcagcgaggccccagggcctccccgcagcctcgcagtgtgcatgtccctggccctctcccatcaccaggctgtggtgggtgtgtggggaggctgtggtacacaacgcaggtaaaataatatgagaacatgcacccagcaccaggggactcaga

SEQ ID NO: 8002 - DNA, 660 bp, Homo sapiens
ggaaaccccggagcatgtttagaagatgacaatataatgatcattatgttagtcatgaaatgggaagaatctatcatttggcaccatttggtactgtgtgccaactctggcttaagcattttgctcatattaccctgtaaggtcaataattattatccccattttgctgtagagaaaactgagtattctgatacaactttaactttcctggggtcaaaaaaattatcagtatcactaggatttgaactccaggtcaatctgattttaaagcatgtactcttaagcattagaacagtggttcttttgactgggcatggtggctcacacctgtaattccagcactttgggaagccaagggtggcagattacttaaacccaggagtttgagaccagtccaggcaacatggcgaaaccccatctcaacaaaaaatatttaaaagttagacaggtgtggtggcatgcacctatagtcccggctactcaggaggctgaggtgaaaggattacttgaacctgctaggtagaggctgcactgagccaagattgtaccactgcactctagcctgggcaacagagtgaaattctgtctctaaaaaaaaaaaaaaaaaagagaaagaaagcaagaaagaaaagaacaaaagcaaaaacaaaaacaaaaaaa

SEQ ID NO: 8003 - DNA, 664 bp, Homo sapiens
ggaaaccccggagcatgtttagaagatgacaatataatgatcattatgttagtcatgaaatgggaagaatctatcatttggcaccatttggtactgtgtgccaactctggcttaagcattttgctcatattaccctgtaaggtcaataattattatccccattttgctgtagagaaaactgagtattctgatacaactttaactttcctggggtcaaaaaaattatcagtatcactaggatttgaactccaggtcaatctgattttaaagcatgtactcttaagcattagaacagtggttcttttgactgggcatggtggctcacacctgtaattccagcactttgggaagccaagggtggcagattacttaaacccaggagtttgagaccagtccaggcaacatggcgaaaccccatctcaacaaaaaatatttaaaagttagacaggtgtggtggcatgcacctatagtcccggctactcaggaggctgaggtgaaaggattacttgaacctgctaggtagaggctgcactgagccaagattgtaccactgcactctagcctgggcaacagagtgaaattctgtctctaaaaaaaaaaaaaaaaaaaaagagaaagaaagcaagaaagaaaagaacaaaagcaaaaacaaaaacaaaaaaaa

SEQ ID NO: 8004 - DNA, 420 bp, Homo sapiens
tgcctgtggaattttctacaactttcctctagttccattagttacctcctaccccaggactgggcttgataagcctcatgagaggctgagtagatatttaatctctagactaagcctattgatttcctactttctgccacttggtcaaactttggtctccttttataataatgttcttatataataaacttgcattctttcctttttcttccccagaatactgacctttcatacttttaggaactgtggatcagtatttaaaggcaagattttgatcttcaaaaatttttttctccttcttaggcaccagactcttacagttcatgagttagaaactcaagaacaaatacaatactttggtctttctggttctataggagtgagagagagagtgatgtctgcattctacaaatactagcc

SEQ ID NO: 8005 - DNA, 420 bp, Homo sapiens; identical to SEQ ID NO: 8004

SEQ ID NO: 8006 - DNA, 1218 bp, Homo sapiens
gtcaccttctcctcctttccctgctgggggtggcaggggtccctttaccccctcattcttgacccttctccagggatgcttgtgacctccttaccccaccccccatcacctctctgtcctgaagtgagggtttgtcaccgtccatggcaaggtgtggtgtctggtaggctctatgacctgccttctctcagggtgtttattctgcagcagagaggggtctgcggtctgagtgtaatggtggaaatccaggcttccttccatggcccaaggaggcctttccggagcaacagggttttcctgggactcagcctggcttttgttaaggcaggtcccggatttactcagaagatgggccccagagaggaggagaggaaaggaatacctgtcagtcaaacgtgaagcccactgatgacactgcctggcagagctgcctccggtcagcagtgacccttcaccccccagctcccaagtcctcttcctgagggagctggtccggctttatggaaggctccgcctgtgttcccccactgggtccctggtccctcacctgtcacgtggggcgatggtcaccctccctccctgcctgccctgaaggatacactgagatgaaggtcaggaaatctgctggctgcagaaccaggggccatgcaggagtgagggatggtctggtcaagttgaggctctgccccagcctcagtttccccacacaggcatgagactgtcttcctgactttcagaggacagggctgagatgggatgagggaacacagggaaagcgtttagcacctctgagtgctgtgtggatgcgacctggggggtcctggcctccactctttaattctatctggactgtgtgccctcctacctccagtttccctgcgggggcctttcacagggcctggcttgcggatacggggtttggcgtagggcagtgcttctcaaatgggaaggcgcactgggattcttcaggttggggtggggcctgaggttctgcatttctaatcagttgcctaggactggctctaattcttgttgaatttacaatcacttgtggagttaagaaaaacatactgggccttggttgggtgtggtggctcacacctgtaatcccagcactttgggaggccaaggtgggcagatcatgaggtcgagagattgagaccatcctggccaacatggtgaaaccttgtctctactaaaaaaaaaaaaaaaaaaaaa

SEQ ID NO: 8007 - DNA, 142 bp, Homo sapiens
gggcagtggctcacacctgtaatcccagcactttgggaggccaaggcgggcggatcatgaggtcaggagatcgagaccatcctggctaacatggtgaaacctcgtctctactaaaaatacaaataattagccgggtgtggtg

SEQ ID NO: 8008 - DNA, 151 bp, Homo sapiens
ggtggcaggcgcctgtaatcccagctacttgggaggctgaggcaggagaatcacttgaacccgggaggtggaggttgcagtgagctgagattgcaccattgcactccagcctgggcaaaaagagcgaaactctgtctcaaaaaaaaaaaaa

SEQ ID NO: 8009 - DNA, 7712 bp, Homo sapiens
agggatctgcaaagacttggagaacttcaatctgaattggcaggagtagctgatttctctgccacctatcttcgctgtcaactacttctcatcaaggttggtttgcatccattccatttatgattgtgttgctaaaaatgcatctttgtggatccagcagtgtgtgaggccataagttataaaacttatggtcttaatgcaaccacttgacaatggagaaatatgtactctgcagtgtgattacatttgtctctaattaacgaaatattaactcataggaatttgtaaatttggggagaattcttttatcataatataattagagcagattggataatcattttagttagaatcccaaggttgtaaatgttttgtataatttgattagcaaaggaattgtatgaagttttagactatcttcttaaaatgctcatttgaaggccaggtgcggtggctcacacctgtaatcttagcactttggcaggccaaggcaggaggatcgcttgagctcaagagtttgagaccagcctgggcaacatagcgacacctcatctctacaagaaaatttaaagtaggcaggtgtggtggtgcattcctgtatatccagctactcggctggagttgggaggactgcttgagcctaggaggtcaaggctgcagtgagattgcactccagcctggatgacagaccaagatcctgtctttaaagaaaacaaacaaacaaacaaacaaaaaaactcactgcacttcatcaaagttaaaaggttgatttcattgcttttaaaaagaccagcttgctggcgtttcttactcagtagtcagctatacacagaattggtacccaagaatctatttagttttgctgagttaaaaaacaattaaatgagttcagtatctttcagcttctgtagcagaattttactataaattttggcacagaatttaggagagcccttctcacttgacgaacttttatcttggccctagttcaaagtgttctttgttttcaaagtgattaatgatgtttggctaaagtcagagtaaatcagggagtcaaaagttattttctactgtgtgaacttgtgctaaatgttatatttacagttgtgcaggtgtgcctatacatgtaaaggtgcgtatgtatacttggcacttaaatggtccttgttaggctagatatgttctttctaatgtatatatctgtgtaatcaccaccataggcaagtcgtagaacattttcatcactccaagaagttccttcctgcccctttgcaaggttgtttggcttttccaagcctctgtgaaaccccaggaattcaaggaggccatggagaagaatccacttttctatagtagcaaaatatgggtgaggaaagagaagtgattactcctaaaaagaacacataattgttggttattcaatgacaaggggtgacagtgtaggtgaggggcccagagccagaacccaaggcaagtgtgtttaataacaggaaaaaagctaaataaattttggtacagctacctagcagtatattctgtagtcagtaattctttatgaagaattatacaacaacatgacaaaatatttagggtgtaatgttatgtacccaaaagaaggggagccaatcataatcccaaaagatagtccagaacatcatagtcctaaactgtttaaattccaaaagactaaaatccctaaggtctaaaatcccaaaaaccacagcccagaaaatatcaaaatccccaaaatataattatggaagaaataatttaaaaaatttaaagatatttattttttaaaggggaatttatttgagaaacataaaaacacaacagaatactttatacatcacttaatataataaaacagacaataacaacatacatttttgcaagcataaacactcaggttactaatgacagttgggtgggtctaacagttatgagcagatgagccatatttataaagaaattggtcataaagggaaaggtataaatgcatatcactttggttgttaattgtgtatacccagctttttaactgtggtcatctgaaatactgtgcccaacaacctcaagtcttttgacgagattgatggaaactgtgctgggtcaccactgcatatgcagtcacccaaagagctgagatctcaagaaattttatctttcacaaatgcagatgtacgaaaaggatatctcatttatcgaggaagtttcaacattttgtgtacacactcaatgcttatacacaaagtcagtattgtgatgatgcactttcatggagtcagatttctgatatccaagcagcagaacccagagagtccgttttgctaatatgccatttttttttttttgagacagagtctcagcttatcatccaggctgaatacagtggcgtgatctcggctcactgctgcaacctctgcctcttgggttcaagcaattctcctgtctcagtctcccaagtagctgggattacaggtgtgcaccaccacgcctggctaatttttgtatttttagtagagacagggttttgccatgttggtcaggctggtctccatctcctgacctcaggtcatccacccacctcggccttccaaagtgctaggattacaggcatgagccaccactcccagcccatttcgtcttaagtatttgttctctcctggccactggctgattggatggtgcccgccaacattgagggcagatagtctccacttagtacactcagatttatacactaatctcttctggaaacactctcatagacacaccctcaatgtgtaaaacaaaataatcttttaccaggtttctgatattccttaatctagtcaagctgatatctaaaattaggtccacaagtccaccccttgtcagcttggcactcatacgcatctccttaagccatatttaatttccaaataaagacaataacatggtaatagttgtgcctaacatgatacaactaacatgatgcaactatcctgcatacaacccaaaacacgctaatcacttccccagaatttggatgtgaggatttcaacatttgggattgtatgttttgggattatgatctaatccccaaacttaattctgctttctgactacaactgtcaaaaaacatgcatacaagaaatgattagaagtaaatattccagaaattcctatagtttttatctacagtttagacctaccactgtttaatttgatagccaccagatacatgggactcttgagcactcaaaaagttgttagtccaaactgagatgtgttattaagtgcaaaatacacactggatttctcagacttagtatgaagagaaaatgtaaactaattaataatttaaaaaatactgcatggtgaaatgttaatatcttggatatactgggttaaataaacttttttaaaaaattaacttagtctttgtatcttaaaattaacttacatctttgtaatttaaaaaccgtggctacgagaatatttaaaattatatatagctcatgttatatttctattggacagtgttagtctaggttttctgtaatgtcatttgattacatctgtaattcagaaggactgagaaaataagaggctgtcacagaagtttgtgcaagggatgaggtcatgtggatggataggtgaggagagagatggaaggtaaaatcatggctcttagtggtggttttgaatgtagaaagattgaaagagggagaaatctaggaaagctgcttgatttctagttgaatatgttgataaagtggttggggcttacaacataatgagcataggggaaaagaaaaaagaaccacagttaaggaagaagtatctaggtggcttgggttagtccagtagctctgggaacaaggagtgcctagagcccggaagctggcttgcctgcgcattctggtgaagctttcgtggttcctgtcctctgcttccagaagcactgatctgggacacagagcctttgggccaagaattggatcaaatgggtgggaattcatttagcccaaaccattggtctcatctttctccataatagatacagcttattgggttaaaagaataagatcaattgagaagtcatgttcatgggagactttcaaaggaaaacaaaaatgtaaatcccaaatgataggccagtctttgtgacctcggtattctgttccctcctgatttgtctgcgtaggccttgcaggaaaagttgtggaatgtagctgcccctttgtatttgaagcagagtgatttggcctcagcagcagcgaaacaggtaagcttattcagaccttcccttcaaataggtctctgtccagtaattgtctggtccaagacagagccagaggccttcctatagctctgtctgtgtaggccttgcaggaaaagttgtggcatgtagctgcccctttgtatttgaagcagagtgatttggcctcagcagcagcaacacaggtaagcttattcagaccttcccttcaaataggtctctgtccaggaattgtctggtccaaggcggagccagaggccttcctgtagctctatacctctgctgtggcctccctaatttcaggctatgacagaagttagtgatatgagaaggagcataactaggagacacagcactcactttggactcaggggacctgggtcctagtcccaggtcttcctctgatttgctgagtgatattgagcaagttacttaaattccctggattttttctcttctataaaatgtggcagttgggccgggcgcggtggctcacacctgtaatcccagcactttgggaggctgagatgggcacatcacttaaggttaggagtttgagaccggcctggccaacatggtgaaacgctgtctctactatcatgaatctttcatctgaaaatgtagcccaactcagttaaggttgtttatatctttagcctgtaccatctcttcaacgttaaaaggtcctgggtagttcattaagtaggctttaattttatttgtctctagtttatttctttttagctttgagtcattcccctttgcacctgagtattgagacttggtgatctcttgcaggtcaagtcttccagatagggagtctgtaaatgacccaggaggaagctaatgatggtgactgttattgttacattacagttcactaaatgatttcaagtctattagcttaattaaccctcataataatcccattagataggaataagtattaagtctgttttagagatgaggcagttaaggctcagcaaggttaaattcatagagctataggtaatacagtcaggacttgagaccagatcctctgatacccagaatctgttttctactacagtgctgaactcttgtctgatccagactctttctcagacctggtatgtggcttattgtagaagagtagaatttaatgactagaacccgataattgagccacattggaaggatgggaccagggagcaataatttggaaggaaaagaggaaaggaattaccattgctgtataccagatactgtgataaacacattgcatgctccatttgatacttgaaacttcatgatattggtactgtttcttccctgtttacagaaagggattgagacactcatgtaatttaacttgtcttattgccaattgtaagagagtctggagtcatttccgtgaccctagagtgttcactgggaggcaagcacagaaggaaaagagaagcatcattttgatgaaaatcgcttatttggatagaaccgagcaagatcggggacttgatctggggtcatagacaaatgttttcttgcacttatttctgtcccaaactccctcagaccaggcccatggaacagtctgtcaggataactaacatatggttaatagttcctgatgcttaattcttgaggactttgtggggattgggtttccatacataatatatattaatttgttcccacagcagagtgggcttcatttagggtaagaagcagtgctttcagtgctttgcagtttgcttagtgattaaactttcttatcttcacatcatcaactaagatgattttattaccaggtcagtcttctttttaagtaggcaaaataatttattctctttttacaaggcatactatactaatttctttcaacacttaaaagcataaggatgtaaaatctcagttaagagtttcacctaaggtcatttaacagtagaattctatgctgctctcaagtaagactatgatatttttattgattgttaattatctttcctttatagattatggaagagacctacaaaatggaattcatgtacagtggtgtggagaataagcaggtggtgattatacatcacatgaggctgcaggccaaagctttgcaacttatagtaacagcacgaactacacgagggtaagatgtggggttggccaaaatatgtggcatgttcctttcaaagatacttcaaatgcattcagacatcacacgaaagttaatgataagtgaaatgaaatttaggaaagactagctaaggaatgtgtgatctattcatttttttcagatattacaaattctgttgttggatcagattagacccttggaaatccaattgtgtctctcccttgctaaaaaccctctggtgactctccattacatatagcacaacactggactttatctggcaataaggacactctgtatcctcctacttgatagatttccttaagaatttagtgccagggaccactttttctgttctgaagggactaataagctttttctcaggcaataaggataaattaagaggatgtactgggaagtcagactactttgttcaaatcttgtcttttctacttactagttgtttggttatgaacctttctgtaccttgtttccctgtacaaaatgaaaatgaagacagcatctacctcatggcatttctatgaagaataaatgagataatacatgtaaaaacacttagcatggtacttgatacgtaataagagctcagtgtaattatatctgtaagactttcagataactggaatcgccacatttcattgattccaagatacacattttttattattgtaacttctctgaaatcagatattttgatggtgtcccatagtgttttttgtttcttactatttcataaaataaaggtgcatcttaagaatgatggcatcatagatttgatacaaaaaagtacttaggtgactcattgccagctcacagacatgtttgatgctcagtccagctcctgtgtcaaaaaaaaaaaagtgccatagagatataaatatgaatgcttaaacacagaaacatactaggtcagaaataacatcctgaaaaataaaatattttatttcttcacgtatcttgatagtgacctcataaagtcaaagaatcatttaatcttaaagatattcatatgtggccgggtgtggtggctcacacctgtaatcccagcactttgggaggccaaggtgggcagatcacgaggtcaggagatcaagagcatcctggctaacatggtgaaaccctgtctctactaaaaatacataaaattagccgggcatggtggcatgcaccagtagtcccagctactcgggaggctgaggcaggagaatctttagaacctgggaggtggaggttgcagtgggccgaaatcacaccactgcactccagcctgggcaacagagcaagactccatctttatataaaaaaaaaaaa

SEQ ID NO: 8010 - DNA, 1495 bp, Homo sapiens
gtaagactatgatatttttattgattgttaattatcttttctttatcgattatggaagagacctacaaaatggaattcatgtagagtggtgtggagaataagcaggtggtgattatacatcacatgaggctgcaggccaaagctttgcaacttataataacagcacgaactacatgagggtaagatgtggggttggccaaaatatgtggcatgttcctttcaaagatacttcaaatgcattcagacatcacacgaaagttaatgataagtaaaatgaaatttaggatagactagctaaggaatgtgtgatctattcatttttttcagatattacaaattctgttgttggatcagattagacccttggaaatccaactgtgcgtctcccttgctaaaaaccctctggtgactctccattacatatagcacaacactggactttatctggcaataaggacattctgtatcctcctacttgatagatttcctcaagagtttagtgccagggaccactttttctgttctgaagggactaataagctttttctcaggcaataaggataaattaagaggatgtactgggaagtcagactactttgttcaaatcttgtcttttctacttactagttgtttggttatgaacctttctgtaccttgtttccctgtacaaaatgaaaatgaagacagcatctacctcatggcatttctatgaagaataaatgagataatacaatataaaaacacttagcatggtacttgatacgtaataagagctcagtgtaattatagctgtaagactttcagataactggaattgccacatttcattgattccaagatacacattttttattattgtaacttctctgaaatcagatattttgatggtgtcctatagtgttttttgtttcttactatttcataaaataaaggtgcatcttaagaatgatggcatcatagatttgatacaaaaaagtacttaggtgactcattgccagctcacagacatgtttgatgctcagttcagctgctgtgtcaaaaaaaaaagtggcatagagatataaatatgaatgtttaaacacagaaacatactaggtcagaaataacatcctgaaaaataaaatattttatttcttcacttatcttgatagtgacctcataaagtcaaagaatcatttaatcgtaaagatattcatatgtggccgggtgcggtggctcacacctgtaatcccagcactttgggaggccaaggtgggcagatcacgaggtcaggagatcaagagcatcctagctaacatggtgaaaccctgtctctactaaaaatacataaaattagctgggcgtggtggcatgcaccagtagtcccagctactcgggaggctgaggcaggagaatctctagaacccgggagacggaggttgcagtgagccgaaatcacatcactgcactccagcctgggcaacagagcaagactccatctttataaaaaaaaaaa

SEQ ID NO: 8011 - DNA, 7713 bp, Homo sapiens
agggatctgcaaagacttggagaacttcaatctgaattggcaggagtagctgatttctctgccacctatcttcgctgtcaactacttctcatcaaggttggtttgcatccattccatttatgattgtgttgctaaaaatgcatctttgtggatccagcagtgtgtgaggccataagttataaaacttatggtcttaatgcaaccacttgacaatggagaaatatgtactctgcagtgtgattacatttgtctctaattaacgaaatattaactcataggaatttgtaaatttggggagaattcttttatcataatataattagagcagattggataatcattttagttagaatcccaaggttgtaaatgttttgtataatttgattagcaaaggaattgtatgaagttttagactattttcttaaaatgctcatttgaaggccaggtgcggtggctcacacctgtaatcttagcactttggcaggccaaggcaggaggatcgcttgagctcaagagtttgagaccagcctgggcaacatagcgacacctcatctctacaagaaaatttaaagtaggcaggtgtggtggtgcattcctgtatatccagctactcggctggagttgggaggactgcttgagcctaggaggtcaaggctgcagtgagattgcactccagcctggatgacagaccaagatcctgtctttaaagaaaacaaacaaacaaacaaacaaaaaaactcactgcacttcatcaaagttaaaaggttgatttcattgcttttaaaaagaccaacttgctggcgtttcttactcagtagtcagctatacacagaattggtacccaagaatctatttagttttgctgagttaaaaaacaattaaatgagttcagtatctttcagcttctgcagcagaattttactataaattttggcacagaatttaggagagcccttctcacttgacgaacttttatcttggccctagttcaaagtgttctttgttttcaaagtgattaatgatgtttggctaaagtcagagtaaatcagggagtcaaaagttattttctactgtgtgaacttgtgctaaatgttatatttacagttgtgcaggtgtgcctatacatgtaaaggtgcgtatgtatacttggcacttaaatggtccttgttaggctagatatgttctttctaatgtatatatctgtgtaatcaccaccataggcaagtcgtagaacattttcatcactccaagaagttccttcctgcccctttgcaaggttgtttggcttttccaagcctctgtgaaaccccaggaattcaaggaggccatggagaagaatccacttttctatagtagcaaaatatgggtgaggaaagagaagtgattactcctaaaaagaacacataattgttggttattcaatgacaaggggtgacagtgtaggtgaggggcccagagccagaacccaaggcaagtgtgtttaataacaggaaaaaagctaaataaattttggtacagctacctagcagtatattctgtagtcagtaattctttatgaagaattatacaacaacatgacaaaatatttagggtgtaatgttatgtacccaaaagaaggggagccaatcataatcccaaaagatagtccagaacatcatagtcctaaactgtttaaattccaaaagactaaaatccctaaggtctaaaatcccaaaaaccacagcccagaaaatatcaaaatccccaaaatataattatggaagaaataatttaaaaaatttaaagatatttattttttaaaggggaatttatttgagaaacataaaaacacaacagaatactttatacatcacttaatataataaaacagacaataacaacatacatttttgcaagcataaacactcaggttactaatgacagttgggtgggtctaacagttatgagcagatgagccatatttataaagaaattggtcataaagggaaaggtataaatgcatatcactttggttgttaattgtgtatacccagctttttaactgtggtcatctgaaatactgtgcccaacaacctcaagtcttttgacgagattgatggaaactgtgctgggtcaccactgcatatgcagtcacccaaagagcctgagatctcaagaaattttatctttcacaaatgcagatgtacgaaaaggatatctcatttatcgaggaagtttcaacattttgtgtacacactcaatgcttatacacaaagtcagtattgtgatgatgcactttcatggagtcagatttctgatatccaagcagcagaacccagagagtccgttttgctatattgcctttttttttttttggaaaaaaagtctccgtttatcatccaggctgaatacagtggcgtgatctcggctcactgctgcaacctctgcctcttggggttcaagcaattctcctgtctcagtctcccaagtagctgggattacaggtgtgcaccaccacgcctggctaatttttgtatttttagtagagacagggttttgccatgttggtcaggctggtctccatctcctgacctcaggtcatccacccacctcggccttccaaagtgctaggattacaggcatgagccaccactcccagcccatttcgtcttaagtatttgttctctcctggccactggctgattggatggtgcccgccaacattgagggcagatagtctccacttagtacactcagatttatacactaatctcttctggaaacactctcatagacacaccctcaatgtgtaaaacaaaataatcttttaccaggtttctgatattccttaatctagtcaagctgatatctaaaattaggtccacaagtccaccccttgtcagcttggcactcatacgcatctccttaagccatatttaatttccaaataaagacaataacatggtaatagttgtgcctaacatgatacaactaacatgatgcaactatcctgcatacaacccaaaacacgctaatcacttccccagaatttggatgtgaggatttcaacatttgggattgtatgttttgggattatgatctaatccccaaacttaattctgctttctgactacaactgtcaaaaaacatgcatacaagaaatgattagaagtaaatattccagaaattcctatagtttttatctacagtttagacctaccactgtttaatttgatagccaccagatacatgggactcttgagcactcgaaaagttgttagtccaaactgagatgtgttattaagtgcaaaatacacactggatttctcagacttagtatgaagagaaaatgtaaactaattaataatttaaaaaatactgcatggtgaaatgttaatatcttggatatactgggttaaataaacttttttaaaaaattaacttagtctttgtatcttaaaattaacttacatctttgtaatttaaaaaccgtggctacgagaatatttaaaattatatatagctcatgttatatttctattggacagtgttagtctaggttttctgtaatgtcatttgattacatctgtaattcagaaggactgagaaaataagaggctgtcacagaagtttgtgcaagggatgaggtcatgtggatggataggtgaggagagagatggaaggtaaaatcatggctcttagtggtggttttgaatgtagaaagattgaaagagggagaaatctaggaaagctgcttgatttctagttgaatatgttgataaagtggttggggcttacaacataatgagcataggggaaaagaaaaaagaaccacagttaaggaagaagtatctaggtggcttgggttagtccagtagctctgggaacaaggagtgcctagagcccggaagctggcttgcctgcgcattctggtgaagctttcgtggttcctgtcctctgcttccagaagcactgatctgggacacagagcctttgggccaagaattggatcaaatgggtgggaattcatttagcccaaaccattggtctcatctttctccataatagatacagcttattgggttaaaagaataagatcaattgagaagtcctgttcatgggagactttcaaaggaaaacaaaaatgtaaatcccaaatgataggccagtctttgtgacctcggtattctgttccctcctgatttgtctgcgtaggccttgcaggaaaagttgtggaatgtagctgcccctttgtatttgaagcagagtgatttggcctcagcagcagcgaaacaggtaagcttattcagaccttcccttcaaataggtctctgtccagtaattgtctggtccaagacagagccagaggccttcctatagctctgtctgtgtaggccttgcaggaaaagttgtggcatgtagctgcccctttgtatttgaagcagagtgatttggcctcagcagcagcaacacaggtaagcttattcagaccttcccttcaaataggtctctgtccaggaattgtctggtccaaggcggagccagaggccttcctgtagctctatacctctgctgtggcctccctaatttcaggctatgacagaagttagtgatatgagaaggagcataactaggagacacagcactcactttggactcaggggacctgggtcctagtcccaggtcttcctctgatttgctgagtgatattgagcaagttacttaaattccctggattttttctcttctataaaatgtggcagttgggccgggcgcggtggctcacacctgtaatcccagcactttgggaggctgagatgggcacatcacttaaggttaggagtttgagaccggcctggccaacatggtgaaacgctgtctctactatcatgaatctttcatctgaaaatgtagcccaactcagttaaggttgtttatatctttagcctgtaccatctcttcaacgttaaaaggtcctgggtagttcattaagtaggctttaattttatttgtctctagtttatttctttttagctttgagtcattcccctttgcacctgagtattgagacttggtgatctcttgcaggtcaagtcttccagatagggagtctgtaaatgacccaggaggaagctaatgatggtgactgttattgttacattacagttcactaaatgatttcaagtctattagcttaattaaccctcataataatcccattagataggaataagtattaagtctgttttagagatgaggcagttaaggctcagcaaggttaaattcatagagctataggtaatacagtcaggacttgagaccagatcctctgatacccagaatctgttttctactacagtgctgaactcttgtctgatccagactctttctcagacctggtatgtggcttattgtagaagagtagaatttaatgactagaacccgataattgagccacattggaaggatgggaccagggagcaataatttggaaggaaaagaggaaaggaattaccattgctgtataccagatactgtgataaacacattgcatgctccatttgatacttgaaacttcatgatattggtactgtttcttccctgtttacagaaagggattgagacactcatgtaatttaacttgtcttattgccaattgtaagagagtctggagtcatttccgtgaccctagagtgttcactgggaggcaagcacagaaggaaaagagaagcatcattttgatgaaaatcgcttatttggatagaaccgagcaagatcggggacttgatctggggtcatagacaaatgttttcttgcacttatttctgtcccaaactccctcagaccaggcccatggaacagtctgtcaggataactaacatatggttaatagttcctgatgcttaattcttgaggactttgtggggattgggtttccatacataatatatattaatttgttcccacagcagagtgggcttcatttagggtaagaagcagtgctttcagtgctttgcagtttgcttagtgattaaactttcttatcttcacatcatcaactaagatgattttattaccaggtcagtcttctttttaaataggcaaaataatttattctctttttacaaggcatactatactaatttctttcaacacttaaaagcactaaggatgtaaaatctcagttaagagtttcacctaaggtcatttaacagtagaattctatgctgctctcaagtaagactatgatattcttattgatcgttaattatctttcctttatagattatggaagagacctacaaaatggaattcatgtacagtggtgtggagaataagcaggtggtgattatacatcacatgaggctgcaggccaaagctttgcaacttatagtaacagcacgaactacacgagggtaagatgtggggttggccaaaatatgtggcatgttcctttcaaagatacttcaaatgcattcagacatcacacgaaagttaatgataagtgaaatgaaatttaggaaagactagctaaggaatgtgtgatctattcatttttttcagatattacaaattctgttgttggatcagattagacccttggaaatccaattgtgtctctcccttgctaaaaaccctctggtgactctccattacatatagcacaacactggactttatctggcaataaggacactctgtatcctcctacttgatagatttccttaagaatttagtgccagggaccactttttctgttctgaagggactaataagctttttctcaggcaataaggataaattaagaggatgtactgggaagtcagactactttgttcaaatcttgtcttttctacttactagttgtttggttatgaacctttctgtaccttgtttccctgtacaaaatgaaaatgaagacagcatctacctcatggcatttctatgaagaataaatgagataatacatgtaaaaacacttagcatggtacttgatacgtaataagagctcagtgtaattatatctgtaagactttcagataactggaattgccacatttcattgattccaagatacacattttttattattgtaacttctctgaaatcagatattttgatggtgtcccatagtgttttttgtttcttactatttcataaaataaaggtgcatcttaagaatgatggcatcatagatttgatacaaaaaagtacttaggtgactcattgccagctcacagacatgtttgatgctcagtccagctcctgtgtccaaaaaaaaaaagtgccatagagatataaatatgaatgcttaaacacagaaacatactaggtcagaaataacatcctgaaaaataaaatattttatttcttcacgtatcttgatagtgacctcataaagtcaaagaatcatttaatcttaaagatattcatatgtggccgggtgtggtggctcacacctgtaatcccagcactttgggaggccaaggtgggcagatcacgaggtcaggagatcaagagcatcctggctaacatggtgaaaccctgtctctactaaaaatacataaaattagccgggcatggtggcatgcaccagtagtcccagctactcgggaggctgaggcaggagaatctttagaacctgggaggtggaggttgcagtgggccgaaatcacaccactgcactccagcctgggcgatagaacgagaatctgtctccaaaaaaaaaaaaaa

SEQ ID NO: 8012 - DNA, 1492 bp, Homo sapiens
gtaagactatgatatttttattgattgttaattatcttttctttatcgattatggaagagacctacaaaatggaattcatgtagagtggtgtggagaataagcaggtggtgattatacatcacatgaggctgcaggccaaagctttgcaacttataataacagcacgaactacacgagggtaagatgtggggttggccaaaatatgtggcatgttcctttcaaagatacttcgaatgcattcagacatcacacgaaagttaatgataagtaaaatgaaatttaggaaagactagctaaggaatgtgtgatctattcatttttttcagatattacaaattctgttgttggatcagattagacccttggaaatccaattgtgcgtctcccttgctgaaaaccctctggtgactctccattacatatagcacaacactggactttatctggcaataaggacattctgtatcctcctacttgatagatttcctcaagaatttagtgccagggaccactttttctgttctgaagggactaataagctttttctcaggcaataaggataaattaagaggatgtactgggaagtcagactactttgttcaaatcttgtcttttctacttactagttgtttggttatgaacctttctgtaccttgtttccctgtacaaaatgaaaatgaagacagcatctacctcatggcatttctatgaagaataaatgagataatacaatataaaaacacttagcatggtacttgatacgtaataagagctcagtataattatagctgtaagactttcagataactggaattgccacatttcattgattccaagatacacattttttattattgtaacttctctgaaatcagatattttgatggtgttccatagtgttttttgtttcttactatttcataaaataaaggtgcatcttaagaatgatggcatcatagatttgatacaaaaaagtacttaggtgactcattgccagctcacagacatgtttgatgctcagtccagctgctgtgtcaaaaaaaagtggcatagagatataaatatgaatgtttaaacacagaaacatactaggtcagaaataacatcctgaaaaataaaatattttatttcttcacttatcttgatagtgacctcataaagtcaaagaatcatttaatcgtaaagatattcatatgtggccgggtgcggtggctcacacctgtaatcccagcactttgggaggccaaggtgggcagatcacgaggtcaggagatcaagagcatcctagctaacatggtgaaaccctgtctctactaaaaatacataaaattagctgggcgtggtggcatgcaccagtagtcccagctactcgggaggctgaggcaggagaatctctagaacccgggagatggaggttgcagtgagccgaaatcacatcactgcactccagcctgggcaacagagcaagactcctctttataaaaaaaaaaa

SEQ ID NO: 8013 - DNA, 4403 bp, Homo sapiens
  misc_feature (1649)..(1649): n equals a,t,g, or c
  misc_feature (1669)..(1669): n equals a,t,g, or c
tagttttaaaaacttaaagatatttattttttaaaggggaacttatttgagaaacataaaaacacaacagaatactttatacaccacttaatataataaaacagacaataataacatacatttttgcaagcataaacactcaggttactaataacatttgggtgggtctaacagttatgagcagatgagccatatttataaagaaattggtcataaagggaaaggtataaatgcatatcactttggttgttaattgtgtatacccagctttttaactctggtcatctgaaatactgtgcccaacaacctcaagtcttttgatgagattgatggaaactgtgctgggtcaccactgcatatgcagtcacccaaagagctgagatctcaagaaattttatctttcacaaatgcagatgtacgaaaaggatatctcatttatcgaggaagtttcaacattttatgtacacactcaatgcttatacacaaagtcagtattgtgataatgcactttcatggagtcagatttctgatatccaagcagcagaacccagagagtccgttttgctattttgcgtttttttgttttttgtttttttttgtttttttttttttttttgagacagagtctcagcttatcacccaggctgaatacagtggcgtgatctcggctcactgctgcgacctctgcctcttgggttcaagcaattctcctgtctcagcctcccaagtagctgggattacaggtgtgcaccaccacgcctggctaatttttgtatttttagcagagacagggttttgccatgttggtcaggctggtctcgaactcctgacctcaggtcatccacccacctcgaccttccaaagtgctaggattacaggcatgagccaccgatcccagcccattttgtcttaagtatttgttctctcctggccactggctgattggatggtgcccgccaacattgagggcagatagtctccacctagtacactcagatttatacactaatctcttctggaaacactctcatagacacaccctcaatgtgtaaaacaaaataatgttttaccaggtttctgatattccttaatctggtcaagctgatacctaaaattaggtccacaagtccaccccttgtcagcttggcactcatacgcatctccttaagccatatttaatttccaaataaagacaataacatggtaatagttgtgcctaacatgatacaactgacatgatgcaactatcctgcatgcaacccaaaacacactaatcacttccccagaatttggatgtcaggatttcaacatttgtgattgtatgttttgggattatgatctaatccccaaacttaattctgctttctgactacaactgtcaaaaaacatgcatacaagaaatgattagaagtaaatattccagaaattcctatagtttatctgtagtttagacctaccactgtttgatagccaccagatacatgggactcttgagcacttgaaaagttgttagtctaaactgagatgtgttattaagtgcaaaatacacactggatttctcagacttagtatgaaaagaaaatgtaaactatctaattaataatttaaacgatactgcgtggtgtactgttatattcttggatatactnggttaaataaactttttaangaaattaacttagttctttgtatcttcaaaattaacttacatctttgtaatttaaaactgtggctatgagaatatttaaattaatatatagctcatgttatatttctattggacagtgttagtctaggttttctgtaatgtcatttgattacatctgtaattcagaaggactgagaaaataagaggctgtcacagaagtttgtgcaagagatgaggtcatgtggatggataggtgaggagagagatggaaggtaaaatcgtggctcttagtggtggttttgaatgtagaagattgaaagagggagaaatctaggaaagctgcttgatttctagttgaatatgttggtaaagtggttggggcttataacataatgagcataggggaaaagaaaaaagaaccacagtcaaggaagaagtatctaggtggcttgggttagtccagtggctctgggaacaaggagtgcctagagcccggaagctggcttgcctgcgcattctggtgaaggtttcatggttcctgtcctctgcttccagaagcactgatctgggacacagagcctttgggccaagaattggatcaaatggatgggaattcatttagcccaaaccattagtctcatctttctccataatagatacagcttattgggttaaaagaataagattaattgagaagtcctgttcatggtagactttcaaaggaaaacaaaaatgtaaattccaaatgatatgccagtctttgtgacgtcggtattctgttccctcctgatttgtctgtgtaggccttgcaggaaaagtcgtggaatgtagctgccccttcgtatttgaagcagagtgatttggcctcagcagcagcaaaacaggtaagcttattcagaccttcccttcaaacaggtctctgtccaggaattgtctggtccaaggcagagcagagcgcttcctatagctctgtctctgtaggccttgcaggaaaagttgtggcatgtagctgcccctttgtatttgaagcagagtgatttggcctcagcagcagcaacacaggtaagcttattcagaccttcccttcaaataggtctctgtccaggaattgtctggtccaaggcggcagacggccttcctgtagctctgtacctctgctgtggcctccctaattttaggctatgacagaagttagtgatatgagaaggagcataactaggggacgcagcactcactgtggactcaggggacctgggtcctagtcccaggtcttcctctgatatgctgagtgatattgagcaagttacttaaattccctggattttttctcttctataaaatgtggcagttgggccgggtgtggtggctcacacctgtaatcccagcactttgggaggctgagatgggcgcatcacttaaggttaggagtttgagaccagcctggccaacatggtgaaacgctgtcgctactgtcatgaatctttcatctgaaaatgtagcccaactcagttaaggttgtttatatctttagcctgtaccatctcttcaacgttaaaaggtcctgggtagttcattaagtaggctttaattttatttgtctctagtttatttctttttagctttgagccgttcccctttgcacctaagtattgagacttggtgatctctggcaggtcaagtcttccagatagggagtctgtaaatgacccaggaggaagctaatgatggtgattgttattgttacattacagttcactaaatgatttcaagtctattagcttaattaaccctcataacaatcccattagataggaataagtattaagtctattttagagatgaggcagttaaggctcagcaaggttaaattcatagagctataggtaatacagtcaggacttgagaccagatcctctgatacccagaatctgttttctactacagtgctgaactcttgtctgatccagactctttctcagacctggtatgtggcttattgtagaagagtagcatttaatgactagaacccgataattgagccacattggaaggatgggatcagggagcaataatttggaaggaaaagaggaaaggaattaccattgctgtataccagatactgtgataaacacattgcatgctccatttgatacttgaaacttcatgatattggtactgtttcttccctgtttacagaaagggattgagacactcatgtaatttaacttgtcttattgccaattgtaagagagtctggagtcgtttccgtgaccctagagtgttcactgggaggcaagcacagaagaaaaagagaagcatcattttgatgaaaatcgcttatttggatggaactaagcaagatcggggacttgatctggggtcatagacaatgttttcttgcacttatttccatcccaaactccctcagaccaggcccatggaacagtctgtcaggataactaacatatggttaatagttcctgatgcttaattcttgaggactttgtggggattgggtttccatacataatatatattaatttgttcccacagcagagtgggcttcatttagggtaagaagcagtgctttcagtgctttgcagtttgcttagtgattaaactttcttatcttcacatcatcaactaagatgattttattaccaggtcagtcttctttttaaataggcaaaataatttattctctttttacaaggcatactatactaatttctttccacacttaaaagcataggga

SEQ ID NO: 8014 - DNA, 389 bp, Homo sapiens
ttttttctttcttaagttttgctagattgttttcttttgtcctccaggggtttgaaagttatgcaccgtaattctaaacacttcaagtgagaggcagtagaacatactggttaagagggctgtggtgccacactgcttgggttcacatcttgactttaccatttgcaaactgagtaacccttggacaagttacttaacacttcttggcctcagtttgttcccataagttaaactgagataatagtagtacctgtctcttcctcacaggggtattgtaagggttattgaattattatatgcaaaaccatttatttattttatttatttatgagacagagtcttgctctatcacccaggctggagtgcagtggcacgatctcaactcactg

SEQ ID NO: 8015 - DNA, 952 bp, Homo sapiens
aacaaagatgaattgagcattaaaggatggtagcttcttgaactacctctgtgtcagcaaaggggatatgggagttagagtttgggaactaccagcccaacctactgggctccacctgttatgtttctgcacaaggacaatgcttttagcactgaagctcccaaagacaaagcattcctttcctgacccatatacctctatcctttcattcattcatccagcatttactgagaacttaactctgtgccaagtctcagtatttctaagcagtagcaatactgagatgaaccaaatgttccatggagtttcattcaggtaaggttagtgaaaatgtgcaaatatttgtagtaggatgagaagaaatggagttgaggatctcagaagacagagtgaataaacccaagtgggaaactgtcatggaagacatgctgttttaactgggtctcgaagtatgaaaatgaataggccttgaatgcagtggttgtagaaggggtaccttctaatggtagagatggtataggaaaagagctgttgaaattatcaaagagataacaaatgggcgagagaaagaagcgttttccagttcaggaagatgagacgttatggagataggaatgaaatttatatatttatgaaaggcatgggggccgggcacagtggctcatgcctgtaatcccagcactttgggaggccaaggagggaggattacctgaggtcaggagttcaagaccagcctggctaaggtggtgaaactttgtctctactaaaaatacaaaaattagccgggtgtggtgacatgcgcctgtaattccagctactcaggaggctgaggcaggagaatcacttgaacccaggaagtggaggttgcagtgagctgagattgtgccactacactccagcctgggcaacaagagcgaaactctgtctcaaaaaaaaggaaaaagaaaaaaaa

SEQ ID NO: 8016 - DNA, 1865 bp, Homo sapiens
ctttcaaaggaaaacaaaatgtaaattccaaatgatatgccagtctttgtgacgtcggtattctgttccctcctgatttgtctgtgtaggccttgcaggaaaagtcgtggaatgtagctgccccttcgtatttgaagcagagtgatttggcctcagcagcagcgaaacaggtaagcttattcagaccttcccttcaaacaggtctctgtccaggaattgtctggtccaaggcggagccagaggccttcctgtagctctgtacctctgctgtggcctccctaattttaggctatgacagaagttagtgatatgagaaggagcataactaggggacgcagcactcactgtggactcaggggacctgggtcctagtcccaggtcttcctctgatttgctgagtgatattgagcaagttacttaaattccctagattttttctcttctataaaatgtggcagttgggccaggtgcggtggctcacacctgtaatcccagcactttgggaggctgagatgggcgcatcacttaaggttaggagtttgagaccagcctggccaacatggtgaaacgctgtcgctactgtcatgaatctttcatctgaaaatgtagcccaactcagttaaggttgtttatatctttagcctgtaccatctcttcaacgttaaaaggtcctgggtagttcattaagtaggctttaattttatttgtctctagtttatttctttttagctttgagccgttcccctttgcacctaagtattgagacttggtgatctcttgcaggtcaagtcttccaaataggaagtctgtaaatgacccaggagaaagctaatgatggtgactgttattgttacattacagttcactaaatgatttcaagtctattagcttaattaaccctcataataatcccattagataggaataagtattaagtctattttagagatgaggcagttaaggctcagcaaggttaaattcatagagctataggtaatacagtcaggacttgagaccagatcctctgatacccagaatctgttttctactacagtgctgaactcttatctgatccagactctttctcagacctggtatgtggcttattgtagaagagtagcatttaatgactagaacccgataattgagccacattggaaggatgggaccagggagcaataatttggaaggaaaagaggaaaggaattaccattgctgtataccagatactgtgataaacacattgcatgctccatttgatacttgaaacttcatgatattggtactgtttcttccctgtttacagaaagggattgagacagtcatgtaatttaacttgtcttattgccaattgtaagagagtctggagtcgtttccgtgaccctagagtgttcactgggaggcaagcacagaagaaaaagagaagcatcattttgatgaaaatcgcttatttggatggaaccaagcaagatcggggacttgatctggggtcatagacaatgttttcttgcacttatttccgtcccaaactccctcagaccaggcccatggaacagtctgtcaggataactaacatatggttaatagttcctgatgcttaattcttgaggactttgtggggattgggtttccatacataatatatattaatttgttcccacagcagagtgggcttcatttagggtaagaagcagtgctttcagtgctttgcagtttgcttagtgattaaactttcttatcttcacatcatcaactaagatgattttattaccaggtcagtcttctttttaaataggcaaaataatttattctctttttacaaggcatactatactaatttctttccacacttaaaagcataggga

SEQ ID NO: 8017 - DNA, 1213 bp, Homo sapiens
cacgcctggctaatttttgtatttttagtagagacagagtttcatcatgttggtcaggctggtcttgaacttctgacctcaaatgatccacctgccccagcctcccaaagtgctgggattgcaggcatgagccaccacacctgggtacacattttattttttatcatggccctgtgcattgagtgcattgttcttgcccagttttcaggaagcagaaagaaaatacaggcaagaactgcaggactttgaattatctgcctagatcattctaagaattgaattgattatgcaataattggactccttttcctgtagattaactgaggcatgaggtggactgtctcctctggttactggaagaggacttcctgattgccttactttgaggcagccagggtgggggtcctcccgagagcatggggagggtcccagggggcccacttcagggttgcctttcatgaaaaacttgtcaaacctttgtacagatgtctttttaataacactcactgctttgcagatccaagtttggactctgggctgctccagtagtttgttggctctgtttatggtagcttaagtgcaaggtttttatgtagccagtaaggtctgtcccatggtcttgagtgaaatggggagcaggaaaacagaaagaaaggaaagtgccacgttgtagcaggggagggtcaggagaccaccttacctgggcattgtggggtgcaggggtgccagcagagcaggagcttacctggtgggcaggggcactgccacatcttgggagggagtatgtgtgtagtttgaaaaagcttacttaatagtttagatttggaaaatggaaaaaacatccttttgaaatgttaaagatcgttaaagaagtttgtgatattttcataaatcaaaatgtggcatatgttttaaaaaattgagaatagctggacacagtggcttgctcccataatcccagtactttgggaggctgaggtgggagggttgcttcaggctgggaattcaagaccagcctgggcaacacagtgagaccccatctctacaacaaaattttaaaaattagctgggcctggtagtgctcctgtggtgccagctgctcaggaggctgaggtgggacggggcctggaaagttgagactgcagtgaactgggatcgtgctactgtactccagcctgggcaacagagcaagaccctgtctccaaaaaaaaaa

SEQ ID NO: 8018 - DNA, 883 bp, Homo sapiens
cgcacattctcttgtccctgcccttgaccatgggtggcatcttggttttcttgcagtctgcatcactgtttgctttgtctttggagagagaattttattgagggaggaaatgttccagggtggatcagattagcatctctgtgaactttgtaccagggtagcgaaggaagtgccaaccccatctttttttcaagaacagaacaccctgggtgcttcaagcaaagtctgggaagcaacccagtgggagggaagacagtgctcttttctctgggtccccacactcaggtcaggcgatgcgagttgttacacttgttttcggtcacgctcggggtgctgcggttcacgtttcttttctattatggagttactgtcaccaggctcttactgttttaaataaagtcattttgcttacgctcaaataattacactcatccaaggcattcttcccttagggttgttgtttatagttatttgaaaagcagggacatactgagtctaacttgtagatctagtaaatgctgatatcaaaagtgatgttaacaactattcctaagactggacctggttggggctgggcgcggtggctcacacctgtaatcccagcactttgggaggcctaagcaggcggatcatgaggtcaggagatcgagaccgtcctagctaacacagtgaaaccccgtctctactaaaaatacaaaaaaattagccaggcgtggtggcgggcgcctgtagtcccagctactctggaggctgaggcaggagaatggcgtgaacccgggaggcggagcttgtagtgagccgagatcgcaccactgcactccagcctgggcgacagagcaagactccgtctcaaaaaaaaaaaaaaaaaaaaaaaccagactgg

SEQ ID NO: 8019 - DNA, 1490 bp, Homo sapiens
gttgtaactcttggtccttctctctctccttttctcttcccttccttccccttccatctttctttccacatgtcctttccttattggctcttttacctcctacttttctcactccctatcagggatattttggggggggatggtaaagggtgggctaaggaacagaccctgggattagggccttaagggctctgagaggagtctaccttgccttcttatgggaagggagaccctaaaaaactttctcctctttgtcctcctttttctcccccactctgaggtttccccaagagaaccagattggcagggagaagcattgtggggcaattgttcctccttgacaatgtagcaataaatagatgctgccaagggcagaaaatggggaggttagctcagagcagagtagtctctagagaaaggaagaatcctcaacggcaccctggggtgctagctcctttttagaatgtcagcagagctgagattaatatctgggcttttcctgaactattctggttattgagcccttcctgttagacctaccgcctcccacctcttctgtgtctgctgtgtatttggtgacacttcataaggactagtcccttctggggtatcagagccttagggtgcccccatccccttccccagtcaactgtggcacctgtaacctcccggaacatgaaggactatgctctgaggctatactctgtgcccatgagagcagagactggaagggcaagaccaggtgctaaggaggggagagggggcatcctgtctctctccagaccatcactgcactttaaccagggtcttaggtacaaaatcctacttttcagagccttccagctctggaacctcaaacatcctcatgctctctcccagctccttttgcataaaaaaaaaagtaaagaaaaagaaaaaaaaatacacacacactgaaacccacatggagaaaagaggtgtttccttttatattgctattcaaaatcaataccaccaacaaaatatttctaagtagacacttttccagacctttgtttttttgtgtcagtgtccaagctgcagataggattttgtaatacttctggcagcttctttccttgtgtacataatatatatatatacatatatatatatatttttaatcagaagttatgaagaacaaaaagaaaaaataaacacagaagcaagtgcaataccacctctcttctccctctctcctagggtttcctttgtagcctatgtttggtgtctcttttgacctttaccccttcacctcctcctctcttcttctgattcccctcccccccttttttaaagagtttttctcctttctcaaggggagttaaactagcttttgagacttattgcaaagcattttgtatatgtaatatattgtaagtaaatatttgtgtaacggagatatactactgtaagttttgtactgtactggctgaaagtctgttataaataaacatgagtaatttaacacc

SEQ ID NO: 8020 - DNA, 1490 bp, Homo sapiens; identical to SEQ ID NO: 8019

SEQ ID NO: 8021 - DNA, 1491 bp, Homo sapiens
gttgtaactcttggtccttctctctctccttttctcttcccttccttccccttccatctttctttccacatgtcctttccttattggctcttttacctcctacttttctcactccctatcagggatattttggggggggatggtaaagggtgggctaaggaacagaccctgggattagggccttaagggctctgagaggagtctaccttgccttcttatgggaagggagaccctaaaaaactttctcctctttgtcctcctttttctcccccactctgaggtttccccaagagaaccagattggcagggagaagcattgtggggcaattgttcctccttgacaatgtagcaataaatagatgctgccaagggcagaaaatggggaggttagctcagagcagagtagtctctagagaaaggaagaatcctcaacggcaccctggggtgctagctcctttttagaatgtcagcagagctgagattaatatctgggcttttcctgaactattctggttattgagcccttcctgttagacctaccgcctcccacctcttctgtgtctgctgtgtatttggtgacacttcataaggactagtcccttctggggtatcagagccttagggtgcccccatccccttccccagtcaactgtggcacctgtaacctcccggaacatgaaggactatgctctgaggctatactctgtgcccatgagagcagagactggaagggcaagaccaggtgctaaggaggggagagggggcatcctgtctctctccagaccatcactgcactttaaccagggtcttaggtacaaaatcctacttttcagagccttccagctctggaacctcaaacatcctcatgctctctcccagctccttttgcataaaaaaaaaagtaaagaaaaagaaaaaaaaatacacacacactgaaacccacatggagaaaagaggtgtttccttttatattgctattcaaaatcaataccaccaacaaaatatttctaagtagacacttttccagacctttgtttttttgtgtcagtgtccaagctgcagataggattttgtaatacttctggcagcttctttccttgtgtacataatatatatatatacatatatatatatatttttaatcagaagttatgaagaacaaaaagaaaaaataaacacagaagcaagtgcaataccacctctcttctccctctctcgtagggtttcctttgtagcatatgtttggtgtctcttttgacctttaccccttcacctcctcctctcttcttctgattcccctccccccccttttttaaagagtttttctcctttctcaaggggagttaaactagcttttgagacttattgcaaagcattttgtatatgtaatatattgtaagtaaatatttgtgtaacggagatatactactgtaagttttgtactgtactggctgaaagtctgttataaataaacatgagtaatttaacacc

SEQ ID NO: 8022 - DNA, 140 bp, Homo sapiens
cctgtagtgccagctacttgggaggctgaggcagaagaatcgcttgaacccaggaggcggaggttgcagtgagccaagatcgcaccactgcactccagcctaggcaacagagcaagactccatctgaaaaaaaaaaaaaa

SEQ ID NO: 8023 - DNA, 832 bp, Homo sapiens
taggatgtgatagatctggtccctctccttgaactacccctccacacgctctagtcccttcaacctaccggtctattaagtggtggcttttctctccttggagtgccccaattttatattctcaggggccaaggctaggtctgcaaccctctgtctctgacagattgggagccacaggtgcctaattgggaaccagggcatgggaaaggagtgggtcaaaattcttctctttctcctccacctctcaaacttcttcactatagtgaccttcctaggctctcaggggctccttcagtccccatcctatgagaaactagtgggttgctgcctgatgacaaggggttgtttcagcccctcagtcatgctgccttctgctgctccctcccagcaggattcaccctctcattcccgggctcctgggccctgttcttaggatcagtggcagggagaaacgggtatctcttttctctcttctaattttcagtataaccaaaaattatcccagcatgagcacgggcacgtgcccttcaccccattccacccttgttccagcaagactgggatgggtacaactgaactggggtcttcctttactacccccttctacactcagctcccagacacagggtaggaggggggactgctggctactgcagagacccttggctatttgagtaacctaggattagtgagaaggggcagaaggagatacaactccactgcaagtggaggtttctttctacaagagttttctgcccaaggccacagccatcccactctctgcttccttgagattcaaaccaaaggctgtttttctatgtttaaagaaaaa

SEQ ID NO: 8024 - DNA, 140 bp, Homo sapiens; identical to SEQ ID NO: 8022

SEQ ID NO: 8025 - DNA, 832 bp, Homo sapiens; identical to SEQ ID NO: 8023

SEQ ID NO: 8026 - DNA, 832 bp, Homo sapiens; identical to SEQ ID NO: 8023

SEQ ID NO: 8027 - DNA, 140 bp, Homo sapiens; identical to SEQ ID NO: 8022

SEQ ID NO: 8028 - DNA, 4401 bp, Homo sapiens
gccaccaaacatctcccaccgagttatttggtgggatttgcagggacttttctgggagaacttaaaggcccatagtaactgcgaatgaagcaatataccactaacctgcagaaaaacacaaacaaaaacagactcccactgtctccagaagtcgtggccttccagaacagtctgcccctcaaggaagggtggggcaggcagtacccccaagcaggctgctcccagaggtggggaacccttcataggaaatccccacccccgtccaccccagagaccctgcccttccacccggaggccaaaggccaactgtactcccaaaggcatgggagaaggttggcgagaagacccctgactaccacatccttgtgtttgcgtgtagagacgggggatagtgagaacctaagccccatcgtagcacagtattacatgtggttgggaaaaataaaaatacaggggtgcggaatactccaaaacctagaaatgctgtaggaataaatctgcggtaactatagaggtttaacttatatcattttcaaactatttaattttttcttttcctggttctactaattatactgtgtcagatttggaactaaacaggcaaggaggctttgagtcacatcgttttcattttaaatcaggctgtgatgcactgtggctggtgccgtcttgcatgaaacgcatgagccgtgagcgcccagttcagactggggccagggaggggcagtccttggcactttctgtcctagaggacactgtcagttgagttaatacaagtgacatagcttcccttccctcccccttcacccactccctccagaacatttagtgtagatgaaaatgtggtgatagaaatgggtgcatgatcttcacgtgtgacagccaggcctttgcctcttggccaagtaaagcccttccgggtcgctctccttcgattccattttacctcctcttctgatcacttccagagatgagctgtttctggataatggcacacgggcaaatctgtgtgccctgtgggccgctgttacttaccctctcctgcgagacccaggggcttttccctactgttcccacgcttcctctctctcgaggccactgaagtttggagtcaaaaggcccagagtctgagtcccagccctgagcacttaggagccttctgacttagggtttgtcactccacctcattgagcctgactgttctgctccataaaatagggtaataaaggtcaaacatcagtgagcaagctgtgtacactggaaaacactgaatcaatacaatgcgtttgtgattatcattagtaaggtaagtcttagatcagagccctccagcccttctttttgaaacctcccaatggcatttcagaagtgagcagtggaattttcctgccatcctaataagagccctggattccatcattaacatttcagcccattggatgaagtggtgccctctcctctggtcccccgcgaaaaggtaaatacacccaaagggagggacctagttaagtcactggcacctagataagttaggagggtaaagccactacctcgtctgaaggactggacttgacaccccacagtggaagggagcatcaggagaggaacaaaaaaagggatctcagggagaggccagtgtcaaacttgacctcccttgtttggcctagaatgaacccttctctttagctcctggatatgaaaggccatctgcttggagcacagaaagatattgccattttacagcttaagagagtaaggccttgggctgtgctgtgacctgcccaagatttgacactggctaggagcagaggctgcgtcaggctcttaaagtcatgtgtttgcatgctggatgctatactgtccagccaggacacaagacttctgatttctaccctcaagatactcccagatcctaaatccagtagcctcccaggcaaaatatagcaatctgccacaactgccagatgaaaagcaacaatcagagtagaaaaatctgttgcctgatatacataacaccaatcagaccgtgtggatttttctctgaattgactgattttgtttttttcttactgaaaatggacctgcctttcactgaattttctgagggcagagtcttagctgttttctttaagcaccttttttttttttttccattgggaaatggctgatgagttcacatttagggatgtacacacacagatggcagacgtctccccactcatccagccccagatctgagccttgacgcaggccaagtggaaaaatactttcccgcccccctcccctgttcccacttcctcatctggcactatgcatgtctcactcaccctccacagcactcagtcccatcgacgttcactgaacattggctttctctttctgactcctgcctgttttagtccactatatattgctgtatttgcttaaatgctggaaagtaactgttaaaatgtgaaattgtaatttttaaaaaggctacaattaaattttagccaatgccactcaccaaatctttgcacctagtagatatatcaatgtaaaaacaaatacctaactgtacagtgagtgtgggggaaatgtagtaacctagttagtagtcttcaatataaccaattgtacaaggggaagtggtgtttacctacttgttcatcaccattactgaaagccgtactgatcagttagttgacaacgggcatttttttttctttgcttcatggaatgatttcttttcttaaccttcgacttatcctgaggtcaagccttttgtctttatgtgtaaccgacgttcagtctattctaggaatgaaccagcaagttgttcatttaaaactgaccaaagacaattaattcctggtctagtttcctgggccttgtggctcagctgccactaaagagctttttggataaaattgagaacaagctgtgcttcctaccccactctccccgtccccttttattcccttttcctcttaaagagctgctctgagctgtgggattctatgaaaaattcttgcctttccttgtttcagtgctaacgatttctcacctcgaagcgccttttgaaccccggacagagtgcacaatcggagggaattgcgagcttgggaattagactttggagtcttttctctgaagtcaccaggccaggggtcaggagagagatggattcccaagggatgaaaggtttctattcaatgaagaaatcggagtgggaagagacacagggaaattgagccatattttggctatcggctggaaccagcagttcagagatctgccttataaacatttaaaaccggtttgtggtacacaaagaggaaccagtgtgggaaggggcctttatgtggggctttcttctctgttggagtcccttggagtgccttgttgggtatatttctctgtcattcaggaggcacgaatgtggaggacttctcgtgacctggtcgtgatgtggcattcagtgcatgtccacagctaatggaaaaacacgaggactcgggtaatggttcttcctctcagtctttctattcctaacttttcacacatccagatggttccacactagtgcaaatgcctcactctcctgagaaacccagaaagaagagtggctggctcacaaccatggggttagcccctgctgggctgggagtcggggtggcggccaggaggaaaggcagaaaggggtgagccgaggtgttgcctagctgattttctgctgtgcagagctaatgctgacatttcatgtcaacttccccggttctctggggtctcctctcctctgagcagccacatagaacattccccacatatccaaagctgcccaggggagccgagagaagggactttgctgtcaggtccaagccctcctgacctccctgagattgatctgccagtgtcctgctgtccctctgggactggccacatggccatcgctgccccttgttgacacctcctttctgtgtgagttgtccccggccaataacaaagctgttccttgaaccagaacaaccagagtgcacttttccttccttagacggaagtagatcctggctagggtttctgcccaggcccttgttcccggcagtgtgactgtttacatggtttggcaataggtttgattctgattgcttcagagtggctggtctattttgtttcctttggtttccttcctccccaaattgtgacaggaaaaacagaccaaaaccaccctaggaaattgctggttgcctgtccccacgtgatgataaatgttgccctcttctggatatcgtttctctaccttacgaccaaacgcccgtcctatagagtgtctgattggatcctctgtcgcgtattctgatggtgcctgctggtttgacgtggagctatcctgtgaaataaaacagcttaacttttctcaaa

SEQ ID NO: 8029 - DNA, 4401 bp, Homo sapiens
gccaccaaacatctcccaccgagttatttggtgggatttgcagggacttttctgggagaacttaaaggcccatagtaactgcgaatgaagcaatataccactaacctgcagaaaaacacaaacaaaaacagactcccactgtctccagaagtcgtggccttccagaacagtctgcccctcaaggaagggtggggcaggcagtacccccaagcaggctgctcccagaggtggggaacccttcataggaaatccccacccccgtccaccccagagaccctgcccttccacccggaggccaaaggccaactgtactcccaaaggcatgggagaaggttggcgagaagacccctgactaccacatccttgtgtttgtgtgtagagacgggggatagtgagaacctaagccccatcgtagcacagtattacatgtggttgggaaaaataaaaatacagtggtgtggaatactccaaaacctagaaatgctgtaggaataaatctgtggtaactatagaggtttaacttatatcattttcaaactatttaattttttcttttcctggttctactaattatactgtgtcagatttggaactaaacaggcaaggaggctttgagtcacatcgttttcattttaaatcaggctgtgatgcactgtggctggtgccgtcttgcatgaaacgcatgagccgtgagcgcccagttcagactggggccagggaggggcagtccttggcactttctgtcctagaggacactgtcagttgagttaatacaagtgacatagcttcccttccctcccccttcacccactccctccagaacatttagtgtagatgaaaatgtggtgatagaaatgggtgcatgatcttcacgtgtgacagccaggcctttgcctcttggccaagtaaagcccttccgggtcgctctccttcgattccattttacctcctcttctgatcacttccagagatgagctgtttctggataatggcacacgggcaaatctgtgtgccctgtgggccgctgttacttaccctctcctgcgagacccaggggcttttccctactgttcccacgcttcctctctctcgaggccactgaagtttggagtcaaaaggcccagagtctgagtcccagccctgagcacttaggagccttctgacttagggtttgtcactccacctcattgagcctgactgttctgctccataaaatagggtaataaaggtcaaacatcagtgagcaagctgtgtacactggaaaacactgaatcaatacaatgcgtttgtgattatcattagtaaggtaagtcttagatcagagccctccagcccttctttttgaaacctcccaatggcatttcagaagtgagcagtggaattttcctgccatcctaataagagccctggattccatcattaacatttcagcccattggatgaagtggtgccctctcctctggtcccccgcgaaaaggtaaatacacccaaagggagggacctagttaagtcactggcacctagataagttaggagggtaaagccactacctcgtctgaaggactggacttgacaccccacagtggaagggagcatcaggagaggaacaaaaaaagggatctcagggagaggccagtgtcaaacttgacctcccttgtttggcctagaatgaacccttctctttagctcctggatatgaaaggccatctgcttggagcacagaaagatattgccattttacagcttaagagagtaaggccttgggctgtgctgtgacctgcccaagatttgacactggctaggagcagaggctgcgtcaggctcttaaagtcatgtgtttgcatgctggatgctatactgtccagccaggacacaagacttctgatttctaccctcaagatactcccagatcctaaatccagtagcctcccaggcaaaatatagcaatctgccacaactgccagatgaaaagcaacaatcagagtagaaaaatctgttgcctgatatacataacaccaatcagaccgtgtggatttttctctgaattgactgattatgtctatggcttactgaaattggacctgcctttcactgaattttctgagggcagagtcttagctgttttctttaagcacctttttttttttttccattgggaaatggctgatgagttcacatttagggatgtacacacacagatggcagacgtctccccactcatccagccccagatctgagccttgacgcaggccaagtggaaaaatactttcccgcccccctcccctgttcccacttcctcatctggcactatgcatgtctcactcaccctccacagcactcagtcccatcgacgttcactgaacattggctttctctttctgactcctgcctgttttagtccactatatattgctgtatttgcttaaatgctggaaagtaactgttaaaatgtgaaattgtaatttttaaaaaggctacaattaaattttagccaatgccactcaccaaatctttgcacctagtagatagatcaatgtaaaaacaaatacctaactgtacagtgagtgtgggggaaatgtagtaacctagttagtagtcttcaatataaccaattgtacaaggggaagtggtgtttacctacttgttcatcaccattattgaaagccgtactgatcagttagttgacaacgggcatttttttttctttgcttcatggaatgatttcttttcttaaccttcgacttatcctgaggtcaagccttttgtctttatgtgtaaccgacgttcagtctattctaggaatgaaccagcaagttgttcatttaaaactgaccaaagacaattaattcctggtctagtttcctgggccttgtggctcagctgccactaaagagctttttggataaaattgagaacaagctgtgcttcctaccccactctccccgtccccttttattcccttttcctcttaaagagctgctctgagctgtgggattctatgaaaaattcttgcctttccttgtttcagtgctaacgatttctcacctcgaagcgccttttgaaccccggacagagtgcacaatcggagggaattgcgagcttgggaattagactttggagtcttttctctgaagtcaccaggccaggggtcaggagagagatggattcccaagggatgaaaggtttctattcaatgaagaaatcggagtgggaagagacacagggaaattgagccatattttggctatcggctggaaccagcagttcagagatctgccttataaacatttaaaaccggtttgtggtacacaaagaggaaccagtgtgggaaggggcctttatgtggggctttcttctctgttggagtcccttggagtgccttgttgggtatatttctctgtcattcaggaggcacgaatgtggaggacttctcgtgacctggtcgtgatgtggcactcagtgcatgtccacagctaatggaaaaacacgaggactcgggtaatggttcttcctctcagtctttctattcctaacttttcacacatccagatggttccacactagtgcaaatgcctcactctcctgagaaacccagaaagaagagtggctggctcacaaccatggggttagcccctgctgggctgggagtcggggtggcggccaggaggaaaggcagaaaggggtgagccgaggtgttgcctagctgattttctgctgtgcagagctaatgctgacatttcatgtcaacttccccggttctctggggtctcctctcctctgagcagccacatagaacattccccacatatccaaagctgcccaggggagccgagagaagggactttgctgtcaggtccaagccctcctgacctccctgagattgatctgccagtgtcctgctgtcaactctgggactggccacatggccatcgctgccccttgttgacacctcctttctgtgtgagttgtccccggccaataacaaagctgttccttgaaccagaacaatcagagtgcacttttccttccttagacggaagtagatcctggctagggtttctgcccaggcccttgttcccggcagtgtgactgtttacatggtttggcaataggtttgattctgattgcttcagagtggctggtctattttgtttcctttggtttccttcctccccaaattgtgacaggaaaaacagaccaaaaccaccctaggaaattgctggttgcctgtccccacgtgatgataaatgttgccctcttctggatatcgtttctctaccttacgaccaaacgcccgtcctatagagtgtctgattggatcctctgtcgcgtattctgatggtgcctgctggtttgacgtggagctatcctgtgaaataaaacagcttaacttttctcaaa

SEQ ID NO: 8030 - DNA, 3304 bp, Homo sapiens
actgaagtttggagtcaaaaggcccagagtctgagtcccagccctgagcacttaggagccttctgacttagggtttgtcactccacctcattgagcctgactgttctgctccataaaatagggtaataaaggtcaaacatcagtgagcaagctgtgtacactggaaaacactgaatcaatacaatgcgtttgtgattatcattagtaaggtaagtcttagatcagagccctccagaccttctttttgaaacctcccaatggcatttcagaagtgagcagtggaattttcctgccatcctaataagagccctggattccatcattaacatttcagcccattggatgaagtggtgccctctcctctggtcccccgcgaaaaggtaaatacacccaaagggagggacctagttaagtcactggcacctagataagttaggagggtaaagccactacctcgtctgaaggactggacttgacaccccacagtggaagggagcatcaggagaggaacaaaaaaagggatctcagggagaggccagtgtcaaacttgacctcccttgtttggcctagaatgaacccttctctttagctcctggatatgaaaggccatctgcttggagcacagaaagatattgccattttacagcttaagagagtaaggccttgggctgtgctgtgacctgcccaagatttgacactggctaggagcagaggctgcgtcaggctcttaaagtcatgtgtttgcatgctggatgctatactgtccagccaggacacaagacttctgatttctaccctcaagatactcccagatcctaaatccagtagcctcccaggcaaaatatagcaatctgccacaactgccagatgaaaagcaacaatcagagtagaaaaatctgttgcctgatatacataacaccaatcagaccgtgtggatttttctctgaattgactgattttgtttttttcttactgaaaatggacctgcctttcactgaattttctgagggcagagtcttagctgttttctttaagcaccttttttttttttttccattgggaaatggctgatgagttcacatttagggatgtacacacacagatggcagacgtctccccactcatccagccccagatctgagccttgacgcaggccaagtggaaaaatactttcccgcccccctcccctgttcccacttcctcatctggcactatgcatgtctcactcaccctccacagcactcagtcccatcgacgttcactgaacattggctttctctttctgactcctgcctgttttagtccactatatattgctgtatttgcttaaatgctggaaagtaactgttaaaatgtgaaattgtaatttttaaaaaggctacaattaaattttagccaatgccactcaccaaatctttgcacctagtagatatatcaatgtaaaaacaaatacctaactgtacagtgagtgtgggggaaatgtagtaacctagttagtagtcttcaatataaccaattgtacaaggggaagtggtgtttacctacttgttcatcaccattactgaaagccgtactgatcagttagttgacaacgggcatttttttttctttgcttcatggaatgatttcttttcttaaccttcgacttatcctgaggtcaagccttttgtctttatgtgtaaccgacgttcagtctattctaggaatgaaccagcaagttgttcatttaaaactgaccaaagacaattaattcctggtctagtttcctgggccttgtggctcagctgccactaaagagctttttggataaaattgagaacaagctgtgcttcctaccccactctccccgtccccttttattcccttttcctcttaaagagctgctctgagctgtgggattctatgaaaaattcttgcctttccttgtttcagtgctaacgatttctcacctcgaagcgccttttgaaccccggacagagtgcacaatcggagggaattgcgagcttgggaattagactttggagtcttttctctgaagtcaccaggccaggggtcaggagagagatggattcccaagggatgaaaggtttctattcaatgaagaaatcggagtgggaagagacacagggaaattgagccatattttggctatcggctggaaccagcagttcagagatctgccttataaacatttaaaaccggtttgtggtacacaaagaggaaccagtgtgggaaggggcctttatgtggggctttcttctctgttggagtcccttggagtgccttgttgggtatatttctctgtcattcaggaggcacgaatgtggaggacttctcgtgacctggtcgtgatgtggcattcagtgcatgtccacagctaatggaaaaacacgaggactcgggtaatggttcttcctctcagtctttctattcctaacttttcacacatccagatggttccacactagtgcaaatgcctcactctcctgagaaacccagaaagaagagtggctggctcacaaccatggggttagcccctgctgggctgggagtcggggtggcggccaggaggaaaggcagaaaggggtgagccgaggtgttgcctagctgattttctgctgtgcagagctaatgctgacatttcatgtcaacttccccggttctctggggtctcctctcctctgagcagccacatagaacattccccacatatccaaagctgcccaggggagccgagagaagggactttgctgtcaggtccaagccctcctgacctccctgagattgatctgccagtgtcctgctgtccctctgggactggccacatggccatcgctgccccttgttgacacctcctttctgtgtgagttgtccccggccaataacaaagctgttccttgaaccagaacaaccagagtgcacttttccttccttagacggaagtagatcctggctagggtttctgcccaggcccttgttcccggcagtgtgactgtttacatggtttggcaataggtttgattctgattgcttcagagtggctggtctattttgtttcctttggtttccttcctccccaaattgtgacaggaaaaacagaccaaaaccaccctaggaaattgctggttgcctgtccccacgtgatgataaatgttgccctcttctggatatcgtttctctaccttacgaccaaacgcccgtcctatagagtgtctgattggatcctctgtcgcgtattctgatggtgcctgctggtttgacgtggagctatcctgtgaaataaaacagcttaacttttctcaaa

SEQ ID NO: 8031 - DNA, 263 bp, Homo sapiens
ggggaaagagggtttggaaatgtcaaagcaaaggcaagttgggagtagtagctgtcatctgcagaaagtgtcttcaaaagtttaagataaattatcagaggccactgggtactgatacatcaaggcacatgcaacattttgatgttcattgtctacaaacgtcatataacctcttggacttttgtttttacctgtgtgtgtttgtgaactgtttattgaccacttatttctgtcccagccactagattaaaccctttacctgt

SEQ ID NO: 8032 - DNA, 263 bp, Homo sapiens; identical to SEQ ID NO: 8031

SEQ ID NO: 8033 - DNA, 263 bp, Homo sapiens; identical to SEQ ID NO: 8031

SEQ ID NO: 8034 - DNA, 1075 bp, Homo sapiens
gccaccaaacatctcccaccgagttatttggtgggatttgcagggacttttctgggagaacttaaaggcccatagtaactgcgaatgaagcaatataccactaacctgcagaaaaacacaaacaaaaacagactcccactgtctccagaagtcgtggccttccagaacagtctgcccctcaaggaagggtggggcaggcagtacccccaagcaggctgctcccagaggtggggaacccttcataggaaatccccacccccgtccaccccagagaccctgcccttccacccggaggccaaaggccaactgtactcccaaaggcatgggagaaggttggcgagaagacccctgactaccacatccttgtgtttgtgtgtagagacgggggatagtgagaacctaagccccatcgtagcacagtattacatgtggttgggaaaaataaaaatacagtggtgtggaatactccaaaacctagaaatgctgtaggaataaatctgtggtaactatagaggtttaacttatatcattttcaaactatttaattttttcttttcctggttctactaattatactgtgtcagatttggaactaaacaggcaaggaggctttgagtcacatcgttttcattttaaatcaggctgtgatgcactgtggctggtgccgtcttgcatgaaacgcatgagccgtgagcgcccagttcagactggggccagggaggggcagtccttggcactttctgtcctagaggacactgtcagttgagttaatacaagtgacatagcttcccttccctcccccttcacccactccctccagaacatttagtgtagatgaaaatgtggtgatagaaatgggtgcatgatcttcacgtgtgacagccaggcctttgcctcttggccaagtaaagcccttccgggtcgctctccttcgattccattttacctcctcttctgatcacttccagagatgagctgtttctggataatggcacacgggcaaatctgtgtgccctgtgggccgctgttacttaccctctcctgcgagacccaggggcttttccctactgttccc

SEQ ID NO: 8035 - DNA, 1338 bp, Homo sapiens
ttcaagtataaattgtttttgacattaagaccaactcctgttcattacaagcacctgaccaactgtcttaatagaaagtactctagactcagtagcttataaacaacagaaatttatttctcacggttctggtggctaagaagtctgagatcaaggccccaataaattaggcctctgatgagggcctgtttcgtgattcgtagatggtaccatcttgctatgttctcacataatggaaagggaaaggcagctctctggggcctctttttattagtgcacgaatcccattaatgaggaccccacccttatgacctaatcactccccagccacgcctcccaatacgatcacattggtaattaggtttcaacatatgaattttgtggagagacaagcattcggaccataacaacaacattcttaaaactaccattgtaggccaggggcagtggctcacaactgtaatcccagcactttgggagcctgaggtgagagaattgcttgagcccaggagttcaagacctgcctgggcaacatagtgagacctcatctctacaaaaaatttaaaaattggctggggtggtagagcaagatgttgtctcaaaaaaaaataaacaccattgcaggctagtcagccactattagattgtggaatctactgtgtattttatgtaccagaaatccagggtcttaaacttttttgctgagctctgaagataccaccaccatgcatcatattttcaagtagcctctaggaaatgccttgtagaacccaaattgaaaactaacgtataactctttatgttgtgaaggtggtcctaatgaaatctaaccatccccaaaagtgtcttccatacctgactcatacctttagcaagtgacatcacattaaatttgtcaaaatcagtctttaataccttatttagaattatgcagctatagaaggaacatggaggaaattatagagctgtgctgcccaatatggctagccactagctcacatgtggctgtttaaatttaattgaacttaaattgaaaatataggtcctcacttaaactagccacatttaaagttcacaatagccacatctaagtagtgactaccgtattgacaacgcagatgtagaactatgtagaacatttgacaatactgtctagaaagtactgatacaaaaagcactttagttgataatggcttatatatttatataaaaatgcctatatgatgacttctcaagagaaaagattgtttataactggaacctataattttatttcattgtgccagaaaagtagcttttaaatttataaattctacttttttcccttaaactcctacc

SEQ ID NO: 8036 - DNA, 9479 bp, Homo sapiens
gccctttctaaggcacaaaatgatgtgatggaaatgaagatgcagtcagagagactttcgaaagaatatgatcaactcctgaaagaacactctgaacttcaggtgggtgtgacatgcactttatgcacctaaatgttttgaaatagtaattacctaagtaaattatttgggttatttgtccttaactaatcaagatgatgtacttaatcctggctttgttaaacgatttaaagaagccagatttttacctagagggtaaagattaggacattgcaggaaaatacaagataattttaaggaattgctgacttgcatacttacagcattccagttttggtgaatttttaagcaaaagaagccacaaaaatggcagcattggaaaacagactggttctagaaaaggtgagttttgctctttgggatgtttgccatattcatgccaaaatgaggccaaaatttcaagttccacatcacactactcttgtctcagtgttttagacatattaggacaagactttagcattcaaatttatcatttacctccaaatgttgatttgaaagatggaaatgggaaaaaaatgtttcattgttaaagccacaaagtcagatctgggccataggttttctttctctttctctctaattcaataaaagaaatggtcatccctgttaggcttgtctttcctccctcccttctgctgccagccagtaacctgaattgatttctcagacacactctgatcaattggggaagagaccattccagagacagccctggccttccctcccagtttctcccaagacagactggttgggcttgtcttcaaaatttggcagcctttgtggctttcagtcagggctttttacaaataatagctttttatttcactgtacacatttccctgcatcttaatggtcatggtatctccaagactcagcactgttcctggcacaaggcaagcatacactatactcatagactttgtagtcagacctacttggaatacctacctatacctggctgcatgctaggttttttatcttaggcaggttatagcatccctttggggctcacttctttcatctataaaaattgaaacaataatgatgcctggctcactggattgttaagagaactaaataaaatgtgtaggttttttagcactatgcctagctgacagtaaacactcaagaaatgataggtattatcatcatcatctgtattacttcctctgtaggaattttgctgaaagaatgacttattctcaaccaaccactttggccttggtttagagccagtaattaagtaacccaaagcacatatttgtaatctgatattcccagttggtttgcatgtttggtttaactagcctactttgacaatagcaaaagacaaggtagccagagaagggtgaataccctgtatgctccaatcccaggacactgagggctcagttcacatggcctggagcagataggtagattgtcagcaagaccaccccttccccgtctcaaaaatagagaccctaaaattgctgacctcattggggcatgataattattcgtggtatctttcaaggtccaccttggaaagtgaagaagtcacttcagagacctcttgcctagaaatacaacattttccccctatttgtgagattagggtttactcagccaggttgagtatcgacattagtggactttgccatgatgtcagacatgcttagatctttgaatggagaaaggaaaaccagaagtatgccttcagtttcttatggccagtgtccattgttgaatgtctccattgttgaatgtctccattgttgaatgtctccattgtggtaacagccattggttctcttaattctgaagaatatatataacagtgagatttcctcaacccatttcctccccacagaaaagccacagtcagcctggagctgctgcattcttggtaaaggaagtagaaagcttttaagagtgattcctggctgagcgtggtggctcacacctttctttaatcccagcactttggaaggctgaggcgggcggatcatgggagatcaagaccatcctggctaacaaggtgaaaccctgtctctactaaaaatacaaaaaattagccgggcatggtggcaagtgcctgtaatcccagctactcgggaggctgaggcaggagaatcacttgaacctgggaggcagaggttgcagtgagccgagatcgcgcttttgcactccagcctgggtgacagagcgagactccatctcagaaaaaaaaaaagtgattccttcccaagaaaatagttgttataatagttgtcatacctgtttctgtggaaaagaccccatcccagattatgccagacaccatgccgagagtagggccttgtttgatagcacttcaggacttgatctaatttctgcttgtatccagtttttgaaatatttaatagatgtcatttgttgagagtatgctctggactaagcacttggctaagggcttcgtatatgttgttttgtttactctccatgacagctcaataattgaaagtattttaatatccctattttgtgaatgaggaaactgagacccagagatgttatataatttatcgaaagtaactagaaagtgatagcattcaaagtcagagaatctttctccagaacctccatcattaaccactatgttctttggcctttgctgatcattggattgtgttcttggatccattctcctctcaccactgctttactctgtatctctgggaggcccgtttccaaggctcccttgctgtctgactcagtctgggcaggtttagccagtggcaggcactagaagactgaaggcaggaggaaggggaaagccagggatttcttctactctttctgctatagaggccttctcctttatgactccagttccttccctctaggtcccactgggcagcttctacatactggccttcgcacctgggctccataaccctcatccctccagcccaagaagtggtggtggcttttctgctattgataatcccagaggtgccttaccaccctgtttggtgtgtgtactttttcatcacctgtaaaaccaatttcccataatatctctgttggaaggaaaacaaaatctcagctccatagtttaccacttctgtaacccacaggtgactcatttgacatctatgctcctcaggtactttactacttaaataaaggttgtaataccttatgaaaattaaaccagatcctgtataagaaagcactttatatatttataatcaagaatgctatttattatgtcctgactggttacatttttttccttcacctacccatcccccaccgttgtccaatatgagaccctgtataagattctcagatttagatatcattaagagccccattttgtttgtttgtttgttttttgagacagtgtctcactctgtcaccaagactggagttcagtggcacaatctcagctcgctgcaacctccacctccccaatttaatcgattcttgtgcctcagccttctgagtgactgggactacaagcacatgccaccatgcgcagctaagttgggtatttttagtagagacagggtttcaccatgttggccaggctggtctcgaactcctgacctcaagcgatccgcccacctgggccttccaaagtgctgggattataggctcgagccaccgtgcccagccaagaacccttttctttaactcttgtgctttaatgttcgtctgagccctgcttgagaagcaaaagatagttacagatcctctatggtaaaaagctctatcaaattgtcctcatgaatttacttctgttgtcaaactaatcttagatattgaattatatgctaaggttctttggaactagcttcctgaattttacacagttgacatattttcattggaacaatcataaaacgaaagatcattaaaatattaaggaaacaaaggttaaagagggaaacgctgatttctttactgtaaatagatcccaatttgcatcttttaaatccttttggatttccccatctggtcccctccctgttataggcactaaataaatattagaaaacagtcccttcaaaacatgtagtcctttccttatttgccctgcctctcttctaaaaaaaaagaaaaacagaactaactagagattattggctgcacaaacccatcagcacctgccagtttttaaatttcattttggaaaatcagccatcacttaagggacttgtccataatagcttcattaaagctttgttttttatcaaaagggggccacatatgtaaacttgtggaagtaatttacctcctctactcttgtctttttatttgattgcaaaagttaatgttattaaagttgctatggaagcattaatgttcagcctgaacaagagcttgacgaacttctttatacaagcaataacactctgcaaccccattttatgagatatttttcatgatgtagacatttactttcttagcacaagtgatctcttaagattaatttcttttccattttccttcagttttaaatgatgtaatatagtaatctttataacatgatcagccaagtataatttgagaagtcagttctgttggcaaatatctgaaggacaaaaccaaagccaccctagctgaggtttttgtcccttccttctttcatttaccaaaaaccttaattgggttaacagtaggggaattttagaaatcatgttttcctaatgtaacctgtgaaacaaaagcaaaatagattaaggcaaggggaaaaatgaacttaccaagagtgttctttttcctaagtaaaaaccacaaattttatagttttttaaattttagactttctcaatcctttttttcacatttaattattctcataagtatacatagaagagagaatgttttttaaaagtccttgtcatgtctatgaatctgtttctctttgctgtactacataaatcatatttttttccttacaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccggctgtggctccagagtctgtgccctttaccaccgtgcccaactgtttcacatgctgtgtttggtagtttttcctagtactctccttaataatggtggtgtttagcaaattgtattacataaataaatatttatttcatggattgagttatgttgcatattaaattactttccttcccattgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttctggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctctgtgggctggttcagttctgcattcccattccagtgtccactgccttctcgctatccctcccatctgtgcgccaccaccagcttatccccagccctgctaacatgacaaactattgtgcatttgagtgcccactatacaatgtgtgaatataaccgtgcttttaagcattgactttaatgtctgggatgatccgtctagagtccatggaaccctcctgtgttttttcatccctttcttagtaatcttggaaatccacttatgaaattctttttctaacatttctttgctgaacggcatttttaaaattactttcacggtgtttctttccagtttgatctctacacaaacacaactttattacttgcaccagaaatgatttcaaacactttaggaactgtggtaggcttaattatgacttcccaaaagatatccctataccaatccctggaacctggaaatgttctcttctatagcaaaagatatgattaagttaaagtcttgagatggagagattattctgggtaatctgggagtgccctaaatgcagctacatctatgcttatatagaagcaaagggagatattaccacacagaagaggagaaagcacagtgaccacagaggcagagattggagtgatggagccgcagcaaaggaatgctgacagccaccagaagctggaggaggcaaagaacagattcttccccagagcctcttccagcaggagcatggccctacagataccgataaaactgatattggacttcctggcctccagaactatgggaataaatttattgtttcaagctatcaagtttgtgattatttgttactgctgccatagtaaattaatacaggagcatgcaggacagatctgtaatggcctgaactgaatttcaaggggtgtggaaaacagttactctttaacaccactccgtcttccccattagccatttggataagtcaaagatagccttagccatctcctatcttagttacttttctccttcaactgtattttgccattgtcgttgccattgcctctgcctaactgcaagccatcatcatctctcacatggactatgacgacctcctcatctccctgtatcttctctaatgcttctctcatatacatgctctcagcagccacctggtttaaaacaaaaacaaaaaaaacactaatcatgtcattccctgcttgtcttcccgttctttccaactgtcattccctgcttgtcttccaattctttccaactgcagttaagatcaaaccaccaagacctcaccaggctcccatctacttttcagcctcaactcagtccacctgctctgccaatcacacctgtttctttttgttgttctttccctaggatatagatcctggcatacctgcattctgattcttcttggaacaagccaaattctttcccctgtcagtacgtttgcatgtgtagtacatgttgcatcccaggcctgtctgccttcttaccctattttattttcatcatagcacttactaccatctgaaatgatctcatttatggtttgtctcctcagtgattaacacagttcctgcacacagtaaatcagtagttctcaacaggaagtgaagaggtcatcctgaggggaacatttagcaatacctagagacatttctggttgtcataaccaggggaatgctcctagtggatagaagtcagggaggctgttaaacccattccacaatgcacaggactggaacaaagaatg

SEQ ID NO: 8037 - DNA, 617 bp, Homo sapiens
gcctttcattgcctgcctgtgctggccatgcttctgctaccaggctgggcctgctcatggggcccagtttctttttcctcttcagtgtggccttctctatcttcagggttcaccttgctcttcctcctaatctgataaagaatgtttcagacctgtgatttccccagattggactcctgtgttctttcattcgacattgatggttctcagtgaggctgcaatacagtctttctctcaactatcctacagattctcttttgcaacagctactaccttctactcattccttcctcctccacagtcctctcttctctcatgagtcttctgagactatcaggcggctggttctccaccacagggctatctctctacatctctgacttctttgcatgactgctgcacgctgggctctctgggccacttctcccacccgaactaagccctgcccccctgtctctgctgctttgattccttacatgcttgatttctgttttgagacttatctgacatttattgtttgtaatgatccttgtggaacccaaatcctttgatatgactacctgggcattggcccaaatcttctctgaaatttctatttgggttaaaaaaaaaaaaaa

SEQ ID NO: 8038 - DNA, 617 bp, Homo sapiens; identical to SEQ ID NO: 8037

SEQ ID NO: 8039 - DNA, 54863 bp, Homo sapiens
gatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttggtaagaatttgactttgtgcatgtgattaccctgttgattaatattttagattttttattaacactattaaagtcattattgaatttgtagaatgtagctaagtggtgcttagaggaaattttatagcattaaatgactttgttaaaaaaggtttcaaatctataatccaagcttctgctatggcagactagaaaaagagaaaactaaaccccaagcaaatggaaggaaataatacagagcaaaattcaataaaattgacaacagaaaacctatagagaaagtcaatgagaccaaaagctggttctttgacaagatcaataaggccgggcacggtggctcacgtctataatcccagcactttgggaggctgaaatgggcagatcacttgaggtcaggagttcaagaccagcctggccaacatggtaaaaccctgtctctacaaaaatacaaaaattagctgggtgtggtggcacgtgcctgtaatcccagctactcaggagactgaggcaggaaactcacttgaacccaggaggtggaggttgcagtgagccgagatcgcgtcaactgcatgccagcatgggcaacagagcaagactccatctccaaagaaaagaaaagatcaataaaattaataaatatctatcgtggttgatcaataaagagaagacacaaattactaacatagagaatgaaagagaggtgggccatcactatagatctgtagatttgtgctatccaatatatagtagccactagccacatgtagctgttgagcacttgaaatgtggttagttcaaactgagatatgttatgagtgcaaccggattttttttttttttttgaggcggagtctcactctgtcacccaggctggagtgcggtggtgtgattttggctcactgcaacctccgcctcctggattcaagtgattcttgtgcctcagcctcctgagtagctgggattacaggcatgcgccaccacgcctggctaatttttgtatttttagtagagatggggtttcaccatggagtgcaaccagattttgaagacaatatgaaaaaaagaatgtaaaaatcttgggaaattttttatattgagtacatgttgaaatgataatatgtattttaaatgcactatattattaagattatggctgtttctttttactctttaaactttagaaatattagaaaatttaaaattacagctgtaactcacattatatgtctgtatggcagtgctactattaatatcaaaggcataatggcaatattatgaataactttgtgcccataaatttaacaacttaaatgaaatagacgaattttctgaaagacacaaagtaccactgctaactcaagaagtaatagataacctgaatagtattgtatctattaaagaaattgagattgtaatttaaaatcttcaaatagagtgcttattgtaacaacttacatgctacaataacacttgaacattatcaagtaaaatgaagaaattgagattgtaattgaaaatcttcaaatagagtgcttattgtaacaacttacatgctacaataacacttgaacattatcaagtaaaatgccaatgtgcagtgctatgttgtgctttttaaagtcatatagagtttatagaacagcagtcctcaaatgttttggtctcagtagcctttatactctaaaaaattttgaggacccttccgagagcatttatttatacagagttacggctatcgtcatttacatattagaaattaaaattcagaaatttaaaaatatttattcacttaaaaataacattaataaactcatgtaaacatgaatagtacttttttatgaaaaacaaaaaaaattagtgagaagagtggcattgcaatctttgtaatgtctatcatagaggatagctggattctctcatctacttttctggattaagtctattgctatacattgtttttgtttgaagtgtataaagaaaatttggcctcacataaatatgtaatttgaaaagggagaagtattttaagaaatcttttaatagcacattcaattaattgtggatattctttgatgttgcaccaagactcagaagatgatcgtttcctaaagattacttgcaaagtgtaatctgaaaacttcagtgaactcttacggctctgttatgttaagattcattggtctggctgggaatggtggctctcacctgtaatcccagcactttgggaggcccaggcaggaggattgcttgaggccaggagttcaagaccagccagggcaacatagtgagacctcctctctacaaaaaaactttaaaaattagccaggtgtggtgacgtgtgcctgtaatcccacctacttgggaggctgaggtaggaggatctcttgagcccgagaggtcgaggctgcagtgagccatgattgcaacagtgggctccaggcagggtaacagaacgagaccctgtctcagaaaaaaacaaaataaaatcaaaaaattcattggtctgacttgaatgttgaatggattttttaaaatcatgtttaattttgtaacatatgaattgataatattggttcactgaagtttatagatcctctttatactgacactttttattatctaatataaattatttgtttttgtttttaattaattatatgttgtttttaattaattaatttttgtttttagagatagcatcttgctctgtcacctaggctggagtgcagtggtatcatcacacctcactgtaaccttgagctcctgggcttaagcagttctcccactcagccttccgggtagctaggactacagatgcatgccaccatgcccatctaattttttattttttgtagagatggaatcttgctttgttgcccaggctggtcttgaaatcctggcctcaagtgatattccctccccagcctcccaaagtgctgcaattacaagcgtgagtcacagcacctggctgtaaattatatctgctagtgttgttaccaatctcatcagtagtttctaagtattagaaagttgtgaagctcataatggcaaatagaagctttccaatatcttaatttttaattgaaagctcaaatttcttgtttttattttttgagagggagtcttgctctgtcacccagcctagagtgcagtggcacgatctcggttcactgcaacctctgccctctgggtacaagtgattctcctgcctcagcctcctgagtagctgggattataggtgcccgccaccatgccaggctaatttttgtattttagtagagacggggtttcactatgtaggtcaatctggtctcggactcctgacctcaaatgatctacccaccttggcctcccaaagtgctgggattacaggcctgagccactgtgcccagctcttttttttttgagacggagtctcccgggttcaagcgattctcctgtctcagcctcccgagtagatgggattacaggcatgtgccaccatgcctggctaatttttgtattttcagtagagacagggtttcaccatgttggccaggctggtcaacgtggaactcccgaccttaagtgatctgcctgcctcggccttgcaaagtgctgggattacaggtgtgagccaccgtgcctggcctgaaagctcaaatgttatcattggcaacaaattctgccagttattttttcttaattgataggctcacttcattcatttacaagaaaatgtttgccaaagatccaattctgcataaccgtagtttatctggcatgtgttttttaagtaaaagtagtgttgtatgaaaaaaaatcacttagttcagcttacaactcaaacaattgcataagtgctttttttcaagacaaccatcacacttctcattttagcacacagaactttaaaaaaaaaatctgtgtaagcgtcaagatttaataaaattaatatttttactgcaagtgagtagtggttaacaatgcagtaacgactaatacagttaggtgccactgccttgattggtgccaaggcaccaggaattttacccaccattgcttttgcaccatcactgcatctctttaacacagtgaaagaggcaaatagcatgtcagtgtcattgaatatgaatgaaaaagttactagattccataatgctttcctttttccaaatcattggtattcgtgattcccttaattatgatcctttgtgttgtagatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtaagacttggatctacacttaacttcttagtaggttttcagcacttttttcttactatagttaatttttttggataaaacatatttttaaaaactttgattaagtagcctggagcactttggttgattacagttttgtggttggtttattttatggttagctcacagttttaatcttgtttcaaccttattgaaaatgatgttaaataaaattctgctttccaaaatgacattaaatgaacataagtaaatattactatcttgcaatatttcttggcaatactttcaaaccttattcttcatggtcattgttacatagaagattatactgactccaaaacactagtaaggaggtgctttcttagaaggcaactactagtataatatattagaaggtggcaagtactatggggggaaaagtctgacccttttcctcactccaccacccaccagaatgtaagctacacgaggataaagatttttgttttgtttactgatatgttcttaggatttggaacaaggtatgatacagtgcacattaaatatatatttcatgaatagacaaaatgaatatattggctttttgccttagatttgagttctttttttttttttttgagatggagtctcgctctgttgcccaggctggagtgcagtggcacaatctctgctcactgcaagctccgcctcccaggttcacgccattctcctgcctcagcctcccgagtagctgggactacaggtgcctgccaccatgcccagctaatttttgtatttttagtagagatgggatttcaccatgttagacaggatggtctcgatctcctgacctcgtgatccgcctgcctaggcctcccaaagtgctgggattacaggcgtgagccaccgcgcctggcctgagttcttataaagtttagtttttctgtgttggttatatgatgttttccattctgaggattttgcctttttaaaagtataggcctggcataaatttgaagagtataggcctggcataaatttttatgtaaagattaagggtggtgattaatattaataaaactttttattgctatcagtagtcatcaagtcataggtcttaatttttttattagtgtcaatattttatttatagttatgttaaataaaatattggcactaattttattagaaactctagggcctagtgtgagcctataatggacatcagtggaagataagttttccaagtggtatcaatttatgttgcctctgccgggcgtgatggctcacgcctataatcccagcactttgggaggccaaggtgggttggtcacttgaggataggagttggagaccagcctggccaacatggtgaaacaccctatctctactaaaaaaatacagaaattagctggacctggtggcatgcacctgtaaccacagctacacaggaggctgagggaggagaatcacttgaatccaggaggcagaggttgcggtgagccgagatcatgccactgcactccagcttgggtgacagagcaaaactgtctccaaaaaaaaaaaaaaattatgttttcttaaaatgtatgtatttattttatcatagaatagttaggaaaaaagtctgttgttatttgcatccatatttgtaagaaaactcaatttttgaaatatttcttttgaggaatttaatggtttggttgttcaaaggacaactgtaatgtgcttttaaagtaacagtcatgtaatttatttttaaatattattaaatactctatttgctaattaataagtatatatgtatcttattctcaccaaggaaataataagtaattgtagctctggtattatgactcctgtcagaaactatttagagatagatgagatgtagtaactcccaaaacctaaatcttaatacaaatttaattataatatttgttaatttgtactactgtggcttactgattctaggagcttcagtttttctcagacttatatttaatcttacctgtttgtaggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaaggtaaactcaagattattaggaagaatttggcactgttgaactgttagatacagttgttgaaattaaagacaaaaagttaataaaacaaaatttattttttgtaatatgaaatttcagaagagtttggtacaaacaccagcacacccaaaatacctcagaacatatgtctgtttttgccataatgattccctcattacatgctctaactacatagcaaaatgacatggcatagttagtaatgcaagagatgggattttttttttacattgttaagtgcttttttttttttttactattataagagtaatatacattcattgtaaagaaaaaaaaccagtatacagtatagaagtttcggaaaatgaaaactcctcccagaattctactctcagatataactgctatttacaatttgatatgtatccttccagatttctttctatttgaacctcccttattttaatttactttattgagatgtaatttatttacaataaaatgcacccatttgatgagttgacaaaggtgtatatacacagataacccctaccacaatcaaaatacagaatgttctttatcacccgaaaatgttttcttatatccctttgcagttagttcaaccctagccttggccaactattagtctagatttttgtcactacgtctttatcacccaagaatgttttcttatatccctttgcagttaattcaacctgagccttggccaactattaatctacatttttgtcatgatggattaaatttaaaatctctcttcgagaaaggaaaaaaaaacggaaaaacaaaccaaaaaatgtactagtcacccgtttgctttttctacttaatattttttggatgtttacatgttttgataagtaggtaggtaagtaaataggtagatagatgtcaagaaaaaaattatgatgggaaagcaatgggtgcagaatgtttttcttttcaaaagaaaagaaaatattttttcagctttttgttaatcaagagattgccctctcttgatcccttcttcagctgattatagtactgatacacttcatggattttactatcttctatgtgatttgaaatttgtatccttcaggctgggcatggtggctcacgcctgtaatcccggcactttgggaggccaaggcggacagatgacctgagctcaagagtttgagaccagcctgaccaacatggtgaaactgcatctctactaaaaatgcaaaaattaaccaggtgcagtggcacccacctgtagtcccagctactcgggaggctgaggcaagagacaggagaattgcttgaacctgggaggcggaggttgcagtgagcagagatcacaccactgtactccagcctgggtgacagagcaaaactccatttcaaaaaaaaagaatttgtatttaataataacttacatatatgtatgtgcaaagaaaaaaggctggaaagatatcaatatagttcattttaagggtatttcataattacttttttaaagcaacttcttatactagtgtataataggaagtaaactatttggtttttttgttgaatatcatgattgcttatatatatatatatgtaaatatcatatgaaagtttgattgtttctgtcttgttttaatttttagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtagatttttttcagtcttttatgacttgaagtaaaatggaaattacttgagcttttttgctgtttttgttactctttttgtcttggattatatacttccttttgaatccgtgtaatctttaaatgtagataattttgttgtgttcactagcagcaatgaaaatgaaaatgtttcttaatagaactatattatagagagaattccaaggtggaatttggttaattacttccatgtctaaatcttaccattttggcaagcacgaccagagaactttcagcgttgaaattccacaaaaataactcctagtaggaagggccaaaacaactctgaatgtgacactttttaaaagctgctgcctcctttttcctcccctcatgtctttcttcagtccccgtcactatgctaagactggtcttatcaaggtaaccgataatctctgtgcttttttaaaaaaataattccattgaaaataccttcttctcatgacttctgtgacatcatactttcaatatttttcctcactggcagctccctttttacttttttgttggctctatcttttagctggagtgtatcccctttttctctactactctctaggtcagggtctttcagtctttttgtctgctttgccacagtaagaaatagattcatagattctggaccaggtatggtgtggtgtggtgtggtggctcacacctgtaatctcagcactttgggaggccgaggcgggagagttgctttagcccaggagttcaatacaagtctggatagcaatagcaagcccctgtttctatttttaaaagaaaaacagaagaaaagaaatatattctatataactgttctataaatatctgcaaatgtaactgaaataaaagtctcctggacaatgtttactcttttgatatcagtttaaatttttttatttcattttttaaaatgctagttgcaaattaaaattgattccatgactcttaggtcaaaatatgcagtttgagaaaccaccctggggaattttatcataatccatggctttaaatacatctcagtgtctatgacttttaagttgatagcaccaaccctaccctctccttgtgtctccagacttacacatccagttgcctacttgaaatctatttagagtttggacagacatttcagacttaatttgctcacaataaaaactgatttttttccttccaagcttgcttcttatgtagtttccccatcttagtaaatggcttactaacaatctagtggctgaagccaaaaatctaaaaattatcctcgattcttctctttccatttcccctgcatcaactccaacagtaaaattatatcatcatgtcaattctatggaataacacattctaaatttgtctcttttcatttcttctgctaatacaacctggatgtcatctcttggactgtcatagtagcctcctaactagtcttttagcttcagttcttgccttccacagtccattctccacagagcagcctaggtgatcttttaaaaatatagatcatgctcctcttctcaaatccctctgactttccttcacttttagaatcaaagtcaaacttctgatagctgtcaaggtgatctactgatcccgtataatctgacctttgcctgcctctccaacctcatctcttaccgttgtttctcattaccatgttctggccatactgcctctttgtgttcttcgagccctccattcttcctaccttaggactttgcattagctgttccctccatccacttccgtgttccttcccctaatgtttgcatggcaggctccagcttgcagttcatgtctcagcttaaactttactttctgagaggtcacttctgactaaccagtctaacaaaccactctgacattctgtatcacattattttaactttgtgataatttttttgttctttttgtgttttttaatttgtcttctacctgaaatttgaatttaataagagtggtgactttgtttattgctgtagccccagtatctaggccaatgctggcgtgtagtaagctctctgtaaatatgtcttgagtgaataaatgcccacttataaggactttatgtgaagagtccatgtaacatcttactgtgtttctaatacctgaatgatgcctcagttggatgggttattcataaaaagtagtgctagtcagtctagtaatttaccacaaaatcaattcacagaaaataatttagactgcgttatagttggataacctttgatgcctgatttatatttacattttctcattaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggcaagataaatttgtttaaaaaaaacaagtataatataaagtgttagatattcttcaagaagaaaattatttcattgttttattcctaattaatttaagaataaattatctctattttatattttaaatttctattttaatatgttggcagaactgggagctgcaatctttaggcaaggtagccattgttttatgtataagatcttgtttttatttttatgttcttttaagacagggtctggctctgttgtccaggctggagtgcagtggcatgatctcggctcactgcaacctccacctcctgggcttaagccatcttcctacctcagcctccttagtagctgggactacaggcatgtgccaccatgcctagctaatttttgtattttttgtagagacagggttttgccatgttgcccaggctggtctcaaactcctaggcgcaagtgatccacccaccttggcctcctaaagtgctgggattacaggcgcgagccactgcacccggctaagagctctcttcatgagaattctcattagaaaacttataaagaaggaaatatatttttctgaaagtattaaatagcaaggaggtgatacaaatcaataataagttgtgtcttttccagcagatcatacagaaaacttagaattttctagagcttcactgtttactacaataactagtatgtgtgtctgttgagcacttgaaatatggctgagatgtgcttgtatgtgtaaaatactctggattttgaagacttagcatgaaaaaagatataaaaatcaatttttttatgttgattacatgttaaatgataatatttgagatatcttcgatgaaataaaatgtattattaacattaacttcatcctttttttctttaaaaataattttttttttggctgggcatggtggctcatgcctataatcccagcactctgggaggccgaggcaggaggatcacttgagcccaggagttcaagaccagagtgggcaacatagtgagatcccatctctatttaaaatttttttttttttaaggaataaattaggagtcttgctctgttgcccaggctggagtgcaatgatgcgatctcagcttactgcaacctctgccttccgggttccagcaattctcctgcttcagccttctgagtagctgggattacaggcttgcgtcaccacactcggctaatttttgtatttttaatagagacagggttttaccatgctggccaggctggtcttgaactcctgacctcatgtgatccacccgcctcgacctcctgaagtgctgggattacaggcgtgagccaccgcccccagcctaaattttttcacttaacttttttttgttgttcagatacatggtatgtagccattttttttttaatgtggcactaggaaattaaaaattacacttgtggctcacatgatatttcttttggataagtgctattttagaccaaattctagaggcttatgacagatgatttgaaagacactgaggagtaccttattttattttatttgtttttgtgtttgtggtttttttgacgcagagtctcactctgtcacccaggctggactgcagtgatgtgacctcagatcactacaacctctgtcttctgggttcaagtgattctcgtacctcagcctccggagtatctgggactacaggcacataccaccacgcctggctaatgttgtatttttagtagagatggggttttgtcatgttggctaggctggttttgaactcctggcatcaggtgatccacctgcctcagcctctcaaagtgctgggattacaggagtgagccactgcacctggcccaggagtaccttattttaaatcacctgtcatctctgtctcatggggacttaaatatttctctttttggagattcatgttcttcatttacattgctggaaactccactttgtctttaaaatatcaaccatttctaaatgtgttttctattagtcattcaggctttaataatatgaaccattgataacttccatttgtatagatttttttctcccaagtaccaattagatccagaccctgcggaaactaatgtttgcagagtgaggggggtgtgaagccacagataagaaaagggataatcaggtaatttgccacagatttcctgagttggaagcagaataggtggaaaacaagaatgcttccctgttttacgaggtaagaattgcttacctagtagttggggacagagtagtgacaaggccaacaaaaagaagagagaggaagaagagtactaaagataaatttcgtaaagatcactttgtatcagattttggtcatttttctaaatgtttctcaagcgggagccttctgattcatgtttaattttttactaaaattggctttaaaattattatcggccgggcgcggtggctcacgcctgtaatcccagcactttgggaggctgaggcgggtggatcacaaggtcaggagattgagaccatcctggctaacatggtgaaaccccgtctctactaaaaatacaaaaaaaaattagctgggcgtggtggcgggtgcctgtagtcccagctactcgggaggctgaggcaggagaatggcttgaacctggaaggcggagcttgcagtgggccgagatcgcgccactgccctccagcctgggtacacatcaagactccatctctttttttttaataataataataaataaataaataaatgaaattattattatcttccagcaggtggcatagttttcactgaaactcagttttttcactttatttgtgtaaattttagtcatatcaaatccaatgttttttctttttttagttaggtcttactttatatggttaatgaaattttacgtaataatcttagattatttgcttctgttttgtgttttgcttttgaaagcaaagttgaatccttggtatgtataatatatttgaaatagggttcctttaacaacatgtagctatgtctccaagtgatttttctgttggtgtttaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgggctattaaaagaagtctaaagttgactctttttaaaaagtatgttgaaattctttttatgaggccctttaagtgtatttgtcttttatcttagtccaattacttgctttccatagtcactaaattaggaatttgttcatattcactctgaagttttcagtcacttgctttacttgaaacatgttgaacaaaatagaaataattaggatgaccttaccatcatttcagccacacagggagaggaattctgattaaacatggcatttcaccttttattactgtcttttattttaataaaataacaataaatataaaagttaaagtgaaaataaaacaatatatattcaattgagaattgaaatatacaattaagctgctttttgagatgttttgcttaattatcgtaataggaggaaggactaatagaagacagagtctcgctctgttgcccaggctggattgtagtggcgtgatctcagctcactgcaagctccgcctcacgggatcacaccattctcctgcctcagcctccccagtagctgggattataggtgcgcaccatcacgcctggctgatttttttgtatttttagtagagagggggtttcaccgtgttagccaggatggtttcaatctcctgaccttgtgatctgcctgcctcggcctcccaaagtgctgggattacaggcatgagccaccacgcccagctgagtttttttttttttttttttttttatgtggagtctcactctgtcacccaggctggagtacagtggcgtgatctcagttcactacaacctccactttgagttcaagctattcttctacctcagcctccccagtagctgagattacataggcatgtgccaccatgcccagctaatttttgtatttttagtagagacagggtttcaccatgttggccaggctggtcttgaactcttgacctcaagtgatccacctcaagtgatccacccaaagtacaggcatgagccaccgtacctggtcctggactaatagtattttatattgatccgtgtgcacattaaagtttgggaagtactgctgctggcatatgtataaaatgatacattggctgggtgtggcatgggatttctttttggggtgatgaaaatgttcagaaattagtgttgatagatgcacaattctgtgaatatacaaaaaaaccactgaattatgtcttttttttttttgagacagagtctcactctgtcacccaggctggagcacagtggcccgattatgtctcacttcaggctcacttcagtgacatcctgggctcaagcgatcctcccaccttagccttccaagtagctgggactacaggcacgcaccaccacacccagctactttttgtagagacagggtttcaccatgttgcctaggctggtctcaaattcctgggcttaagggatcttcccgcctcggcctcccaaagtgttgggattacaggcatgagccactgtgcctggctgaattgtatacttaccatatgatatggctggtacattctctgtgaactcaatattatgtgaatcatatcttgacaaagctgttaaaaaggatgaggacactatataatgatatagaaaaatctgcaagatgtgttaagtgaaataaataccatttgtgtaaaagtggggaaagaataagaatatgtaattgtatttgctttacatacgcaaaagaattcctagaagaatgaaaaggaaactaacaataatagttacctcacggagagaaactcagtggatagtataggagacttttctctgtattcatttttatactttttgagcatgtaaattgagcatgtaactttgaattactagttcaaaagttaaataaattgaatttttaaacaaagcagcaattcaataaactaaatcagataaggccagaagttaagttcaagaagacttcttaatttggctacatggaggttaacggtgactctgataaaagtgataaaatgttaaattccagattggggtgggcatgggaggtaaagaaatgaaagtagaatatgtggataactcttatcaagaaatttgactattgggccaggcgaggtggctcacgcctgtaatcccaacactttgggagcccaaggcgggaggaatgctggaggccaggagtttgagaccagcctgggcaacatagtgagacccagtttcaacaaaaaaaaatttttttaattacccaggcatgatggcacacacctatagtctctgctacttgagaggctaagaggggaggatcacttgagcccaggaggttgaggttacagtgagtcatgatcacacctctgcactcctgtctaggcgacagagaacctatctcaaaaaaaaagaactttggtgtgaagaggagcaaagatttggggtggcacctaaaggaggataaaaagtctttgaagggattttttagcttaggtgactctatagcatttttgtaatcttttggcaatgaatttagtaaagaagataagattgataatttaaaagaaggagccaatgaaaggaatgaaaaaagaaaaaaaagtagtagcttttagatcacctgtctaaaataggaaaatagacatttcatcagttctggaaagggaaaaaaataggcacaaatgcagatagatttggtagccaaaaggtaacaaattcctatcttctgtttttggcttctgttttgttggcagatcatgaagcagaattcagttatttctggagacagtggttggcattgtgggatgtttgagaagaaaagacatatagtctcagaggatgcaaaattgaattagtagagaactacagaggaattggtggttatttctgtgtgttttgcctttacagttgtaatcactgaatattacattctaaatattgacatatttagtatcagaagaagtatattcattaacggttttttttttttagagccagggtatcactcatttgcccatgctggagtgcagtagtgcagtcatagctcactgcagccttgaattcctgggctcaagtgatcctggcacctcagtctcctgagtaggtagaactacaggcacaggctaccacacctggctaatttttaaaaatattttgtaaagatggggtctcaccatcttgcccagattgacctctaattcctggcctcaactgatcctcttgcatcagccttccaaagtgctaggattataggtataagccagatgccaagccacattcactatttttagtagttcttatagtgtaggttgttctcagtgatttcttgcatgtccattttcaggaatctagttagtttagtaatttgaattaaagaattcacagtctatcttaatagtaggttaaggtttgaacctatgaggatttttactattctgcctaatgcttattcaagtaagattattcattttgttagtgaatgtcattatcttagaggtatatgaaattatttatttgcaatatatgaaattagtcatctgcaatgaacaattttgcttcttcatttcatttaatattacaagtatttcatcaattgcagttttcacacccttagtaatttatccagctggctttttttttcttaacatgcttttttttttttccacacaaccctttggaacacattttttacttgctttttatttaagatttgtaaagaattttaacttgttaaaaactacgataattacagctggtaacatttaactgttatattcaataatggataaagaaataatggactgtaaattacagcttttacacttagaaggattttagaaaccgtctatactagtagctcctgacattttcaaatataagagccctttttatttatttatttagaaacagggtctccttacgttatccaggctggacttgaacaagagtccttttttaaatgttgaacagttcatgcctccaaataatagtagctctagtagctctacatttagtatcagctaataaagaatatttctttattgagacacagtctcgctatgttccctaggcttttcttgaactaacctcgagtgatcctcccaccttggcctcccaaagtgctgggattacaggcatgataacataagcttctgtagacctgaaaattttattttaatataaaattgtatttacaaatcacgttatctgcatacatgtgaaaattttagtatgtaaagtggaaactatttttgtatttggtctacagacaattcatggtgcttgtgtgcattcctagacactttataatagctcagcagccctacaggaataaaagaatgggaactaccaagttcttttggtctatttgctgtctctcttcacccccagcacttctccccaatttttacatatgagaaaactaaggtccaaaaagattaaagtaatttggtagagagtacacatctatttattggcaaaaaaaaaacaaccttatttttttgtattaaaatataggaacaaagggagttagctgataagtagattgaaagaataaatacttctcctataaagaccagcttgttgtagaataattgaattactgaggggaatcttatacagtaggcatttgaagcactgagaagatacactaaaaaatctgttgatagaaatgtatttatttgtatattatgtgataaattgataactgcagactgttttcatattttcatattttcctggctttatgctggaataataaacttgaataagaatatttttctttttttttggtacacccttgtagaacatttatttatttattatttattatttattttttggtatatagccttaaatatttttcaaagattggaagcaacacttctcagtatggcttactgtacttttcacaccagttttgcttaacatgttggcatatttagagatgattcatttcctttctgtggatagcggtacatggaagttcggggaataaaattctgcaatcacttttttagtagcctgctgttgtgtttaaagagccttacctattttggctagcaagaaattcatttttggccaggctttgtgactcacagctgtaatcccaacacatcgggaggccaaagcatggggatcacttgaggccaggagtttgaggctagcctgggcaacatagagagaccctgccaggcatggtggtacatgcctgtagtcccagctgctcgggaggctgaggtaagggtatgacttgaacccaggagttcaaggttatacagcccctgcaccccaacctgcgtgacagaaggagactttgtctctaaaataaaaaggaaataaagaaattcatcttcatatttatttgcatttttaatgcctctgtttgctctcattgtttgtgataaagatagcaaatcacatgcttctctggaaagccaatgtggcctagtggtccagagctcgagctctcgagtgacactgcctgcttgtggtatcctggctgaaatcctcgttcagtagccctggctctgtgccactgtttcctcatctctaaaaccacagtgtacccatttcacagaatttctgtgaagatgaagtgacttagtgatacctctttctttattcttttaactttaaatgcattttctaacccaactcagtggtatttatgctttctttttgttcagagatcctttaaaagaaagtacattttgtgaaaaataatttttaaaaattcatttgagagcgtgtcacatcggtgcacacctgaataccagctacttaaaagacaggggcaggaggatcactggagcccaggagtttgcagacagcctgggcaacagcaaaaccccgtctctttaaaaaaaaaagcattaatttaagtcaatataaaattttcctattttcctttaattatgaatatgaggttgggtgcagtggctcacgcctgtaatcccagcaccttgggagggcaaggcaggcagatcaccctgaggtcaggagtttgagactatcctggccaacatggtgaaaccctgtctctactaaaaatacaaaaattagccaggcctggtggcagatgcctgtaatcccagctacttgggaggctgaggcaagagaatcgcttcaacctgggaggtagaggttgcagtgagccgagattgcgccactgtactccagcctgggcaacagagggaaactctgtctcaaaaaaaaaaaaattatgaatatgagaaattactgatctgtattaatgtcatccctgccccctttgagctgaacttcagtttaccaagtattgtttcttctaaagattttttcatgacactactggttaatacataactgagagttaataaattttgctgtgttacagtctaatttgctctctaccaacagagaccttctttctttttctgtttagtttttcaaaacaagagttatttaatgtgcttgaaaactagacatttttcctagttgtgttcactgaattagcatttattatagtaccgactagatgtgctataccacacaaagataaatgaggctgtggcctggaagaggtaggcttgtaaagtcattatgctactcccaaataagtgctttaaaagagatgtgagcaaagtcccctcaaatgcagaagacagtccggtccaacacagaagaaaaagcaaaacttgctggctggggcaaggttaatctggacacgacctagttttctccagtttggcatttttatttattttttcgagacagagtctcattctgtcatccaggctagtacagtggcacaatctcatctcactgcaacctcctccttccgggttcaagtgattcttatgcctcagcctcccaagtagctgagattacaggcatgtgccaccatgcccagttaattttttgtatttttagtagagacagtgtttcgccaggttgcccaggctggtctcgatctccagagctcaggtgatctgccggccttggctcccaaagtgctgggatattacaggagtgagccaccacgcctgattattttggcatttttaaactctttctttaatataacaaaaaaaaaaaaaacaaaacaaaacaggttttgtggtcaatttgaaaacaaattgaagtaattttttttttttttgagacagaatctctctctgttgcccagactggagtgcagtggcgtgacctcagctcactgcaacttctgcctcctggcctcaagcgatcctccgtcctccgccttccgagtagctaaagctacaggtccatgctgccatgcctagcaaattttttgtattttttgtatttttttgtagagacgaggttttgctatgtagcccgagctggtcttgagctcctgagctcaagcgatctgcctacctcagcctccttatgtactgggattacaggcatgagccactgtgcccagccacttttgtctttttagtaaaccaggtttttcattgtttttttttttttaaattcctcttccaggtggtttatgcacatagtttccaggaaactccgtcgtcatcaaaacccaccaaattagcagtttaaatgtgtttgttttttccttgaattcttctatgacggggatatttaacagagaaaacatctttttagttgaagtctctaaagctaaggaaaggataaaaaaatgcgaattggtgctctgctttgatgtaaatgtggcttagaaagtaacttaataaaatcctactcagtatttcctttttctttgtgataattgcttactatgtgtaaatcaataaagtgagctgtaaaatgtttttaaacaggacattttagaaaaaaatgtttaggcaattaacatttctcacagtgtttcttctaattttgttaatgtacatatatatgtacctggactcatcttttgtgaatgcacatgctctttttcattttgcatgactagtaaagtagtgattcttgtaaatagagatttatgacagaattgccacaagattctttcaaacttgaggtattcacactgccacctcatactgtgtggtgaaaactagattttttataaaatcataaaaggagagaaggaagaaataaatgaaattgtatgttcaaaaaaattagaaccctaaaaacatttgtatttttattgtatagtcagaaaaaaaagaagggagggtatttgaatctcacaagaaaggggcctgagtagtttgaaaaagaatactagacattgtcacttacttgttttctaattactctagtgggcatttgataatactggaagatatttataaaatttttaaaccctagggtctagcttctacttagtatctcccttcaagaatgtcctgattaaaaggctatactataaattaagtggatgattattagtaagcattcaaaaagagatttcgtctttttaaatgactttatgaaaatatgaaatttgcctgtggtatttatagtgtgcagtcatggttttccagtgcttttctaataaataaatcggagtacataagttgaaagagttctatatatatataaatcattctgtgattaattaatgctttttaataaatcagctgcgagagcactactcatgatgggcgtgtttgaatgccttatatagactactcagaacaggtttagacagtctttgccccgttgacctgttaccatatttatcagagtagatatagattatagtctttctaatgatgttctgcttcactctgaccaatatctaataaacacttaacctatattaggcatttcaccatctttctgtctctcttttttggaatggagtcttgctatgttgcccaggctggtctcctggcttaagtgatacccttctgtctcagcctcctgaatatctgggattacaagtgcccactaccatgcctgatttttttctcttttttgacaactcataccgacagtactaagaattcccaaactgatggatgaaagtgaatatgcctcattggcattttttttttttttttttttttgtgacagtcttgctttattgcccaggctggagtgcagtagtgcaatttcccaggttcaagagattctcgtgctttaccctcccgagtagctgggattacaggcgttcaccaccacacccagctaatttttgtatttttagtagagatgggttttcaccacattggccaggctggtctcgagctcctggcctcaagtgatctgcctgcctcacccctcaaagtgctgggattacagacatgagccaccatatctggccaacttttttttttttttttggtgagaccgagtctcactctgtctcccaggctggagtgcagtggtgtgatctcggctcaccgcaagctccgcctcccgggttcaccccattctcctgcctcagcctcctgagtagctgggactacaggcgcccatcaccacgcctggctaattttttaaaatatttttagtagagacagggtttcactgtgttagccaggatggtctcgatttcctgacctcgtgatccacccgcctcggcctcccaaagtgctgggattacatgtcttgccatgttgcccaggctggtctgaaactactggtttcaagtgatccacccacctcagcctcccaaagttctgggattatgggtgtgacccaccgttcccagccttgtatgtcttcttttgaaaagtgtctgttcatgtcctttgcccactttttattggggatatttgttttttgctgctgatttttttttaagttccttatagactctggatatcagatctttgttggatgcatagcttgcgaacattttcttgcattctgtgggatgtcttttttttttttttttttttttttgaggcagagtctcattctgtcacccaggctacagtgcggtggtgagatgagatcatggctcactgcagcctcgactttctgggctcagtgatccacctcaggatctgcaaatgtctttccatttgtttgtgtcatctatggtttctttcaacagtgttttgtagttcttgtagagatctttcacctccttggttagatatatcctaggtattttgtgtgtgtgcatatggctattgtaaatgggattgcacaagactacaggcacatgccaccacacctggataatttttaaatttttttgtagagacaggtctccctttgttgcccaggctggtctcaaactcctgggctcaagtaatcctcctgccttggcctcccaaagtgctgggattacagatgtgagccattgcacctgacctgtttactcttggtagtttcttttgctgcgcagaagctctttggtttaattaggtcccacttgtcaatttttgtttttgttgcaattgcttttgtggacttagtcatgaaatatttaccaaggccaatatcctgaagggtatttgctagggtttcttctgggatttttatattctgaggtcttacatttaagtgtttaatccatcttgagttaatttttgcacatggtgatagttaagggtccagtttcattctgcatgtggttagccagttatctcagcaccatttattgagtagggattcctttcccagttccttgtttttgtcagctttctcaaagatcagttggttgtaggtgtgtggctttatttctgtgttccctattgtgttccactggtctgtgtttctgtttgtgcaccagtgccatgttctttttcactagccttgaagtagagtttgatgttgggtaatgtgatgcctccagctttgttgtttttgttttagatcctttggctatttgggctcttttttggttccatatgaattttagaatagttttttctaattctgtgaaaaatgacattggtaatttgataggaatagtgttgaatctatagattgctttggggagtatggtctttttctttcttctttctttctttttttttttttttggtgctgtgacttcgatgcaaaccaaggttgctgcagacacagtatggtcattttaatgatattgattcttctaatccatgagtgtggaatgtgtttccatttgtttgtgttatctgtgatttctttcaacagtgttttgtagttcttgtagagatctttcacctccttggttagatatattcctaggtattttatgtacatgtatgactattgtaaatgggattgcatacttgatttgactctcagctcgaacattattggtgtataaaaatgctactgatttttgtatattgattttgtatcctgaaactttaccaaagtcttttatctaggagccctttagcaattctatgtatagagtaatatagtcagtggagagatatttgacttcttttcctattttggtatcttacttgattgttctggctaagattttcagtactctgttaaatatgagtgaaaagagtggccaaccttgtcttattccaattcttaagggtaatgcttccagctttttcccattcatatggtgttgtctgtgggtttgccatagatggctctttttattttgagttatgttccttcaatgcctagtatgttggaggtctttattatgaaaggatgttgaattttatcgaaagctttttctgcatctattgagatgatcatgtggtttttgtttttaattctgttgatgcagtgaattgcatatattgatttgcatatgttgaaccaaccttacatcccaggagtaaaacctactggttgtggtgtattaacttcctaaagtactgttgggtttggtttgctagtgttttgttgaggatttttatatctgtgttcatcaaggatattggcctgtagtttctctttttgatgtgtctttgccagattttggtatcaggataatgctggctttatagagtgatttggagaggagttggtattttggaatattttcagtaggactggtaccagttctttgtgcatctagaattcagctgtgatttttctggtccagggctttttttggttgataggttttttatttattacgattcaattttggaactcattattggtttgttcagaatttctgttttttctgagtcagtcttgggaagttttatgtttccaggaatttatccatttcctctagattttctttgctgtgcagaagttctttagtctaattaggtcccacttgtcagttttggtttttgttgcaattgcttttgaggactttctctttctctctctctttttttttttttttttcttgaaacggagtcttaatgctgggcgcggtggctcacgcctgtaatcccagcactttgggaggcataggcgggcggatcacaaggtcaggagatcgagaccacggtgaaaccccgtctctactaaaaatacaaaacattagctgggcgtggtggtgggcacctgtagtctcagctacttgggaggctgaggcaggagaattgcgtgaacctggaaggcggagcttgcagtgagccgagatcgtgccactgcactccagcctgggcaacaaagcgagactccgtctcaaaaataaataaataaataaatagaaacaaggtcttacctaggctggagtgcagtggcatgatcatggctcactgcagcctcaacctcccaagctcaattaatcttcccatctcagtcttctgagcagctggagctacagatacacaccaccacacctggctaatctttaaaaatttttgtagcaattgggtctcattttgttgcccagggtggtgtcaaacttctgacctcaagtgattctcccacctttgcctccaaaagtattgggattacaggtgtgagcccatttcctctaaattttctggtttgtgcacatagaagtgttcataatagtctctgaggatcttttgtatttctgtggaatcagttgtagtgtcacctttgccattttctgattgtgcttatatggagcttccctcttcttttctttgttaatctagctaggagtttatcgatcttgtttatcctttcaaaaaatcaattttttttgttttattgatcctttgtatggattctttagtctcaattttgtttagttctgctgttattttagttatttcttttcttctgctagctttggggttagtgtgttctcgtttatctagtttccctagatgcaatgttagattgttaatttgagatctttctaacttgatataggtgtttagtgctataaacgttcctcttaacattgcttttgctgcatcccatatattttgatatgttgtgtctgttttcatttatttcaaagaatatttcaatttctgcttaatttcattgtttattcaaaagtcattctggagtatgttgtttactttccatgtaatttgtgtggttctgagagatcctcagtattgatttctatttttattttactatggtctcagaatatatgcttggtatgatttcaatttaaaaaaaatttttgagacttgctttacggccaagcatgtggttgaccttagagtatgttccatgtgcagcttcatcagcatttatcttggtgataacatggattccatgacaggtattaatggtacaatttttatgttttaaaagtggtagtttgctaaggaaaatatgaagagagctgatttcacttttagtggttgtcatttaataaagtgagatgtgaggttgggcagggtagctcacgcctgtaatcccaacactttgggaggcaaaggtgggaggcacactttagcccaggagttcgagtccagcctgggcaacatggcaaaaccccatcgctactgaaaatacaaaagttagccaggcatggtggcatatgtctgtagtcccagctacttgggaggctgaggtgggaggattgcttgaacttgggaggttggggcttcagtgagccgtgatcacaccaccgtgctttagcctgggcaacacagtgagaccctgtctcaaaaaaaataaatcaagtgagatgtgagaaggaatttttctattcttgaaatgcatgtagggatagtctttatgcctagtcaagcctaaaacacttttttaaaaagagatatttgttatatatgattaaggcagctattataatattactattctaagttactaacttttgaaaactttttaaattttgtagtttttatgacatgttagtaaatttttatgatggaacttttctttactaacaggtgcattccttgtaaaggttctcggtttcccccaacccttccacgccctgctgttgctatattatcctttaagcttccttactgtcagattgcaacagagaaaggacaaatggaggtatgtggaagtcttaccttgacactttgaatttgataatacagcacctgtgatacacacactttaaaattatcctgatggccagtattgaatattcattactgtataattacataaataggggtagcagggagggaagaggactgcttgggatcaccaggccacctgattgccatcactgcttccagggactttgtctacaaagtaaatgggtgtgactgtcagagacccactggggaaagacttactctcaggatggggcatgtccctgagaagaagtgcctccatacattttgtgccataacacctggcttgcctgaccctagtcctagccttgtgtcatcaaaagtcatttgaaatcttgcagttagttattctaaataagaaacaagttagcttttaaaaatcttgtttaccaaattctctgagcattaattatgatagctaggaaactgttttaaatgctgtattcctccccagctgccttttttaaggataggggaaaaagttaagctgtagtatcacactagaatttaaattgtaaaataaacttatagaaaggaagagttcagaacatattttattcaaaaactggtatcttaagataaatatttaacgcttgcctcatattaaggtgatagttggccttaagcaattttatttgcttttataggagcaattttggcgttcagttatatttcacaaccaccttgattatttagctaaaaatggttatgaatatgaagagagcactaaaaatcaagcaacaaaagagcaacaggaacttttaatgaaaatgcttgcggtgagtaaaataaatatactgaaaacgttaaagttaaatgcttttctataggttgaatttcttaaaggtctgtgcattaggactaagtcccacaacctaagattcttaagtttttttttgttgttgttgttgttttttgtgcgacggagtctcgttctgtcacccaggctggagtgcagtggtgcgatctcggctcactgcaacctctgcctcccgggttcacgcaattctgcctcagcctcccgagtagctaggattacaggcacacaccaccacgcctagctaattttttttttttttttttttttttttagtagagatggggtttccctatgttggcccgactggtctcgaactcctgacctcgtgatccgcccgcctcagcctcccaaagtgctgggattacaggtgtgagccaccacacccagccattcttaagttttatctggtggtgttttcccttgtaaagttctatcttctagttggtcttgcagttaaaatttttttctttttttttttttaggcggagtttcgctcttgtttctcaggctgaagtgcagttgtgcagtcttggcttactgcaacctccacttcccgggttcaagtgattctcctgcctcaaccttccgagtagctgggactacaggcgtgtgccaccatgcctggctaatttttgtatttttagtagaaacagggtttcaccacattggtcaggctggtcttgaactcctgacctcaggtaattcacctgcctcggcctccgaaagtgctgggatcacaggcatgagccaccgtgcccagcctaaaataaataaaacagtaccttgtagctaagatcatgtgcaggaataaacatctctagggctacttcccttttgcttttgcccatcagtctatgttttaacgggctctcaaggtaactgagaaccactgctctagtttctgttattattttacaaagtttgagtatatactgttttttaatctccagggctgggcaatcttaagaactttgatcgggctgttagatatgcctgccttttgtcatcctctttgagttaggcagctgtgtgtgatgaaaatttatttgtgaccagtggccaggtttggtgtctagaatatttaagtacatttatctttggagcagggtgtcttaaagttcctgtgcttgtgtccccactcaaggttggtttatggagaggagtatagtatcatttcttctttatttgtcttacactagactttatgccccagagggcagagacctgctcactgctgtatgccaggcactgacatggtggcttaacacatagtagacctcgatatttgttgacaagagtgaatggtccagacttttaattttaaaattggagaaaaaaggttcttagagaaaagtggtatatgagaccacagagcaaattgccactcttgtctccaaaaggtagtactcactactgtcacctttatgcaacatggccttaagtttggtattaagaaaactcagtttattgtagaaaaagttttattccttttataaagtgttacttgtggtccaggaactagtagcctttttatttgtacaacacatataaggaaacatatttcatgtatttgctatttagcctagaggagcttttccctgtggcagtgtttctcatatcaaaaataccaggggactcatatcaaagatgccagggcaggaggatatcttgagcccaggagttcaaggggattgttgagttcttctttagcattcctgacccccgggcaaatgcctttagttcagaatagtcactgtggaaaccagactattcctttttatttctttttttttttttgaaacgaagtctcgctctgttgcccaggctggagtgcagtggcgcgatctctgctcactgcaagctccgcctcccaggttcacgccattctcctgcctcagcctcccgagtagctgggactacagttgtctgccaccacaccagctaattttttgtatttttaatagagactgtgtttcaccgtgttagccagtatggtctcgatctcctgaccttgtgatccacctgtctcagtctcccaaagtgctaggattacaggtgtgagccactgcgcccggcttcctttttatttctaaatgccccctgaggcagtgtaccatcccgattaagaagtactgattatagataaatgatactaaaaatcttgaaaagggcatccaggtgaatatctaaagcttttgtgctgatggatcagacatggaatatctaagtaagaaaatagttctaatacactatgaattaggagacccttagtaatcttcaaaataccaacttttctcagtttgttgtttttcttttttgtattttttagagaaagggtctcactctgttacccaggctagagtacagtggcaagattgtaactcactgcagcctcaacctcctgggctctagtgaacctcctgtctcaggctcctgagtagataagactgcaggtgcatgccaccacgcccagctaatttattttttgtagttatagggtctcactgtgttgcccaggttagtctcaaactcctggcctctagcagtccctctgccttggccttccaaagtgctaggattacaggtgtgagccagcacacctggcccccttgattttttttttttttttttttttgagacagagtctcgctttctcgcccaggctggagtgcagtggtgcaatcttggctcactgcaacctccacctcccgggttcaagcgattctcctgcctcagcttcccgagtagctgggattacaggcgcacgccaccacgcctggctaattgtgtttttagtagagacggggttttgccatattggccaggctgatctcgaactcctcacctcatgatccacccatctgggcctcccaaagcactggtattacaggcgtgagccaccgtgcccagcctcccccttgaattttttaaacaaatttcttaattttcttgcaattagtagattaaagtggtatgtaatatttcatcaaatctaagccactgtttattgcatagtgcaccattactttattcatttaagccatggagacataaaaatgctgccaaactgacccaccattaattgtaattaattgtaattccaatttcagagatgttaaaacttgtaaaaatgtgcatcttagaattagggagatagagtagctagaaaactattgtctcagttttactagtagtgtcagtatctttaaaaagttttacttgatgttatttgatctcccccccccccccctttttggattagctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctgggtaagaaataatttagttgtttgaattttcctttactgtcttgaatgttaagttggtctttgcatagctctttattgaataatattattttctcttagttacagcaatactgctacagagtggagccaaccaaggttcagaaatcaagttgaagaagatgctgaggacagtggagaagctgatgatgaagaaaaaccagaaatacataagcctggtgagatacattttcaagcccataaatcatgagaactatcatggatgtggcttttcccattttgcttaactgagggaaattgaatactcatactttttttcagacctctttgctatctggttgttgtatattgaggatgactatattttccccatttacattatattgctttattttaatctgtaggacagaactcgttttccaaaagtacaaattcctctgatgtttcagctaagtcaggtgagaaatatttataaatttgtaatatcaaggaaattttgcaagtcatctgcaaagtgacacatctacgcaaatacaccttaactcttaaggccacttttggtgtgtgtgtgtttatgtttttgtttttttaatctcagatgttgtttgtgaagctatggtcatttaacagatgtttataaaatgcctattgagtgtcaggcattttacttaatggtggatacagaagtcaaacagacatgtgtggttgatctctgttttaatgctattttagcccagctgagaagacagatgttgaagacagatctgggtatcactgaggaagcatgcaggatactggagaaacagttaaaaggaattgaaggctgggcgcagtggctcacgcctgtaatcccagcactttgggaggccggagtgggcggataacgaggtcaggagttctagactagcctggccaacacggtgaaaccccatctctactaaaaatacaaaaattagctgagggtggtggtatgtgcctgtaatcccagctactcgggaggctgaagcaggagaatcacttgaactcaggaggtggaggtagcagtgagccgagatcgtgccattgcactccagcctgggcaatggagtgagactccatctcaaaaaaaaaaaaaaggagttgaaaatggttgcgtacagggagtgggcctgggggataagagaaggttgaagtaaggcactgctggcccttttttggtggggagcataaaccttatagtaccatttgactttttaaactgtggacatatgttactttgatttaaaaaaattaacttaaaaaacatgtagaatatgaaaagagcgtatgacacatagctgtcatctagccagtggtggaggatgggtagggacttcaaggcaggcctcatggagtgtttacagcagagacctgaaggatgaataacagtcagcaaggcaaaggtgcatgggaacaggagcagaagagaagcatttgggcttaaggaacagtatgtgtgaactgaaggctgcaaaagggtggtgtgaaaagctcagagagcaaagagaaagtggtgctgaagggtttcggagtgatgggcaggagccaagtcatgcagatctgtgtaggccatattaaggattttggtcttttttttattttattttattttttttaatagagatggggtgtcactctgttgtccaggctggtctcaaactcaagcaatttcctcacctccacatcccaaagttgttggacctgcaggtgtgagccaccacacccggtcaggattttgctctttattctaaggtcactgagagactgttgtaggttttaagcagaggtatagcatggcacactgtgctgaagaagaacagataatagactactggccaggtgtgatggctcatgtctgtaacctcagcattttgagaggccaaggtggaaggatcacttgagaccagacgtttgagaccagccttggaaacaatgaaaccctatctctacaaaaagtaaataataaaaatattagccaggcatggtagtacacaccggtagtcccaggtatttgggaggctgggacaggaggatatcttgagcccaggagttcgagggtgcagtaggctatggttgcaccactgcactccagcctgggtgacagagcaagaccctgtatcaaaaaataaataggccaggcgtggtggctcacgcctgtaattccagcactttgggaggccgaggcaggtggagcacttgaggtcaggagttcaagaccagcctggccaaaatggtgaaaccacatctccactaaaaatacaaaaaaaaaaattagccgggcatggtggctcatgcctgtaatcccagctactcgggaggctgaggcaggagaattgcttgaatccaggagtggggagttgcagtaagtggagatcacgccactgcactccagcctaggtgacagagtgagacttcatctaaaataataataagaagaagtaaataaaaattaaaaaataaagagactacaagctgggcgtggtggctcacacctgtaatcccagcactttgggaggctgaggagggtggatcacgaggtcaggagattgagagcatcctgaagaacacagtgaaaccccgtctctactaaaaatacataaaaattagccgggcatggtgacaggcacctgtaatcccagctacttgggaggctgaggcaggagaatggcgtgaacccgggaggcagagcttgcagtgaggtgagatcataccaccgcactccagcctgggcgacagagcgagactccatctcaaataaataaataaacaaacaaactacagaggcagtccaaatgagattgaataagggcctgagctagggtggtgatggtgatgttagaaagaatgggcagagttggagagctatttctgaagatgatgaagagagtgtaggagttcagggcgtaaagagtgattctcagtttcttgtaatagaagaaaaacttaagcacatttgaatcttgaaggattaatttgaacattcagtgattcatgaatcagggaggcaccaaaccgcaaggggctagcactctgccaggagagacaaaaggggaaacttttataaagtattttcagaaacgagataaataaaacaatttttattggctagatggaaaggtttttttgtttgttttttttgtttggtggggggggtgcggatacagggtatcttgctttgtcactcagactggagcagagttggagtgcagtgatgcagtcctagctcgctacagccttgaactcgtatgctcaggtgatcctcctgcctcaccctactgagtagctatgactacagttgtgcatcaccatgcctggttaattttttgtgtgtactttttgtagagagaggagcttgctttgttgccgaagctggtctggaactcctgggcttaagtgaccctcctgccttagcctcccaaaattttcggattacaggcacaagtggccatgctcagctagaaatttcctgcctgcctgcctgcctgcctgcctgcctccctccctcccttccttcttccctccctccctccctcctcttccccccgccagggtgtgactgtcatccaggttagagtgcagtggcgtgattatggctcactgcagcctcaaccccccagacccaagcgatctttccacctcagcctcccaagtaactaggaccacaggcatgtgtcaccatgtctggctagttttgttttggtttgggttttttgttttgttgttttttgtttttgtagagacagggtctccctatgttacccatgctagtcttaaactgggctcaagcagtcctccctcctcagcctcccaaagtgctgggattacaggcttaagccaccatgccaggaaagctcttaattagagattagtttgttaacactggcttgagtacttgagtgaatgatggtgccatttcctaagtcaggaaacactagagaaaagcagatttagagaggaagatgatgaattactgtaaggtgagtagaatgtcgtgaagacagatatttgaatcaggagctcagggaagtattctggtcaagagatacaaagtgaaaatcattggcataagtatagcaatttaaaccatgagcatgggtaagcaagcattgggggagaatgtaaagcaaaaagaaaaatgagcttaagcctagggaatctccaacatttgagcatcaggtagaggaagaggaggaaccaactattggaacacaatgagtccacaggtccagagaggaaggaactaagtcagggaatgcagtatctcagaagtcaagagaggacaaagtatcaagaagtaaggaacagtcagctatgtgggatgccattgatagagcaaacaaggtgactgaaaggtatccaccagatttgacaatgtagagatcactgagggccttagcaagaggagattctgtagggtggtagagctggaagtgctatattgtatggaggaatgtatgggtggtgaggaaatgataatagtgtcaacagttcttggaaaaatttggctggatgaccgggcgtggtggctcatgcttgtaatcccagcactgtgggaggccaaggcagacggatcacctgaggtcaggagttcaagaccagcctggccaacatggtgaaaccctgtctctattaaaaatacaaaaattagccgggcgtggtagcaggcgcctgtaatcccagcaattcgggaggctgagacagtagaatcgcctgaacctgggaggtggactttgcagtgagccgagatcacaccattgccctccagcttgggcaacaagagcgagactctgtctcaaaaaaaaaaaaaaatggctggatggaggaggcgagagaaaatggtgactggaaggaatgtggggtagagaaggtttgttttttgtttctttttaagttgggagactttaggggccaataaatagggaaaagtcaaagatgtaggatgtcaagaaacttgataggtcaggttttctgacaaagcaggagggcatgggatgcagaacacaagtaaagggattactaaccttagctcagacgagctgccactcttccgcagtaacagaagataaaagatctgtacatactgaatatgtttcatagtggcacgttggggtggttcacatttaatagcttttattttggcttagaagtaggaaagaggatatctgttgttaatagttttgaaaagttgcaaaatacatttgttttcatttaatggggattaaaatactctgtctagtattatagatgtcagaagtcatctattttctaccattattaagcaagggtttcttttttgtgaaaggtgcagttacctttagcagccaaggacgagtaaatccctttaaggtaaactcttccaagtgatgttttatattatttaaatacatttgtatacaaagaaatatttccaaatgatgagatgactctccccagacttggaggcatgaaagactgatctgtgtggaaacagaagaaagcagcacttgggctgagagttgtcttttctacttaccttctaagtacctatggttttgaaagatacctctgtctttcttggggatgtggtatttgggaatatacgtatcattcttaatttggattgtaccaaatgtatttagttctaaagatgagatggcaatacaaacttaacagaaatttcaagaaaaaataagtctcttgggattttatttttcttctttaaacatacagtgctaacactagtttgctctttaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggtactgtttcagctaccctcatctgcagtaagcagcatgggatctgtttgtcttcagttttgttcactgtttcagatataggataggaggttctgattgtttacaattgtcttgctagggaagtgggttcaattctgtttttgcagctaggcacagtggcacatacctgtagtcccagatactcaggaggctgaggtgggaggatcacttgagcccaggagtttgagtccagtctgggaaacataagagataccccatctgaaaaaaacaaaccccaaaacagttgtgttttttgtttcagaatcactccctattctgcctcgtgagttgttacacactttgtagcagattctgacttccaagatcactatcctgctccccctgtcttttttgagacagaggctcactctgtcacccaggctggatggagtgcagtgtcaggatctcagctcactgcagcctctgtctcctgggttcaagcaattctcatgcctcagcctcccgaggagttgggattacagaggcctgacatcacgcccagctaattttggtatttttagtagagatggggtttcagcatgatggccaggctggtctcaaactcctggcctcaagtgatccacccacctcagcctcccaaagtgctggtattacaggcatgagccaccgcacccagcctatcctgcccctctccttgtttttacagatcactttttaaaaatatatatactcagaccccagaagctcagacatttatctgtatttttattaaaatcacccagatagttctgatgtatattcgtatttaatagtggctgatattgtacatggccctaatttttccttgttctgagtcctgatttttccactctgataagtatttgatcccggattagtcattggtaaaatagatctattgcttatcttttctatttaatataattgtattcatttagaaaacatggaatttaggccagccgcggtggcaggtgcctgtaatcccagctacctgggagggtgagtcaggagaaccacttgaactcggagggtggaggttgcagtgagccgagatagcgccactgcactccagcctgggcaacagagtgagactccgtctcaaaaaaaaaaaaaaaaaaaaggaaaacatggaatctgaagtgtagttttttggttttgcatgtgtttgcctatttatttacaactgagaactccagatttcacatgttagtataagaattctcaataattatagatgtttcttcacatttttcagaacgtgcttataaaacatataaaattatactagatgttattgcagtattcatgtttgtttttataggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggtcagtacatagagaaatttagcatgcagtgaccaagtaaaaagtatacagtagcagcaatacaaaattatgcaatgctgttattccttaatacaaataatacattggcattggtagtgggcattctggacacttgtgactataaggaagccacaaatattaatgtctatttataatatttattaaaatatgctttaataaattgtatatttttaaattgtggatatattttattgggacattatattttgtaattaattttttgtttgtttttaaatagtttaatggggagaaatagcaaaagatacaaaaagaagagtgataataagtagtttcatccaactaatttctgtctccaaaaacaatcactgcaacaagtttcttgtggaactttccaaaattattctatttatgtgcaaatacatatttgtctattttttgttttacacattattctgtaccttacttttttaacttaacaatagcttttgtagcttattttatattactacataaagaacttctttatactggctgggcatggtggctcacgcctataatctcagcactttgggaagccgaagcaggcggatcatctgaggatgggagttcgagaccagcctgaccaacatggagaaaccctgtctctattaaaaatacaaaattagccaggcttggtggcacatgcctgtaatcccagcaaatcggaaggctgaggcaggagaatcacttgaacccgggacgcggagattgcagtcatctgagatcacaccgctgcactccagcctgggcaacaaaagcgaaactctgtctcaaaaaaaccaaaaaaacaaaaagaacttctttatactatagcaaggctatcagaaaaagtaaatacataaatggatggatagatagaaaaataagagctttaatctttgtgtatccattgaatagacatgtcatagttcatgtagttctctacttgtggacaaaagatggttaccggtcttttgctagtacagacagtactgcaatgaataattttatatgaatagcatttctcacagatgcatatatagctataagatggattcatgtatggttcaagttaatctgcacttataattccaatgccagattgttctgcattgatgttgtatcattttatacacctttagcaatatgagtattcctatttgctcatatcctctttgtccacaaacacagtatgttacctattttcttgatctctactatgctggatttctttgtatttatttattttttctgagacggagtttcgctcttgttgcccaggctggagtgcattggcacgatcttggctcactgcaacctccgcctcccaggttcaagcgattctcctgcctcagcctcctgagtagctgggattgcaggcatacgccaccatgcctggctaattttatatcttttttttttttttaaatacttttaagctctagggtacatgtgcacaacattcaggtttgttacatatgtacacatgtgccatgttggtgtgctgtgctcatcatttacattaggtatatctcctaatgctatccctccctacttcccccaccccacaacaggcccaagtgtgtgatgttccccttcctgtgtccaagcgttctcattgttcagttctcacctatgagtgagaacatgcggtgtttggttttttgtccttgagatagtttgctgagaatgatggttcccagtttcatccatgtccctacaaaggacatgaattcatccttttttatggctgtatagtattccatggtgtatatgtgccacattttcttaatctagtctatcattgatgaacatttaggttggttccaagtctttgctattgtgaatagtgccacaataaacatacgtgtgcatgtgtttttatagcagcatgatttataatcctttgggtatatacccagtaatgggattgctgggtcaaatggtatttctagttctagatccttgaggaatcgccacaccgccttccacaatggttgaactagtttacagtcccaccaacagtgtaaaagtgttcctatttctccacatcctctccagcacctgttgtttcctgacattttaatgattgccattctaactggtgtgagatggtttctcactgtggttttgatttgcatttctctgatggccagtgatgatgagcattttttcatgtgtctgttggctgcataaatgtcttcttttgagaagtgtctgctcatatccttcgcccactttttgattgggtttgtttttttcttgtaaatttgtttgagttctttgtagattctggatattagccctttgtcagatgggtagattgcaaaattttttcccgttctgtaggttgcctgttcactctgatggtagtttcttttgctgtgcagaagctctttagtttaattagatcccatctgtcaattttggcttttgttgccattgcttttggtgttttagacatgaagtccttgcacattcctatatcctgaatggtattgcctaggttttcttctggggtttttatggttttagatctaacatttaagtctttaatccatctggaattaatttttgtataagatgtgaggaatggatccagtttcagctttctacatatggctaggcagttttcccagcaccatttattaaatagggaatcctttccccatttcttgtttttgtcatgtttgtcaaagatcagatggttgtagatgtgtggtattatttctgagggctctgttctgttccattggtctgtatctctgttttggtaccagtactgtgctgttttgtatagtttgaagtcaggtagcgtgatgcctccagctttgttcctttggcttatgagtgacttggcaatgcgggctcttttttggttccatatgaactttaaagtagttttttccaattctgtgaagaaagtcattgatagcttgatggggatggcattgaatctataaattgccttggacaggatggccgttttcacgatagtgattcttcctatccatgagcgtggaatgttcttccgtttgtttgtgtcctcttttatttcattgagcagtggtttgtagttctctttgaagaggtccttcacatcccttgtaagttggattcctaggtattttattctctttgaagcaattgtgaatgggagttcactcatgatttggctctctgtttgtctgttattggtgtataagaatgcttgcgatttttgcacattgattttgtatcctgagactttgctgaagttccctatcagcttaaggagattttgggctgagacgacggggttttctaaatatacaatcatgtcatctgcaaacaggtacaatttgacttcctcttttcctaattgaataccctttatttctttctcctgcctgattgccctggccagaacttccaacactatgttgaacagaagtggtgagagagggcatccctgtcttgtgccagttttcaaagggaatgcttccagtttttgcccattcagtatgatattggctgtgggtttgtcataaatagctcttattattttgagatacatcccatcaatacctaatttattgagagttttttagcatgaagcgttgttgaattttgtcacaggccttttctgcatctattgagataaccatgtggttttagtctttggttctgtttatatgctggattacgtttatttatttgcgaatgttgaactagccttgcatcccagagatgaagcccacttgataagttttttgaagtgctgctggatttggtttgccagtattttactgaggatttttgcatcgatgttcatcagggatattggtctaaaattctctttttttgttgtgtgtctgccaggctttggtatcaggatgatgctggcctcataaaatgagttagggaggattccctctttttctattgattggaatagtttcagaaggaatggtaacagctcctccttgtacctctggtagaatttggctgtgaatccatctggtcctggactttttatttggttggtaggctattaattattgcctcaatttcagagcctgttattggtctattcagagattgaacttcttcctcgtttagtcttgggagggtgtgtgtgtccaggaatttatccatgtcttctagattttctagtttatttgcatagaggtgtttatagtattctttgatggtagtttgtatttctgtgggatcagtggtgatatcccctttatcattttttattgcatctatttgattcttctctcttttcttctttattagtcttgctagcggtctatcagttttattgatcttttcaaaaaaccagctcctggattcattgattttttgaaggcttttttgtgtctctatctccttcagttctgctctgatctcagttatttcttgccttctgctagcttttgaatatgtttgctcttgcttctctagttcttttaattgtgatgttagggtgtcaattttagatattttctgctttctcttgtgggcatttagtgctataaatttccctctacacactgctttaaatgtgtcccagagattctggtatgctgtgtctttgttctcgttggtttcaaagaacatctttatttctgccttcatttcgttatgtacccagtagtcattcaggagcaggttgttcagtttccatgtggttgagcagttttgggtgagtttcctaatgctgagttctagtttgattgcactgtggtctgagagacagtttgttataatttctgttcttttacatttgctgaggagtgctttacttccaactatgtggtcagtgttggaataagtgcgatgtggtgctcagaagaatgtatattctgttgatttggggtggagagttccgtagatgtctattaggtctgcttggtgcagagctgagttcaattcctggatatccttgttaactttgtctcgttgatctgtctaatgttgacagtggggtgttaaagtctcccattattattgcgtgggagtctaagtctctttgtaggtctctaaggacttggtttatgaatctgggtgctcctgtattgggtgcatatatatttaggatagttagctcttcttgttgaattgaattgatccctttaccattatgtaatggccttctttgtctcttttgatctttgttggtttaaagtctgttttatcagagactaggattgcaacccctgccttttgttgttttccatttgcttggtagatcttcctccatccctttattttgagcttatgtgtgtctctgcacatgacatgggtctcctgaatacagcacactgatgggtcttgactctttatccaatttgccattctgtgtcttttaattggagcatttagcccatttacatttaaggttaatattgttatgtgtgaatttgatcctgtcattatgatgttagctggttactttgctcattaattgatgcagtttcttcctagccttgatggtctttacaatttggcatgttttttcagtggctggtaccggttgttcctttccatgtttagtgcttctttcaggagctcttgtagggcaggcgtggtggtgacaaaatctctcagcatttgcttgtctgtaaaggattttatttctccttcacttatgaagcttagtttggctggatatgaaattctgagttgaaaattcttttctttaagaatgttgaatattggcccccactctcttctggctcatagagtttctgccgagagatcagctgttagtctgatgggcttccctttgtgggtaacctaacctttctctctgaacattttttctttcatttcaactttggtgaatctgacaattatgtgtcttggagttgctcttctcgaggagtatctttgtggcattctctgtatttcctgaatttgaatgttggcctgccttgctaggttggggaagttctcctggatagtatcctgcagagtgttttccaacttggttccattctccctgtcactttcaggtacaccaaacaaacgtagatttggtcttttcacatagtcccatatttcttggaggctttgtttgtttctttttactcttttttctctaaacttttcttctcgcttcatttcattcatttgatctttgatcactgataccctttcttccagttgattgaattggctactgaggcttgtgcattcgtcacgtagttctcgtgccatggttttcagctccatcaggtcatttgaggagttctctacactggttattctagttagccattcgtctaatcttttttcaaggtttttagctcctttgcgatgcgttcgaacttcctcctttagctcggagaggtttgatcgtctgaagccttcttctctcaactcgtcaaagtcattctccgtccagctttgttccgttgctggtgaggagctgcgttcctttggggggggagaggtgctctgatttttagaattttcagcttttttgctctgttttttccccaatctttatggtttcatctatctttggtctttgatgatggtgacgtacacatggggttttggtatggatgtcctttttgtttgttagttttccttctaacagtcaggaccctcagctgcaggtctgttggagtttgctggaggcccactccagactctgcctgggtatcagcagcggaggctgcagaacagcaaatattggtgaacagcaaatgttgctgcctggtcattcctctggaagcctcgtctcagaggggtacccggccgtgtgaggtgtcagtctgcccctactggggggtgcctcccagttaggctacttgtggatcatggacccacctgtcactgaggaggcagtctgtccattctcagatctcaaactctgtgctgggagaaccactactctcttcaaagctgtcagacagggacatttaaatctgtagaggtttctgctgcctttgttcggctatgccctgcccccagaggtggagtccacagaggcaggcaggactccttgagcttcagtgggctccacccagttcgagtttcctggctgaggctgccgccttgtagttcaatctcagactgctgtgctagcaatgagtgaggctccatgggcatgggaccctctgagccaggagtgggatataatctcctggtgtgccgtttgctaagaccattggaaaagcacagtattagggtgggggtgacccaattttccaggtgctgtgtgtcacagctttgcttggctaggaaagggaattttctgaccccttgcgcttcccgggtgaggtgatgccttgccctgcttcagctcacactcggtgtgccacaccccctgttctgcgcccactgtccgacaagccctagtgagatgaacctggtacctcagttggaagtgcagaaatcacccgtcttctgcatcgctcatgctgggagctgtaggctgaagctcttcctattcgaccatcttggaaccgcttaattttgtatctttagtagagacgaggtttctccatgttggtcaggctggtctcaaactcctgacctcaggtgatctgcccaccttggcctcccaaagtgctggaattacaggtgtgagccaccactcctggccttatttttaatatatccgttaaatttgaaaagtcacaattttggcctggcacagtggctcacgcctgtaatcccagcactttgggaggctgaggtgggcggatcacttgaggtcaagagttcgagaccagcctggccaacatggtgaaaccccatctctattaaaaatacaaaagtttgccaggtatggtggctcatgcctgtaatcccagctacttgggaggctgaggcaggagaatcgcttgaacacaggagacggaggctgcaatgagccaagattgtgccactgcactccagcctgggcaacagagtgagactccatctcagaaaaaacaaaaagaaaagaacagtcacaatttcatttttaccataatatatctcatttttctcatgctgaacagtccagggagaaaaataataataaagtatatcttattttcttaatgactttatgttaaccagtttgagggagtggctgtggttttcacatttcctgttttgttctgaatttaatttaggtcttaaacagtgaaaattttatttaagaaaattgataggccgggcatagtggctcatggttttttttccgcttaacacttttttctttttgctcttgttgcccagactgcaatgcaatggcacaatctcggctcactgcaacctctgcctctgggttcaagtgattctcctgtctcagcctcctgagtagctgtgattacaggcatgcgcaaccatgcccgactaattttgtatttttagtagagatgaggtttctccatgttggtcaggctggtcttgaactcctgacctcaggtgatccacccgccttggcctcccaaagtgcagggattacaggtgtgagccaccatgcctggcccgcctaacactttttttgagacagtcttgccctgtcaccaaggctggagtccactggtgcaatctcagctcactgcaacctccaccttctgggttcaagcaattctcatgcctcagcctcctgagtagctgggattacaggtgtgtgccaccatgcccactaattttgttattttttggtagagatggagtttgccacgttggccaggctggtctcaaactcttggcctcaagcgatttgcccatctcggcttcccaaagtgctggggttacaggtgtgagccaccacacctggccaagcctaacactttggaaggccaacatgatcagttagcttcagcccaggagattggaaccagcctgggcaatgtagggagaccccatctctaccaaaagttttaaaatcagccaggtgtgtgtggtggcacatgcctgtagtcccaactgcttgagagtctgaggcaggaggattgcttgagcccaggaatttgaggtggcagtgagctgattataccactgcactccagcctgggcgacaaagcaagaccctttctcttaaaacaacaacaaagaagattgataatttaatttttcatactatcagttggttatacaaaaaacttacttttgaaattttaaggaattaccactattgaaactaatattttgtcacagatgttgatatacttaatcagaaatgtccagttttagccaggtggctgtgcactcttgtagtcctagccactcagaaggttgagtcagaagggttgcttaagcccagaagtttgaggccagcctaggcaacatagtgagactcacgtctctttaaaaaacaaagaaagaaatgttcaattttggttttctttttaaaaatagctgtttagaagtagatgattgcaggccactaagtagacttgtgacattgccccaagtttcattaaaatgggtcttcattaatttttggaaattcaggaacctttgttataccttgatttttacttgttttgatttgttctgttatttttctggaaatcggtttacgttaagattacttaaaatttgcatattttcagaaattgggcaaatggttatggtcatactagtaattttttaataaaaatttttttaaccttaaaaagtttagactttttatttaggattcatttaggttcagcctagtgaggggcgtatagctgctgggttaaacataagagactctgggccaggcacagtggctcacgcctgtaatcccagcactttgggaggccgaggcgagtggatcatgaggtcaggagttcgagacccacctggccaatatggtgaaaccctgtctttactaaaaatacaaaaattagctgggtgtggtggcgcgtacctgtagtcccagctgtttgggaggctgaggcaggagaatcacttgaacctggaaggtggaggttgcagtaagccaatacagagccactgtactccagcataggggaaagagctagactccatctctacaaaaaaacatagactttggagtcaaattgcctggttgttggatcccaggtctgagttttactgtttgtgtaacctgggataggttatttcacatctctgagcctcccttttctcacttatggaatggagataataactgtatccatctcatagtgttattgtcatttaaatgaggtactatacataaagcttttagagtagtgcctggtagatagtaagtgatcagtaaatgttaaatatttgcattaaaccttcacttgtgtgacttaaagacaatttgtattgtgagtggaatctaatgaaatgtacaaatgtgctgtgtccgtgcttcacctaatgctgatgcaggtcagctctgagagcaagggtgaggcgatggcaaaggggcttgagaaaagtcgtgaggaattcaaatagctggtttggggaaatagaaaaagagcctaccaaggacatgtggtaggccacaagggctaagtgaggttggagaccttgagcctgtcaacattcattaaaaagttgaaagtacagagttcatggttgctgcacttggaaaatacaaacgtgagtgatccttttgaattgaccttacaaaggattttccagttcattgatcctgcagtctccaggcagtttaaagtaatatgaggccaggcacggtggcttatgcctgtaatcccagcagtttgggaagccgaggcgggcagatcacgtgaggtcaggagtttgagaccagcctgaccaacatggtgaaaccccatgcaaaaaattagccaggtgtggtggcgcatgcctgtaatcccagctacttgggaggctgaggcaggagaatcgcttgaacccaggaggcggaggttgcagtgagctgagatcgcgccattgcactccaggctgggtgacagagtgagactctgtctcaaaaaaaaaaaaaaaaaaaaagtaacatgaattaacaagtgtaactgtgtcttccttactttatataatagatgtcagagacttatggttgattactaacttaaaatcatgaggcactttaaactctgtcttaagtataaaatgttttcacataattgtgattttaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtaaggataattgtgccgagattgagatcttagtgaattcccagatttaaaaaattcttatagaaatgccttttggctgggtatggtgtcttatgcctgtaatcctagcacattgggaggtcgaggcggatcacttgagctcaggagttcgtgaccagcctgggcaacatagtgagacatcgtctctaataataataataacaacaacaaagataataacgatcatgacaactaaaaaaaaaaggaaaagcctttttctgtttttggaaattgaatacatccaccaaactttttaaagaggaaagtaagtgcggatatatggtaatatggatatgtagtaattattatgtaatggtgatgggttttttgttttgtttttgtttgaggcaggtcttgttctttcacccaggcaggagtgtcgtggtgtgatcatggctcactgccacctcgacctcctgggcacaagcaattgtcctcttttttttttttatagagacaacctctcactgtgttgcccaggctggatggttaattttttgacggtttactgttttaatctctataagttcctgtatgttttaagttaggagaataccccaagaaaagatgcatttgttaaaaatcaaaagtgtcaagctgagttcgttggctcaagcctgtaatcctagcactttgggaggccaaggcaggaggatctcttgagcccaggagtttgagaccagcctagacaacatagtgatacaccatctctacaaaaatttaaaaattagcctggcatggtggcacacacctgtagtcccagttactcaggaggttgaggtgggaagatcacttacttgagcccaggaggtcaaggctgcagtgagccgtgattgtgtcactgtactccagcatgggtgacagagtgagaccgggtctctagggggaaaaaaattaataagtaaaaatgaattcacattttttgaatactactttagggttcttgcaagcagaatttttaaaaattgtatctacttacacattaaatactacatgagactattccttttgggaaaaagactggtgttctgttccagcctttcacatggaaattaggacaggtggctggcttgcttctgataaacttctgccatgtgaaggaaggaaggcacaatctctcagttagaagtggaaggaatgtgtgtggtgtaccagttaaatcctcaggtttcacttccccaggaatggcagggcgcagcacaggcacctagtaacgtagatacttgctttggtaaattgggttttatgaaaaaggtgttgcataatgaggaagccagaaactggtttaaacacctttagcgtcatttagaacctcatttacaattttatgtttctcatttgttgttcaataaaatggcgtctaaataaataagactttacactgcaaaagaggaagagacttggcaaagtctgtgattgtgtttttgaatacttaaaaatgtaatcagtatttttaaggtaaaccctaaacatttacttaaatccagtttgttaatgtgagaaattctacagcttgaagagcccttgaaatggccagggaaataaagtaggagtggggaactattatagattaaaagagattttagagacagatgaaatgaatggaccttgtctggctcttgctgagtgaataaaaaccaaaccccaaagaatatatactcatttatataacattcctgaaatgacaacatgatcaagatggagaatagagtagtggttgccaggggttggagtcggagttggggcttggggaagaggttctgtattttgactgtggtggtaaacaaaccaacccacaataaaagtaaatacatacatacgctcaaatgagtagaagtaaaatgggattgtttcaatgtcagttccctatagttgtgattgttgggctatagttttgcaaaatgttaccactggggaaaactgggtgaaggctacacaggatctttctgtattatttcatacaactgcatgtgaaactgcaattatcttagaataaaaagtttcatttttattatttatttatttatttatttatttattttttgagacggagtcttgctctcgcccaggctggagtgcagtggcgtgatctcagctcactgcaggctccacctcccgggttcactctagtctcctgcctcagcctcccaagtagctgggactacaggcgcccgctaccatgcccggctaatttttttgtatttttagtagagacggggtttcactgtgttagccaggatggtctcagtctcctgaccccgtgatccacccacctcggcctcccaaagtgctgggattacagacatgagccaccgtgcctggccaaaagtttcatttttaaatagtactgcaattatagtattttgcaactaatatgattaatataagcaaagcttagattgagatataaaagtagtgtaaatctttaatgtgctctgcatttaagtaataaaagatttgttaacaatgagaacacttaattcaagtgctaattattctgctttatatataaaaatattacctggaaaagtaaataaatcatttacttcttatttgttattttctaaaaatctttccttttcactcctgccattttacaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcattaataccttctaggggtttggttcatttggtttttgtcatgtgcaaggaaggacaatagtcctctttccaagtgtgttagcatagacttctctatatgtttctactagacctaggggatgacgtcttttaataatactggccctaaacatgtaaataatcttgtaggtgagactttttcttttgtgtttcggaaatttcctatgtggctttcagttgtctgtttgtatagcctggatttttttgaggtaaatgaaactttctcatttgt

SEQ ID NO: 8040 - DNA, 54877 bp, Homo sapiens
gatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttggtaagaatttgactttgtgcatgtgattaccctgttgattaatattttagattttttattaacactattaaagtcattattgaatttgtagaatgtagctaagtggtgcttagaggaaattttatagcattaaatgactttgttaaaaaaggtttcaaatctataatccaagcttctgctatggcagactagaaaaagagaaaactaaaccccaagcaaatggaaggaaataatacagagcaaaattcaataaaattgacaacagaaaacctatagagaaagtcaatgagaccaaaagctggttctttgacaagatcaataaggccgggcacggtggctcacgtctataatcccagcactttgggaggctgaaatgggcagatcacttgaggtcaggagttcaagaccagcctggccaacatggtaaaaccctgtctctacaaaaatacaaaaattagctgggtgtggtggcacgtgcctgtaatcccagctactcaggagactgaggcaggaaactcacttgaacccaggaggtggaggttgcagtgagccgagatcgcgtcaactgcatgccagcatgggcaacagagcaagactccatctccaaagaaaagaaaagatcaataaaattaataaatatctatcgtggttgatcaataaagagaagacacaaattactaacatagagaatgaaagagaggtgggccatcactatagatctgtagatttgtgctatccaatatatagtagccactagccacatgtagctgttgagcacttgaaatgtggttagttcaaactgagatatgttatgagtgcaaccggattttttttttttttttgaggcggagtctcactctgtcacccaggctggagtgcggtggtgtgattttggctcactgcaacctccgcctcctggattcaagtgattcttgtgcctcagcctcctgagtagctgggattacaggcatgcgccaccacgcctggctaatttttgtatttttagtagagatggggtttcaccatggagtgcaaccagattttgaagacaatatgaaaaaaagaatgtaaaaatcttgggaaattttttatattgagtacatgttgaaatgataatatgtattttaaatgcactatattattaagattatggctgtttctttttactctttaaactttagaaatattagaaaatttaaaattacagctgtaactcacattatatgtctgtatggcagtgctactattaatatcaaaggcataatggcaatattatgaataactttgtgcccataaatttaacaacttaaatgaaatagacgaattttctgaaagacacaaagtaccactgctaactcaagaagtaatagataacctgaatagtattgtatctattaaagaaattgagattgtaatttaaaatcttcaaatagagtgcttattgtaacaacttacatgctacaataacacttgaacattatcaagtaaaatgaagaaattgagattgtaattgaaaatcttcaaatagagtgcttattgtaacaacttacatgctacaataacacttgaacattatcaagtaaaatgccaatgtgcagtgctatgttgtgctttttaaagtcatatagagtttatagaacagcagtcctcaaatgttttggtctcagtagcctttatactctaaaaaattttgaggacccttccgagagcatttatttatacagagttacggctatcgtcatttacatattagaaattaaaattcagaaatttaaaaatatttattcacttaaaaataacattaataaactcatgtaaacatgaatagtacttttttatgaaaaacaaaaaaaattagtgagaagagtggcattgcaatctttgtaatgtctatcatagaggatagctggattctctcatctacttttctggattaagtctattgctatacattgtttttgtttgaagtgtataaagaaaatttggcctcacataaatatgtaatttgaaaagggagaagtattttaagaaatcttttaatagcacattcaattaattgtggatattctttgatgttgcaccaagactcagaagatgatcgtttcctaaagattacttgcaaagtgtaatctgaaaacttcagtgaactcttacggctctgttatgttaagattcattggtctggctgggaatggtggctctcacctgtaatcccagcactttgggaggcccaggcaggaggattgcttgaggccaggagttcaagaccagccagggcaacatagtgagacctcctctctacaaaaaaactttaaaaattagccaggtgtggtgacgtgtgcctgtaatcccacctacttgggaggctgaggtaggaggatctcttgagcccgagaggtcgaggctgcagtgagccatgattgcaacagtgggctccaggcagggtaacagaacgagaccctgtctcagaaaaaaacaaaataaaatcaaaaaattcattggtctgacttgaatgttgaatggattttttaaaatcatgtttaattttgtaacatatgaattgataatattggttcactgaagtttatagatcctctttatactgacactttttattatctaatataaattatttgtttttgtttttaattaattatatgttgtttttaattaattaatttttgtttttagagatagcatcttgctctgtcacctaggctggagtgcagtggtatcatcacacctcactgtaaccttgaactcctgggcttaagcagttctcccactcagccttccgggtagctaggactacagatgcatgccaccatgcccatctaattttttattttttgtagagatggaatcttgctttgttgcccaggctggtcttgaaatcctggcctcaagtgatattccctccccagcctcccaaagtgctgcaattacaagcgtgagtcacagcacctggctgtaaattatatctgctagtgttgttaccaatctcatcagtagtttctaagtattagaaagttgtgaagctcataatggcaaatagaagctttccaatatcttaatttttaattgaaagctcaaatttcttgtttttattttttgagagggagtcttgctctgtcacccagcctagagtgcagtggcacgatctcggttcactgcaacctctgccctctgggtacaagtgattctcctgcctcagcctcctgagtagctgggattataggtgcccgccaccatgccaggctaatttttgtattttagtagagacggggtttcactatgtaggtcaatctggtctcggactcctgacctcaaatgatctacccaccttggcctcccaaagtgctgggattacaggcctgagccactgtgcccagctcttttttttttgagacggagtctcccgggttcaagcgattctcctgtctcagcctcccgagtagatgggattacaggcatgtgccaccatgcctggctaatttttgtattttcagtagagacagggtttcaccatgttggccaggctggtcaacgtggaactcccgaccttaagtgatctgcctgcctcggccttgcaaagtgctgggattacaggtgtgagccaccgtgcctggcctgaaagctcaaatgttatcattggcaacaaattctgccagttattttttcttaattgataggctcacttcattcatttacaagaaaatgtttgccaaagatccaattctgcataaccgtagtttatctggcatgtgttttttaagtaaaagtagtgttgtatgaaaaaaaatcacttagttcagcttacaactcaaacaattgcataagtgctttttttcaagacaaccatcacacttctcattttagcacacagaactttaaaaaaaaaatctgtgtaagcgtcaagatttaataaaattaatatttttactgcaagtgagtagtggttaacaatgcagtaacgactaatacagttaggtgccactgccttgattggtgccaaggcaccaggaattttacccaccattgcttttgcaccatcactgcatctctttaacacagtgaaagaggcaaatagcatgtcagtgtcattgaatatgaatgaaaaagttactagattccataatgctttcctttttccaaatcattggtattcgtgattcccttaattatgatcctttgtgttgtagatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtaagacttggatctacacttaacttcttagtaggttttcagcacttttttcttactatagttaatttttttggataaaacatatttttaaaaactttgattaagtagcctggagcactttggttgattacagttttgtggttggtttattttatggttagctcacagttttaatcttgtttcaaccttattgaaaatgatgttaaataaaattctgctttccaaaatgacattaaatgaacataagtaaatattactatcttgcaatatttcttggcaatactttcaaaccttattcttcatggtcattgttacatagaagattatactgactccaaaacactagtaaggaggtgctttcttagaaggcaactactagtataatatattagaaggtggcaagtactatggggggaaaagtctgacccttttcctcactccaccacccaccagaatgtaagctacacgaggataaagatttttgttttgtttactgatatgttcttaggatttggaacaaggtatgatacagtgcacattaaatatatatttcatgaatagacaaaatgaatatattggctttttgccttagatttgagttctttttttttttttttgagatggagtctcgctctgttgcccaggctggagtgcagtggcacaatctctgctcactgcaagctccgcctcccaggttcacgccattctcctgcctcagcctcccgagtagctgggactacaggtgcctgccaccatgcccagctaatttttgtatttttagtagagatgggatttcaccatgttagacaggatggtctcgatctcctgacctcgtgatccgcctgcctaggcctcccaaagtgctgggattacaggcgtgagccaccgcgcctggcctgagttcttaaaaagtttagtttttctgtgttggttatatgatgttttccattctgaggattttgcctttttaaaagtataggcctggcataaatttgaagagtataggcctggcataaatttttatgtaaagattaagggtggtgattaatattaataaaactttttattgctatcagtagtcatcaagtcataggtcttaatttttttattagtgtcaatattttatttatagttatgttaaataaaatattggcactaattttattagaaactctagggcctagtgtgagcctataatggacatcagtggaagataagttttccaagtggtatcaatttatgttgcctctgccgggcgtgatggctcacgcctataatcccagcactttgggaggccaaggtgggttggtcacttgaggataggagttggagaccagcctggccaacatggtgaaacaccctatctctactaaaaaaatacagaaattagctggacctggtggcatgcacctgtaaccacagctacacaggaggctgagggaggagaatcacttgaatccaggaggcagaggttgcggtgagccgagatcatgccactgcactccagcttgggtgacagagcaaaactgtctccaaaaaaaaaaaaaaattatgttttcttaaaatgtatgtatttattttatcatagaatagttaggaaaaaagtctgttgttatttgcatccatatttgtaagaaaactcaatttttgaaatatttcttttgaggaatttaatggtttggttgttcaaaggacaactgtaatgtgcttttaaagtaacagtcatgtaatttatttttaaatattattaaatactctatttgctaattaataagtatatatgtatcttattctcaccaaggaaataataagtaattgtagctctggtattatgactcctgtcagaaactatttagagatagatgagatgtagtaactcccaaaacctaaatcttaatacaaatttaattataatatttgttaatttgtactactgtggcttactgattctaggagcttcagtttttctcagacttatatttaatcttacctgtttgtaggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaaggtaaactcaagattattaggaagaatttggcactgttgaactgttagatacagttgttgaaattaaagacaaaaagttaataaaacaaaatttattttttgtaatatgaaatttcagaagagtttggtacaaacaccagcacacccaaaatacctcagaacatatgtctgtttttgccataatgattccctcattacatgctctaactacatagcaaaatgacatggcatagttagtaatgcaagagatgggattttttttttacattgttaagtgcttttttttttttttactattataagagtaatatacattcattgtaaagaaaaaaaaccagtatacagtatagaagtttcggaaaatgaaaactcctcccagaattctactctcagatataactgctatttacaatttgatatgtatccttccagatttctttctatttgaacctcccttattttaatttactttattgagatgtaatttatttacaataaaatgcacccatttgatgagttgacaaaggtgtatatacacagataacccctaccacaatcaaaatacagaatgttctttatcacccgaaaatgttttcttatatccctttgcagttagttcaaccctagccttggccaactattagtctagatttttgtcactacgtctttatcacccaagaatgttttcttatatccctttgcagttaattcaacctgagccttggccaactattaatctacatttttgtcatgatggattaaatttaaaatctctcttcgagaaaggaaaaaaaaacggaaaaacaaaccaaaaaatgtactagtcacccgtttgctttttctacttaatattttttggatgtttacatgttttgataagtaggtaggtaagtaaataggtagatagatgtcaagaaaaaaattatgatgggaaagcaatgggtgcagaatgtttttcttttcaaaagaaaagaaaatattttttcagctttttgttaatcaagagattgccctctcttgatcccttcttcagctgattatagtactgatacacttcatggattttactatcttctatgtgatttgaaatttgtatccttcaggctgggcatggtggctcacgcctgtaatcccggcactttgggaggccaaggcggacagatgacctgagctcaagagtttgagaccagcctgaccaacatggtgaaactgcatctctactaaaaatgcaaaaattaaccaggtgcagtggcacccacctgtagtcccagctactcgggaggctgaggcaagagacaggagaattgcttgaacctgggaggcggaggttgcagtgagcagagatcacaccactgtactccagcctgggtgacagagcaaaactccatttcaaaaaaaaagaatttgtatttaataataacttacatatatgtatgtgcaaagaaaaaaggctggaaagatatcaatatagttcattttaagggtatttcataattacttttttaaagcaacttcttatactagtgtataataggaagtaaactatttggtttttttgttgaatatcatgattgcttatatatatatatatgtaaatatcatatgaaagtttgattgtttctgtcttgttttaatttttagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtagatttttttcagtcttttatgacttgaagtaaaatggaaattacttgagcttttttgctgtttttgttactctttttgtcttggattatatacttccttttgaatccgtgtaatctttaaatgtagataattttgttgtgttcactagcagcaatgaaaatgaaaatgtttcttaatagaactatattatagagagaattccaaggtggaatttggttaattacttccatgtctaaatcttaccattttggcaagcacgaccagagaactttcagcgttgaaattccacaaaaataactcctagtaggaagggccaaaacaactctgaatgtgacactttttaaaagctgctgcctcctttttcctcccctcatgtctttcttcagtccccgtcactatgctaagactggtcttatcaaggtaaccgataatctctgtgcttttttaaaaaaataattccattgaaaataccttcttctcatgacttctgtgacatcatactttcaatatttttcctcactggcagctccctttttacttttttgttggctctatcttttagctggagtgtatcccctttttctctactactctctaggtcagggtctttcagtctttttgtctgctttgccacagtaagaaatagattcatagattctggaccaggtatggtgtggtgtggtgtggtggctcacacctgtaatctcagcactttgggaggccgaggcgggagagttgctttagcccaggagttcaatacaagtctggatagcaatagcaagcccctgtttctatttttaaaagaaaaacagaagaaaagaaatatattctatataactgttctataaatatctgcaaatgtaactgaaataaaagtctcctggacaatgtttactcttttgatatcagtttaaatttttttatttcattttttaaaatgctagttgcaaattaaaattgattccatgactcttaggtcaaaatatgcagtttgagaaaccaccctggggaattttatcataatccatggctttaaatacatctcagtgtctatgacttttaagttgatagcaccaaccctaccctctccttgtgtctccagacttacacatccagttgcctacttgaaatctatttagagtttggacagacatttcagacttaatttgctcacaataaaaactgatttttttccttccaagcttgcttcttatgtagtttccccatcttagtaaatggcttactaacaatctagtggctgaagccaaaaatctaaaaattatcctcgattcttctctttccatttcccctgcatcaactccaacagtaaaattatatcatcatgtcaattctatggaataacacattctaaatttgtctcttttcatttcttctgctaatacaacctggatgtcatctcttggactgtcatagtagcctcctaactagtcttttagcttcagttcttgccttccacagtccattctccacagagcagcctaggtgatcttttaaaaatatagatcatgctcctcttctcaaatccctctgactttccttcacttttagaatcaaagtcaaacttctgatagctgtcaaggtgatctactgatcccgtataatctgacctttgcctgcctctccaacctcatctcttaccgttgtttctcattaccatgttctggccatactgcctctttgtgttcttcgagccctccattcttcctaccttaggactttgcattagctgttccctccatccacttccgtgttccttcccctaatgtttgcatggcaggctccagcttgcagttcatgtctcagcttaaactttactttctgagaggtcacttctgactaaccagtctaacaaaccactctgacattctgtatcacattattttaactttgtgataatttttttgttctttttgtgttttttaatttgtcttctacctgaaatttgaatttaataagagtggtgactttgtttattgctgtagccccagtatctaggccaatgctggcgtgtagtaagctctctgtaaatatgtcttgagtgaataaatgcccacttataaggactttatgtgaagagtccatgtaacatcttactgtgtttctaatacctgaatgatgcctcagttggatgggttattcataaaaagtagtgctagtcagtctagtaatttaccacaaaatcaattcacagaaaataatttagactgcgttatagttggataacctttgatgcctgatttatatttacattttctcattaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggcaagataaatttgtttaaaaaaaacaagtataatataaagtgttagatattcttcaagaagaaaattatttcattgttttattcctaattaatttaagaataaattatctctattttatattttaaatttctattttaatatgttggcagaactgggagctgcaatctttaggcaaggtagccattgttttatgtataagatcttgtttttatttttatgttcttttaagacagggtctggctctgttgtccaggctggagtgcagtggcatgatctcggctcactgcaacctccacctcctgggcttaagccatcttcctacctcagcctccttagtagctgggactacaggcatgtgccaccatgcctagctaatttttgtattttttgtagagacagggttttgccatgttgcccaggctggtctcaaactcctaggcgcaagtgatccacccaccttggcctcctaaagtgctgggattacaggcgcgagccactgcacccggctaagagctctcttcatgagaattctcattagaaaacttataaagaaggaaatatatttttctgaaagtattaaatagcaaggaggtgatacaaatcaataataagttgtgtcttttccagcagatcatacagaaaacttagaattttctagagcttcactgtttactacaataactagtatgtgtgtctgttgagcacttgaaatatggctgagatgtgcttgtatgtgtaaaatactctggattttgaagacttagcatgaaaaaagatataaaaatcaatttttttatgttgattacatgttaaatgataatatttgagatatcttcgatgaaataaaatgtattattaacattaacttcatcctttttttctttaaaaataattttttttttggctgggcatggtggctcatgcctataatcccagcactctgggaggccgaggcaggaggatcacttgagcccaggagttcaagaccagagtgggcaacatagtgagatcccatctctatttaaaatttttttttttttaaggaataaattaggagtcttgctctgttgcccaggctggagtgcaatgatgcgatctcagcttactgcaacctctgccttccgggttccagcaattctcctgcttcagccttctgagtagctgggattacaggcttgcgtcaccacactcggctaatttttgtatttttaatagagacagggttttaccatgctggccaggctggtcttgaactcctgacctcatgtgatccacccgcctcgacctcctgaagtgctgggattacaggcgtgagccaccgcccccagcctaaattttttcacttaacttttttttgttgttcagatacatggtatgtagccattttttttttaatgtggcactaggaaattaaaaattacacttgtggctcacatgatatttcttttggataagtgctattttagaccaaattctagaggcttatgacagatgatttgaaagacactgaggagtaccttattttattttatttgtttttgtgtttgtggtttttttgacgcagagtctcactctgtcacccaggctggactgcagtgatgtgacctcagatcactacaacctctgtcttctgggttcaagtgattctcgtacctcagcctcccgagtatctgggactacaggcacataccaccacgcctggctaatgttgtatttttagtagagatggggttttgtcatgttggctaggctggttttgaactcctggcatcaggtgatccacctgcctcagcctctcaaagtgctgggattacaggagtgagccactgcacctggcccaggagtaccttattttaaatcacctgtcatctctgtctcatggggacttaaatatttctctttttggagattcatgttcttcatttacattgctggaaactccactttgtctttaaaatatcaaccatttctaaatgtgttttctattagtcattcaggctttaataatatgaaccattgataacttccatttgtatagatttttttctccgaagtaccaattagatccagaccctgcggaaactaatgtttgcagagtgaggggggtgtgaagccacagataagaaaagggataatcaggtaatttgccacagatttcctgagttggaagcagaataggtggaaaacaagaatgcttccctgttttacgaggtaagaattgcttacctagtagttggggacagagtagtgacaaggccaacaaaaagaagagagaggaagaagagtactaaagataaatttcgtaaagatcactttgtatcagattttggtcatttttctaaatgtttctcaagcgggagccttctgattcatgtttaattttttactaaaattggctttaaaattattatcggccgggcgcggtggctcacgcctgtaatcccagcactttgggaggctgaggcgggtggatcacaaggtcaggagattgagaccatcctggctaacatggtgaaaccccgtctctactaaaaatacaaaaaaaaattagctgggcgtggtggcgggtgcctgtagtcccagctactcgggaggctgaggcaggagaatggcttgaacctggaaggcggagcttgcagtgggccgagatcgcgccactgccctccagcctgggtacacagcaagactccatctcgaaaaaaaaaataataataataaataaataaataaatgaaattattattatcttccagcaggtggcatagttttcactgaaactcagttttttcactttatttgtgtaaattttagtcatatcaaatccaatgttttttctttttttagttaggtcttactttatatggttaatgaaattttacgtaataatcttagattatttgcttctgttttgtgttttgcttttgaaagcaaagttgaatccttggtatgtataatatatttgaaatagggttcctttaacaacatgtagctatgtctccaagtgatttttctgttggtgtttaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgggctattaaaagaagtctaaagttgactctttttaaaaagtatgttgaaattctttttatgaggccctttaagtgtatttgtcttttatcttagtccaattacttgctttccatagtcactaaattaggaatttgttcatattcactctgaagttttcagtcacttgctttacttgaaacatgttgaacaaaatagaaataattaggatgaccttaccatcatttcagccacacagggagaggaattctgattaaacatggcatttcaccttttattactgtcttttattttaataaaataacaataaatataaaagttaaagtgaaaataaaacaatatatattcaattgagaattgaaatatacaattaagctgctttttgagatgttttgcttaattatcgtaataggaggaaggactaatagaagacagagtctcgctctgttgcccaggctggattgtagtggcgtgatctcagctcactgcaagctccgcctcacgggatcacaccattctcctgcctcagcctccccagtagctgggattataggtgcgcaccatcacgcctggctgatttttttgtatttttagtagagagggggtttcaccgtgttagccaggatggtttcaatctcctgaccttgtgatctgcctgcctcggcctcccaaagtgctgggattacaggcatgagccaccacgcccagctgagtttttttttttttttttttttttatgtggagtctcactctgtcacccaggctggagtacagtggcgtgatctcagttcactacaacctccactttgagttcaagctattcttctacctcagcctccccagtagctgagattacataggcatgtgccaccatgcccagctaatttttgtatttttagtagagacagggtttcaccatgttggccaggctggtcttgaactcttgacctcaagtgatccacctcaagtgatccacccaaagtacaggcatgagccaccgtacctggtcctggactaatagtattttatattgatccgtgtgcacattaaagtttgggaagtactgctgctggcatatgtataaaatgatacattggctgggtgtggcatgggatttctttttggggtgatgaaaatgttcagaaattagtgttgatagatgcacaattctgtgaatatacaaaaaaaccactgaattatgtcttttttttttttgagacagagtctcactctgtcacccaggctggagcacagtggcccgattatgtctcacttcaggctcacttcagtgacatcctgggctcaagcgatcctcccaccttagccttccaagtagctgggactacaggcacgcaccaccacacccagctactttttgtagagacagggtttcaccatgttgcctaggctggtctcaaattcctgggcttaagggatcttcccgcctcggcctcccaaagtgttgggattacaggcatgagccactgtgcctggctgaattgtatacttaccatatgatatggctggtacattctctgtgaactcaatattatgtgaatcatatcttgacaaagctgttaaaaaggatgaggacactatataatgatatagaaaaatctgcaagatgtgttaagtgaaataaataccatttgtgtaaaagtggggaaagaataagaatatgtaattgtatttgctttacatacgcaaaagaattcctagaagaatgaaaaggaaactaacaataatagttacctcacggagagaaactcagtggatagtataggagacttttctctgtattcatttttatactttttgagcatgtaaattgagcatgtaactttgaattactagttcaaaagttaaataaattgaatttttaaacaaagcagcaattcaataaactaaatcagataaggccagaagttaagttcaagaagacttcttaatttggctacatggaggttaacggtgactctgataaaagtgataaaatgttaaattccagattggggtgggcatgggaggtaaagaaatgaaagtagaatatgtggataactcttatcaagaaatttgactattgggccaggcgaggtggctcacgcctgtaatcccaacactttgggagcccaaggcgggaggaatgctggaggccaggagtttgagaccagcctgggcaacatagtgagacccagtttcaacaaaaaaaaatttttttaattacccaggcatgatggcacacacctatagtctctgctacttgagaggctaagaggggaggatcacttgagcccaggaggttgaggttacagtgagtcatgatcacacctctgcactcctgtctaggcgacagagaacctatctcaaaaaaaaagaactttggtgtgaagaggagcaaagatttggggtggcacctaaaggaggataaaaagtctttgaagggattttttagcttaggtgactctatagcatttttgtaatcttttggcaatgaatttagtaaagaagataagattgataatttaaaagaaggagccaatgaaaggaatgaaaaaagaaaaaaaagtagtagcttttagatcacctgtctaaaataggaaaatagacatttcatcagttctggaaagggaaaaaaataggcacaaatgcagatagatttggtagccaaaaggtaacaaattcctatcttctgtttttggcttctgttttgttggcagatcatgaagcagaattcagttatttctggagacagtggttggcattgtgggatgtttgagaagaaaagacatatagtctcagaggatgcaaaattgaattagtagagaactacagaggaattggtggttatttctgtgtgttttgcctttacagttgtaatcactgaatattacattctaaatattgacatatttagtatcagaagaagtatattcattaacggttttttttttttagagccagggtatcactcatttgcccatgctggagtgcagtagtgcagtcatagctcactgcagccttgaattcctgggctcaagtgatcctggcacctcagtctcctgagtaggtagaactacaggcacaggctaccacacctggctaatttttaaaaatattttgtaaagatggggtctcaccatcttgcccagattgacctctaattcctggcctcaactgatcctcttgcatcagccttccaaagtgctaggattataggtataagccagatgccaagccacattcactatttttagtagttcttatagtgtaggttgttctcagtgatttcttgcatgtccattttcaggaatctagttagtttagtaatttgaattaaagaattcacagtctatcttaatagtaggttaaggtttgaacctatgaggatttttactattctgcctaatgcttattcaagtaagattattcattttgttagtgaatgtcattatcttagaggtatatgaaattatttatttgcaatatatgaaattagtcatctgcaatgaacaattttgcttcttcatttcatttaatattacaagtatttcatcaattgcagttttcacacccttagtaatttatccagctggctttttttttcttaacatgctttttttttttttccacacaaccctttggaacacattttttacttgctttttatttaagatttgtaaagaattttaacttgttaaaaactacgataattacagctggtaacatttaactgttatattcaataatggataaagaaataatggactgtaaattacagcttttacacttagaaggattttagaaaccgtctatactagtagctcctgacattttcaaatataagagccctttttatttatttatttagaaacagggtctccttacgttatccaggctggacttgaacaagagtccttttttaaatgttgaacagttcatgcctccaaataatagtagctctagtagctctacatttagtatcagctaataaagaatatttctttattgagacacagtctcgctatgttccctaggcttttcttgaactaacctcgagtgatcctcccaccttggcctcccaaagtgctgggattacaggcatgataacataagcttctgtagacctgaaaattttattttaatataaaattgtatttacaaatcacgttatctgcatacatgtgaaaattttagtatgtaaagtggaaactatttttgtatttggtctacagacaattcatggtgcttgtgtgcattcctagacactttataatagctcagcagccctacaggaataaaagaatgggaactaccaagttcttttggtctatttgctgtctctcttcacccccagcacttctccccaatttttacatatgagaaaactaaggtccaaaaagattaaagtaatttggtagagagtacacatctatttattggcaaaaaaaaaacaaccttatttttttgtattaaaatataggaacaaagggagttagctgataagtagattgaaagaataaatacttctcctataaagaccagcttgttgtagaataattgaattactgaggggaatcttatacagtaggcatttgaagcactgagaagatacactaaaaaatctgttgatagaaatgtatttatttgtatattatgtgataaattgataactgcagactgttttcatattttcatattttcctggctttatgctggaataataaacttgaataagaatatttttctttttttttggtacacccttgtagaacatttatttatttattatttattatttattttttggtatatagccttaaatatttttcaaagattggaagcaacacttctcagtatggcttactgtacttttcacaccagttttgcttaacatgttggcatatttagagatgattcatttcctttctgtggatagcggtacatggaagttcggggaataaaattctgcaatcacttttttagtagcctgctgttgtgtttaaagagccttacctattttggctagcaagaaattcatttttggccaggctttgtgactcacagctgtaatcccaacacatcgggaggccaaagcatggggatcacttgaggccaggagtttgaggctagcctgggcaacatagagagaccctgccaggcatggtggtacatgcctgtagtcccagctgctcgggaggctgaggtaagggtatgacttgaacccaggagttcaaggttatacagcccctgcaccccaacctgcgtgacagaaggagactttgtctctaaaataaaaaggaaataaagaaattcatcttcatatttatttgcatttttaatgcctctgtttgctctcattgtttgtgataaagatagcaaatcacatgcttctctggaaagccaatgtggcctagtggtccagagctcgagctctcgagtgacactgcctgcttgtggtatcctggctgaaatcctcgttcagtagccctggctctgtgccactgtttcctcatctctaaaaccacagtgtacccatttcacagaatttctgtgaagatgaagtgacttagtgatacctctttctttattcttttaactttaaatgcattttctaacccaactcagtggtatttatgctttctttttgttcagagatcctttaaaagaaagtacattttgtgaaaaataatttttaaaaattcatttgagagcgtgtcacatcggtgcacacctgaataccagctacttaaaagacaggggcaggaggatcactggagcccaggagtttgcagacagcctgggcaacagcaaaaccccgtctctttaaaaaaaaaagcattaatttaagtcaatataaaattttcctattttcctttaattatgaatatgaggttgggtgcagtggctcacgcctgtaatcccagcaccttgggagggcaaggcaggcagatcaccctgaggtcaggagtttgagactatcctggccaacatggtgaaaccctgtctctactaaaaatacaaaaattagccaggcctggtggcagatgcctgtaatcccagctacttgggaggctgaggcaagagaatcgcttcaacctgggaggtagaggttgcagtgagccgagattgcgccactgtactccagcctgggcaacagagggaaactctgtctcaaaaaaaaaaaaattatgaatatgagaaattactgatctgtattaatgtcatccctgccccctttgagctgaacttcagtttaccaagtattgtttcttctaaagattttttcatgacactactggttaatacataactgagagttaataaattttgctgtgttacagtctaatttgctctctaccaacagagaccttctttctttttctgtttagtttttcaaaacaagagttatttaatgtgcttgaaaactagacatttttcctagttgtgttcactgaattagcatttattatagtaccgactagatgtgctataccacacaaagataaatgaggctgtggcctggaagaggtaggcttgtaaagtcattatgctactcccaaataagtgctttaaaagagatgtgagcaaagtcccctcaaatgcagaagacagtccggtccaacacagaagaaaaagcaaaacttgctggctggggcaaggttaatctggacacgacctagttttctccagtttggcatttttatttattttttcgagacagagtctcattctgtcatccaggctagtacagtggcacaatctcatctcactgcaacctcctccttccgggttcaagtgattcttatgcctcagcctcccaagtagctgagattacaggcatgtgccaccatgcccagttaattttttgtatttttagtagagacagtgtttcgccaggttgcccaggctggtctcgatctccagagctcaggtgatctgccggccttggctcccaaagtgctgggatattacaggagtgagccaccacgcctgattattttggcatttttaaactctttctttaatataacaaaaaaaaaaaaaacaaaacaaaacaggttttgtggtcaatttgaaaacaaattgaagtaattttttttttttttgagacagaatctctctctgttgcccagactggagtgcagtggcgtgacctcagctcactgcaacttctgcctcctggcctcaagcgatcctccgtcctccgccttccgagtagctaaagctacaggtccatgctgccatgcctagcaaattttttgtattttttgtatttttttgtagagacgaggttttgctatgtagcccgagctggtcttgagctcctgagctcaagcgatctgcctacctcagcctccttatgtactgggattacaggcatgagccactgtgcccagccacttttgtctttttagtaaaccaggtttttcattgtttttttttttttaaattcctcttccaggtggtttatgcacatagtttccaggaaactccgtcgtcatcaaaacccaccaaattagcagtttaaatgtgtttgttttttccttgaattcttctatgacggggatatttaacagagaaaacatctttttagttgaagtctctaaagctaaggaaaggataaaaaaatgcgaattggtgctctgctttgatgtaaatgtggcttagaaagtaacttaataaaatcctactcagtatttcctttttctttgtgataattgcttactatgtgtaaatcaataaagtgagctgtaaaatgtttttaaacaggacattttagaaaaaaatgtttaggcaattaacatttctcacagtgtttcttctaattttgttaatgtacatatatatgtacctggactcatcttttgtgaatgcacatgctctttttcattttgcatgactagtaaagtagtgattcttgtaaatagagatttatgacagaattgccacaagattctttcaaacttgaggtattcacactgccacctcatactgtgtggtgaaaactagattttttataaaatcataaaaggagagaaggaagaaataaatgaaattgtatgttcaaaaaaattagaaccctaaaaacatttgtatttttattgtatagtcagaaaaaaaagaagggagggtatttgaatctcacaagaaaggggcctgagtagtttgaaaaagaatactagacattgtcacttacttgttttctaattactctagtgggcatttgataatactggaagatatttataaaatttttaaaccctagggtctagcttctacttagtatctcccttcaagaatgtcctgattaaaaggctatactataaattaagtggatgattattagtaagcattcaaaaagagatttcgtctttttaaatgactttatgaaaatatgaaatttgcctgtggtatttatagtgtgcagtcatggttttccagtgcttttctaataaataaatcggagtacataagttgaaagagttctatatatatataaatcattctgtgattaattaatgctttttaataaatcagctgcgagagcactactcatgatgggcgtgtttgaatgccttatatagactactcagaacaggtttagacagtctttgccccgttgacctgttaccatatttatcagagtagatatagattatagtctttctaatgatgttctgcttcactctgaccaatatctaataaacacttaacctatattaggcatttcaccatctttctgtctctcttttttggaatggagtcttgctatgttgcccaggctggtctcctggcttaagtgatacccttctgtctcagcctcctgaatatctgggattacaagtgcccactaccatgcctgatttttttctcttttttgacaactcataccgacagtactaagaattcccaaactgatggatgaaagtgaatatgcctcattggcatttttttttttttttttttttttttttttttttttttgtgacagtcttgctttattgcccaggctggagtgcagtagtgcaatttcccaggttcaagagattctcgtgctttaccctcccgagtagctgggattacaggcgttcaccaccacacccagctaatttttgtatttttagtagagatgggttttcaccacattggccaggctggtctcgagctcctggcctcaagtgatctgcctgcctcacccctcaaagtgctgggattacagacatgagccaccatatctggccaacttttttttttttttttggtgagaccgagtctcactctgtctcccaggctggagtgcagtggtgtgatctcggctcaccgcaagctccgcctcccgggttcaccccattctcctgcctcagcctcctgagtagctgggactacaggcgcccatcaccacgcctggctaattttttaaaatatttttagtagagacagggtttcactgtgttagccaggatggtctcgatttcctgacctcgtgatccacccgcctcggcctcccaaagtgctgggattacatgtcttgccatgttgcccaggctggtctgaaactactggtttcaagtgatccacccacctcagcctcccaaagttctgggattatgggtgtgacccaccgttcccagccttgtatgtcttcttttgaaaagtgtctgttcatgtcctttgcccactttttattggggatatttgttttttgctgctgatttttttttaagttccttatagactctggatatcagatctttgttggatgcatagcttgcgaacattttcttgcattctgtgggatgtcttttttttttttttttttttttttgaggcagagtctcattctgtcacccaggctacagtgcggtggtgagatgagatcatggctcactgcagcctcgactttctgggctcagtgatccacctcaggatctgcaaatgtctttccatttgtttgtgtcatctatggtttctttcaacagtgttttgtagttcttgtagagatctttcacctccttggttagatatatcctaggtattttgtgtgtgtgcatatggctattgtaaatgggattgcacaagactacaggcacatgccaccacacctggataatttttaaatttttttgtagagacaggtctccctttgttgcccaggctggtctcaaactcctgggctcaagtaatcctcctgccttggcctcccaaagtgctgggattacagatgtgagccattgcacctgacctgtttactcttggtagtttcttttgctgcgcagaagctctttggtttaattaggtcccacttgtcaatttttgtttttgttgcaattgcttttgtggacttagtcatgaaatatttaccaaggccaatatcctgaagggtatttgctagggtttcttctgggatttttatattctgaggtcttacatttaagtgtttaatccatcttgagttaatttttgcacatggtgatagttaagggtccagtttcattctgcatgtggttagccagttatctcagcaccatttattgagtagggattcctttcccagttccttgtttttgtcagctttctcaaagatcagttggttgtaggtgtgtggctttatttctgtgttccctattgtgttccactggtctgtgtttctgtttgtgcaccagtgccatgttctttttcactagccttgaagtagagtttgatgttgggtaatgtgatgcctccagctttgttgtttttgttttagatcctttggctatttgggctcttttttggttccatatgaattttagaatagttttttctaattctgtgaaaaatgacattggtaatttgataggaatagtgttgaatctatagattgctttggggagtatggtctttttctttcttctttctttctttttttttttttttggtgctgtgacttcgatgcaaaccaaggttgctgcagacacagtatggtcattttaatgatattgattcttctaatccatgagtgtggaatgtgtttccatttgtttgtgttatctgtgatttctttcaacagtgttttgtagttcttgtagagatctttcacctccttggttagatatattcctaggtattttatgtacatgtatgactattgtaaatgggattgcatacttgatttgactctcagctcgaacattattggtgtataaaaatgctactgatttttgtatattgattttgtatcctgaaactttaccaaagtcttttatctaggagccctttagcaattctatgtatagagtaatatagtcagtggagagatatttgacttcttttcctattttggtatcttacttgattgttctggctaagattttcagtactctgttaaatatgagtgaaaagagtggccaaccttgtcttattccaattcttaagggtaatgcttccagctttttcccattcatatggtgttgtctgtgggtttgccatagatggctctttttattttgagttatgttccttcaatgcctagtatgttggaggtctttattatgaaaggatgttgaattttatcgaaagctttttctgcatctattgagatgatcatgtggtttttgtttttaattctgttgatgcagtgaattgcatatattgatttgcatatgttgaaccaaccttacatcccaggagtaaaacctactggttgtggtgtattaacttcctaaagtactgttgggtttggtttgctagtgttttgttgaggatttttatatctgtgttcatcaaggatattggcctgtagtttctctttttgatgtgtctttgccagattttggtatcaggataatgctggctttatagagtgatttggagaggagttggtattttggaatattttcagtaggactggtaccagttctttgtgcatctagaattcagctgtgatttttctggtccagggctttttttggttgataggttttttatttattacgattcaattttggaactcattattggtttgttcagaatttctgttttttctgagtcagtcttgggaagttttatgtttccaggaatttatccatttcctctagattttctttgctgtgcagaagttctttagtctaattaggtcccacttgtcagttttggtttttgttgcaattgcttttgaggactttctctttctctctctcttttttttttttttttcttgaaacggagtcttaatgctgggcgcggtggctcacgcctgtaatcccagcactttgggaggcataggcgggcggatcacaaggtcaggagatcgagaccacggtgaaaccccgtctctactaaaaatacaaaacattagctgggcgtggtggtgggcacctgtagtctcagctacttgggaggctgaggcaggagaattgcgtgaacctggaaggcggagcttgcagtgagccgagatcgtgccactgcactccagcctgggcaacaaagcgagactccgtctcaaaaataaataaataaataaatagaaacaaggtcttacctaggctggagtgcagtggcatgatcatggctcactgcagcctcaacctcccaagctcaattaatcttcccatctcagtcttctgagcagctggagctacagatacacaccaccacacctggctaatctttaaaaatttttgtagcaattgggtctcattttgttgcccagggtggtgtcaaacttctgacctcaagtgattctcccacctttgcctccaaaagtattgggattacaggtgtgagcccatttcctctaaattttctggtttgtgcacatagaagtgttcataatagtctctgaggatcttttgtatttctgtggaatcagttgtagtgtcacctttgccattttctgattgtgcttatatggagcttccctcttcttttctttgttaatctagctaggagtttatcgatcttgtttatcctttcaaaaaatcaattttttttgttttattgatcctttgtatggattctttagtctcaattttgtttagttctgctgttattttagttatttcttttcttctgctagctttggggttagtgtgttctcgtttatctagtttccctagatgcaatgttagattgttaatttgagatctttctaacttgatataggtgtttagtgctataaacgttcctcttaacattgcttttgctgcatcccatatattttgatatgttgtgtctgttttcatttatttcaaagaatatttcaatttctgcttaatttcattgtttattcaaaagtcattctggagtatgttgtttactttccatgtaatttgtgtggttctgagagatcctcagtattgatttctatttttattttactatggtctcagaatatatgcttggtatgatttcaatttaaaaaaaatttttgagacttgctttacggccaagcatgtggttgaccttagagtatgttccatgtgcagcttcatcagcatttatcttggtgataacatggattccatgacaggtattaatggtacaatttttatgttttaaaagtggtagtttgctaaggaaaatatgaagagagctgatttcacttttagtggttgtcatttaataaagtgagatgtgaggttgggcagggtagctcacgcctgtaatcccaacactttgggaggcaaaggtgggaggcacactttagcccaggagttcgagtccagcctgggcaacatggcaaaaccccatcgctactgaaaatacaaaagttagccaggcatggtggcatatatctgtagtcccagctacttgggaggctgaggtgggaggattgcttgaacttgggaggttggggcttcagtgagccgtgatcacaccaccgtgctttagcctgggcaacacagtgagaccctgtctcaaaaaaaataaatcaagtgagatgtgagaaggaatttttctattcttgaaatgcatgtagggatagtctttatgcctagtcaagcctaaaacacttttttaaaaagagatatttgttatatatgattaaggcagctattataatattactattctaagttactaacttttgaaaactttttaaattttgtagtttttatgacatgttagtaaatttttatgatggaacttttctttactaacaggtgcattccttgtaaaggttctcggtttcccccaacccttccacgccctgctgttgctatattatcctttaagcttccttactgtcagattgcaacagagaaaggacaaatggaggtatgtggaagtcttaccttgacactttgaatttgataatacagcacctgtgatacacacactttaaaattatcctgatggccagtattgaatattcattactgtataattacataaataggggtagcagggagggaagaggactgcttgggatcaccaggccacctgattgccatcactgcttccagggactttgtctacaaagtaaatgggtgtgactgtcagagacccactggggaaagacttactctcaggatggggcatgtccctgagaagaagtgcctccatacattttgtgccataacacctggcttgcctgaccctagtcctagccttgtgtcatcaaaagtcatttgaaatcttgcagttagttattctaaataagaaacaagttagcttttaaaaatcttgtttaccaaattctctgagcattaattatgatagctaggaaactgttttaaatgctgtattcctccccagctgccttttttaaggataggggaaaaagttaagctgtagtatcacactagaatttaaattgtaaaataaacttatagaaaggaagagttcagaacatattttattcaaaaactggtatcttaagataaatatttaacgcttgcctcatattaaggtgatagttggccttaagcaattttatttgcttttataggagcaattttggcgttcagttatatttcacaaccaccttgattatttagctaaaaatggttatgaatatgaagagagcactaaaaatcaagcaacaaaagagcaacaggaacttttaatgaaaatgcttgcggtgagtaaaataaatatactgaaaacgttaaagttaaatgcttttctataggttgaatttcttaaaggtctgtgcattaggactaagtcccacaacctaagattcttaagtttttttttgttgttgttgttgttttttgtgcgacggagtctcgttctgtcacccaggctggagtgcagtggtgcgatctcggctcactgcaacctctgcctcccgggttcacgcaattctgcctcagcctcccgagtagctaggattacaggcacacaccaccacgcctagctaattttttttttttttttttttttttagtagagatggggtttccctatgttggcccgactggtctcgaactcctgacctcgtgatccgcccgcctcagcctcccaaagtgctgggattacaggtgtgagccaccacacccagccattcttaagttttatctggtggtgttttcccttgtaaagttctatcttctagttggtcttgcagttaaaatttttttctttttttttttttaggcggagtttcgctcttgtttctcaggctgaagtgcagttgtgcagtcttggcttactgcaacctccacttcccgggttcaagtgattctcctgcctcaaccttccgagtagctgggactacaggcgtgtgccaccatgcctggctaatttttgtatttttagtagaaacagggtttcaccacattggtcaggctggtcttgaactcctgacctcaggtaattcacctgcctcggcctccgaaagtgctgggatcacaggcatgagccaccgtgcccagcctaaaataaataaaacagtaccttgtagctaagatcatgtgcaggaataaacatctctagggctacttcccttttgcttttgcccatcagtctatgttttaacgggctctcaaggtaactgagaaccactgctctagtttctgttattattttacaaagtttgagtatatactgttttttaatctccagggctgggcaatcttaagaactttgatcgggctgttagatatgcctgccttttgtcatcctctttgagttaggcagctgtgtgtgatgaaaatttatttgtgaccagtggccaggtttggtgtctagaatatttaagtacatttatctttggagcagggtgtcttaaagttcctgtgcttgtgtccccactcaaggttggtttatggagaggagtatagtatcatttcttctttatttgtcttacactagactttatgccccagagggcagagacctgctcactgctgtatgccaggcactgacatggtggcttaacacatagtagacctcgatatttgttgacaagagtgaatggtccagacttttaattttaaaattggagaaaaaaggttcttagagaaaagtggtatatgagaccacagagcaaattgccactcttgtctccaaaaggtagtactcactactgtcacctttatgcaacatggccttaagtttggtattaagaaaactcagtttattgtagaaaaagttttattccttttataaagtgttacttgtggtccaggaactagtagcctttttatttgtacaacacatataaggaaacatatttcatgtatttgctatttagcctagaggagcttttccctgtggcagtgtttctcatatcaaaaataccaggggactcatatcaaagatgccagggcaggaggatatcttgagcccaggagttcaaggggattgttgagttcttctttagcattcctgacccccgggcaaatgcctttagttcagaatagtcactgtggaaaccagactattcctttttatttctttttttttttttgaaacgaagtctcgctctgttgcccaggctggagtgcagtggcgcgatctctgctcactgcaagctccgcctcccaggttcacgccattctcctgcctcagcctcccgagtagctgggactacagttgtctgccaccacaccagctaattttttgtatttttaatagagactgtgtttcaccgtgttagccagtatggtctcgatctcctgaccttgtgatccacctgtctcagtctcccaaagtgctaggattacaggtgtgagccactgcgcccggcttcctttttatttctaaatgccccctgaggcagtgtaccatcccgattaagaagtactgattatagataaatgatactaaaaatcttgaaaagggcatccaggtgaatatctaaagcttttgtgctgatggatcagacatggaatatctaagtaagaaaatagttctaatacactatgaattaggagacccttagtaatcttcaaaataccaacttttctcagtttgttgtttttcttttttgtattttttagagaaagggtctcactctgttacccaggctagagtacagtggcaagattgtaactcactgcagcctcaacctcctgggctctagtgaacctcctgtctcaggctcctgagtagataagactgcaggtgcatgccaccacgcccagctaatttattttttgtagttatagggtctcactgtgttgcccaggttagtctcaaactcctggcctctagcagtccctctgccttggccttccaaagtgctaggattacaggtgtgagccagcacacctggcccccttgatttttttttttttttttttttttgagacagagtctcgctttctcgcccaggctggagtgcagtggtgcaatcttggctcactgcaacctccacctcccgggttcaagcgattctcctgcctcagcttcccgagtagctgggattacaggcgcacgccaccacgcctggctaattgtgtttttagtagagacggggttttgccatattggccaggctgatctcgaactcctcacctcatgatccacccatctgggcctcccaaagcactggtattacaggcgtgagccaccgtgcccagcctcccccttgaattttttaaacaaatttcttaattttcttgcaattagtagattaaagtggtatgtaatatttcatcaaatctaagccactgtttattgcatagtgcaccattactttattcatttaagccatggagacataaaaatgctgccaaactgacccaccattaattgtaattaattgtaattccaatttcagagatgttaaaacttgtaaaaatgtgcatcttagaattagggagatagagtagctagaaaactattgtctcagttttactagtagtgtcagtatctttaaaaagttttacttgatgttatttgatctcccccccccccccctttttggattagctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctgggtaagaaataatttagttgtttgaattttcctttactgtcttgaatgttaagttggtctttgcatagctctttattgaataatattattttctcttagttacagcaatactgctacagagtggagccaaccaaggttcagaaatcaagttgaagaagatgctgaggacagtggagaagctgatgatgaagaaaaaccagaaatacataagcctggtgagatacattttcaagcccataaatcatgagaactatcatggatgtggcttttcccattttgcttaactgagggaaattgaatactcatactttttttcagacctctttgctatctggttgttgtatattgaggatgactatattttccccatttacattatattgctttattttaatctgtaggacagaactcgttttccaaaagtacaaattcctctgatgtttcagctaagtcaggtgagaaatatttataaatttgtaatatcaaggaaattttgcaagtcatctgcaaagtgacacatctacgcaaatacaccttaactcttaaggccacttttggtgtgtgtgtgtttatgtttttgtttttttaatctcagatgttgtttgtgaagctatggtcatttaacagatgtttataaaatgcctattgagtgtcaggcattttacttaatggtggatacagaagtcaaacagacatgtgtggttgatctctgttttaatgctattttagcccagctgagaagacagatgttgaagacagatctgggtatcactgaggaagcatgcaggatactggagaaacagttaaaaggaattgaaggctgggcgcagtggctcacgcctgtaatcccagcactttgggaggccggagtgggcggataacgaggtcaggagttctagactagcctggccaacacggtgaaaccccatctctactaaaaatacaaaaattagctgagggtggtggtatgtgcctgtaatcccagctactcgggaggctgaagcaggagaatcacttgaactcaggaggtggaggtagcagtgagccgagatcgtgccattgcactccagcctgggcaatggagtgagactccatctcaaaaaaaaaaaaaaggagttgaaaatggttgcgtacagggagtgggcctgggggataagagaaggttgaagtaaggcactgctggcccttttttggtggggagcataaaccttatagtaccatttgactttttaaactgtggacatatgttactttgatttaaaaaaattaacttaaaaaacatgtagaatatgaaaagagcgtatgacacatagctgtcatctagccagtggtggaggatgggtagggacttcaaggcaggcctcatggagtgtttacagcagagacctgaaggatgaataacagtcagcaaggcaaaggtgcatgggaacaggagcagaagagaagcatttgggcttaaggaacagtatgtgtgaactgaaggctgcaaaagggtggtgtgaaaagctcagagagcaaagagaaagtggtgctgaagggtttcggagtgatgggcaggagccaagtcatgcagatctgtgtaggccatattaaggattttggtcttttttttattttattttattttttttaatagagatggggtgtcactctgttgtccaggctggtctcaaactcaagcaatttcctcacctccacatcccaaagttgttggacctgcaggtgtgagccaccacacccggtcaggattttgctctttattctaaggtcactgagagactgttgtaggttttaagcagaggtatagcatggcacactgtgctgaagaagaacagataatagactactggccaggtgtgatggctcatgtctgtaacctcagcattttgagaggccaaggtggaaggatcacttgagaccagacgtttgagaccagccttggaaacaatgaaaccctatctctacaaaaagtaaataataaaaatattagccaggcatggtagtacacaccggtagtcccaggtatttgggaggctgggacaggaggatatcttgagcccaggagttcgagggtgcagtaggctatggttgcaccactgcactccagcctgggtgacagagcaagaccctgtatcaaaaaataaataggccaggcgtggtggctcacgcctgtaattccagcactttgggaggccgaggcaggtggagcacttgaggtcaggagttcaagaccagcctggccaaaatggtgaaaccacatctccactaaaaatacaaaaaaaaaaattagccgggcatggtggctcatgcctgtaatcccagctactcgggaggctgaggcaggagaattgcttgaatccaggagtggggagttgcagtaagtggagatcacgccactgcactccagcctaggtgacagagtgagacttcatctaaaataataataagaagaagtaaataaaaattaaaaaataaagagactacaagctgggcgtggtggctcacacctgtaatcccagcactttgggaggctgaggagggtggatcacgaggtcaggagattgagagcatcctgaagaacacagtgaaaccccgtctctactaaaaatacataaaaattagccgggcatggtgacaggcacctgtaatcccagctacttgggaggctgaggcaggagaatggcgtgaacccgggaggcagagcttgcagtgaggtgagatcataccaccgcactccagcctgggcgacagagcgagactccatctcaaataaataaataaacaaacaaactacagaggcagtccaaatgagattgaataagggcctgagctagggtggtgatggtgatgttagaaagaatgggcagagttggagagctatttctgaagatgatgaagagagtgtaggagttcagggcgtaaagagtgattctcagtttcttgtaatagaagaaaaacttaagcacatttgaatcttgaaggattaatttgaacattcagtgattcatgaatcagggaggcaccaaaccgcaaggggctagcactctgccaggagagacaaaaggggaaacttttataaagtattttcagaaacgagataaataaaacaatttttattggctagatggaaaggtttttttgtttgttttttttgtttggtggggggggtgcggatacagggtatcttgctttgtcactcagactggagcagagttggagtgcagtgatgcagtcctagctcgctacagccttgaactcgtatgctcaggtgatcctcctgcctcaccctactgagtagctatgactacagttgtgcatcaccatgcctggttaattttttgtgtgtactttttgtagagagaggagcttgctttgttgccgaagctggtctggaactcctgggcttaagtgaccctcctgccttagcctcccaaaattttcggattacaggcacaagtggccatgctcagctagaaatttcctgcctgcctgcctgcctgcctgcctgcctccctccctcccttccttcttccctccctccctccctcctcttccccccgccagggtgtgactgtcatccaggttagagtgcagtggcgtgattatggctcactgcagcctcaaccccccagacccaagcgatctttccacctcagcctcccaagtaactaggaccacaggcatgtgtcaccatgtctggctagttttgttttggtttgggttttttgttttgttgttttttgtttttgtagagacagggtctccctatgttacccatgctagtcttaaactgggctcaagcagtcctccctcctcagcctcccaaagtgctgggattacaggcttaagccaccatgccaggaaagctcttaattagagattagtttgttaacactggcttgagtacttgagtgaatgatggtgccatttcctaagtcaggaaacactagagaaaagcagatttagagaggaagatgatgaattactgtaaggtgagtagaatgtcgtgaagacagatatttgaatcaggagctcagggaagtattctggtcaagagatacaaagtgaaaatcattggcataagtatagcaatttaaaccatgagcatgggtaagcaagcattgggggagaatgtaaagcaaaaagaaaaatgagcttaagcctagggaatctccaacatttgagcatcaggtagaggaagaggaggaaccaactattggaacacaatgagtccacaggtccagagaggaaggaactaagtcagggaatgcagtatctcagaagtcaagagaggacaaagtatcaagaagtaaggaacagtcagctatgtgggatgccattgatagagcaaacaaggtgactgaaaggtatccaccagatttgacaatgtagagatcactgagggccttagcaagaggagattctgtagggtggtagagctggaagtgctatattgtatggaggaatgtatgggtggtgaggaaatgataatagtgtcaacagttcttggaaaaatttggctggatgaccgggcgtggtggctcatgcttgtaatcccagcactgtgggaggccaaggcagacggatcacctgaggtcaggagttcaagaccagcctggccaacatggtgaaaccctgtctctattaaaaatacaaaaattagccgggcgtggtagcaggcgcctgtaatcccagcaattcgggaggctgagacagtagaatcgcctgaacctgggaggtggactttgcagtgagccgagatcacaccattgccctccagcttgggcaacaagagcgagactctgtctcaaaaaaaaaaaaaaatggctggatggaggaggcgagagaaaatggtgactggaaggaatgtggggtagagaaggtttgttttttgtttctttttaagttgggagactttaggggccaataaatagggaaaagtcaaagatgtaggatgtcaagaaacttgataggtcaggttttctgacaaagcaggagggcatgggatgcagaacacaagtaaagggattactaaccttagctcagacgagctgccactcttccgcagtaacagaagataaaagatctgtacatactgaatatgtttcatagtggcacgttggggtggttcacatttaatagcttttattttggcttagaagtaggaaagaggatatctgttgttaatagttttgaaaagttgcaaaatacatttgttttcatttaatggggattaaaatactctgtctagtattatagatgtcagaagtcatctattttctaccattattaagcaagggtttcttttttgtgaaaggtgcagttacctttagcagccaaggacgagtaaatccctttaaggtaaactcttccaagtgatgttttatattatttaaatacatttgtatacaaagaaatatttccaaatgatgagatgactctccccagacttggaggcatgaaagactgatctgtgtggaaacagaagaaagcagcacttgggctgagagttgtcttttctacttaccttctaagtacctatggttttgaaagatacctctgtctttcttggggatgtggtatttgggaatatacgtatcattcttaatttggattgtaccaaatgtatttagttctaaagatgagatggcaatacaaacttaacagaaatttcaagaaaaaataagtctcttgggattttatttttcttctttaaacatacagtgctaacactagtttgctctttaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggtactgtttcagctaccctcatctgcagtaagcagcatgggatctgtttgtcttcagttttgttcactgtttcagatataggataggaggttctgattgtttacaattgtcttgctagggaagtgggttcaattctgtttttgcagctaggcacagtggcacatacctgtagtcccagatactcaggaggctgaggtgggaggatcacttgagcccaggagtttgagtccagtctgggaaacataagagataccccatctgaaaaaaacaaaccccaaaacagttgtgttttttgtttcagaatcactccctattctgcctcgtgagttgttacacactttgtagcagattctgacttccaagatcactatcctgctccccctgtcttttttgagacagaggctcactctgtcacccaggctggatggagtgcagtgtcaggatctcagctcactgcagcctctgtctcctgggttcaagcaattctcatgcctcagcctcccgaggagttgggattacagaggcctgacatcacgcccagctaattttggtatttttagtagagatggggtttcagcatgatggccaggctggtctcaaactcctggcctcaagtgatccacccacctcagcctcccaaagtgctggtattacaggcatgagccaccgcacccagcctatcctgcccctctccttgtttttacagatcactttttaaaaatatatatactcagaccccagaagctcagacatttatctgtatttttattaaaatcacccagatagttctgatgtatattcgtatttaatagtggctgatattgtacatggccctaatttttccttgttctgagtcctgatttttccactctgataagtatttgatcccggattagtcattggtaaaatagatctattgcttatcttttctatttaatataattgtattcatttagaaaacatggaatttaggccagccgcggtggcaggtgcctgtaatcccagctacctgggagggtgagtcaggagaaccacttgaactcggagggtggaggttgcagtgagccgagatagcgccactgcactccagcctgggcaacagagtgagactccgtctcaaaaaaaaaaaaaaaaaaaaggaaaacatggaatctgaagtgtagttttttggttttgcatgtgtttgcctatttatttacaactgagaactccagatttcacatgttagtataagaattctcaataattatagatgtttcttcacatttttcagaacgtgcttataaaacatataaaattatactagatgttattgcagtattcatgtttgtttttataggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggtcagtacatagagaaatttagcatgcagtgaccaagtaaaaagtatacagtagcagcaatacaaaattatgcaatgctgttattccttaatacaaataatacattggcattggtagtgggcattctggacacttgtgactataaggaagccacaaatattaatgtctatttataatatttattaaaatatgctttaataaattgtatatttttaaattgtggatatattttattgggacattatattttgtaattaattttttgtttgtttttaaatagtttaatggggagaaatagcaaaagatacaaaaagaagagtgataataagtagtttcatccaactaatttctgtctccaaaaacaatcactgcaacaagtttcttgtggaactttccaaaattattctatttatgtgcaaatacatatttgtctattttttgttttacacattattctgtaccttacttttttaacttaacaatagcttttgtagcttattttatattactacataaagaacttctttatactggctgggcatggtggctcacgcctataatctcagcactttgggaagccgaagcaggcggatcatctgaggatgggagttcgagaccagcctgaccaacatggagaaaccctgtctctattaaaaatacaaaattagccaggcttggtggcacatgcctgtaatcccagcaaatcggaaggctgaggcaggagaatcacttgaacccgggacgcggagattgcagtcatctgagatcacaccgctgcactccagcctgggcaacaaaagcgaaactctgtctcaaaaaaaccaaaaaaacaaaaagaacttctttatactatagcaaggctatcagaaaaagtaaatacataaatggatggatagatagaaaaataagagctttaatctttgtgtatccattgaatagacatgtcatagttcatgtagttctctacttgtggacaaaagatggttaccggtcttttgctagtacagacagtactgcaatgaataattttatatgaatagcatttctcacagatgcatatatagctataagatggattcatgtatggttcaagttaatctgcacttataattccaatgccagattgttctgcattgatgttgtatcattttatacacctttagcaatatgagtattcctatttgctcatatcctctttgtccacaaacacagtatgttacctattttcttgatctctactatgctggatttctttgtatttatttattttttctgagacggagtttcgctcttgttgcccaggctggagtgcattggcacgatcttggctcactgcaacctccgcctcccaggttcaagcgattctcctgcctcagcctcctgagtagctgggattgcaggcatacgccaccatgcctggctaattttatatcttttttttttttttaaatacttttaagctctagggtacatgtgcacaacattcaggtttgttacatatgtacacatgtgccatgttggtgtgctgtgctcatcatttacattaggtatatctcctaatgctatccctccctacttcccccaccccacaacaggcccaagtgtgtgatgttccccttcctgtgtccaagcgttctcattgttcagttctcacctatgagtgagaacatgcggtgtttggttttttgtccttgagatagtttgctgagaatgatggttcccagtttcatccatgtccctacaaaggacatgaattcatccttttttatggctgtatagtattccatggtgtatatgtgccacattttcttaatctagtctatcattgatgaacatttaggttggttccaagtctttgctattgtgaatagtgccacaataaacatacgtgtgcatgtgtttttatagcagcatgatttataatcctttgggtatatacccagtaatgggattgctgggtcaaatggtatttctagttctagatccttgaggaatcgccacaccgccttccacaatggttgaactagtttacagtcccaccaacagtgtaaaagtgttcctatttctccacatcctctccagcacctgttgtttcctgacattttaatgattgccattctaactggtgtgagatggtttctcactgtggttttgatttgcatttctctgatggccagtgatgatgagcattttttcatgtgtctgttggctgcataaatgtcttcttttgagaagtgtctgctcatatccttcgcccactttttgattgggtttgtttttttcttgtaaatttgtttgagttctttgtagattctggatattagccctttgtcagatgggtagattgcaaaattttttcccgttctgtaggttgcctgttcactctgatggtagtttcttttgctgtgcagaagctctttagtttaattagatcccatctgtcaattttggcttttgttgccattgcttttggtgttttagacatgaagtccttgcacattcctatatcctgaatggtattgcctaggttttcttctggggtttttatggttttagatctaacatttaagtctttaatccatctggaattaatttttgtataagatgtgaggaatggatccagtttcagctttctacatatggctaggcagttttcccagcaccatttattaaatagggaatcctttccccatttcttgtttttgtcatgtttgtcaaagatcagatggttgtagatgtgtggtattatttctgagggctctgttctgttccattggtctgtatctctgttttggtaccagtactgtgctgttttgtatagtttgaagtcaggtagcgtgatgcctccagctttgttcctttggcttatgagtgacttggcaatgcgggctcttttttggttccatatgaactttaaagtagttttttccaattctgtgaagaaagtcattgatagcttgatggggatggcattgaatctataaattgccttggacaggatggccgttttcacgatagtgattcttcctatccatgagcgtggaatgttcttccgtttgtttgtgtcctcttttatttcattgagcagtggtttgtagttctctttgaagaggtccttcacatcccttgtaagttggattcctaggtattttattctctttgaagcaattgtgaatgggagttcactcatgatttggctctctgtttgtctgttattggtgtataagaatgcttgcgatttttgcacattgattttgtatcctgagactttgctgaagttccctatcagcttaaggagattttgggctgagacgacggggttttctaaatatacaatcatgtcatctgcaaacaggtacaatttgacttcctcttttcctaattgaataccctttatttctttctcctgcctgattgccctggccagaacttccaacactatgttgaacagaagtggtgagagagggcatccctgtcttgtgccagttttcaaagggaatgcttccagtttttgcccattcagtatgatattggctgtgggtttgtcataaatagctcttattattttgagatacatcccatcaatacctaatttattgagagttttttagcatgaagcgttgttgaattttgtcacaggccttttctgcatctattgagataaccatgtggttttagtctttggttctgtttatatgctggattacgtttatttatttgcgaatgttgaactagccttgcatcccagagatgaagcccacttgataagttttttgaagtgctgctggatttggtttgccagtattttactgaggatttttgcatcgatgttcatcagggatattggtctaaaattctctttttttgttgtgtgtctgccaggctttggtatcaggatgatgctggcctcataaaatgagttagggaggattccctctttttctattgattggaatagtttcagaaggaatggtaacagctcctccttgtacctctggtagaatttggctgtgaatccatctggtcctggactttttatttggttggtaggctattaattattgcctcaatttcagagcctgttattggtctattcagagattgaacttcttcctcgtttagtcttgggagggtgtgtgtgtccaggaatttatccatgtcttctagattttctagtttatttgcatagaggtgtttatagtattctttgatggtagtttgtatttctgtgggatcagtggtgatatcccctttatcattttttattgcatctatttgattcttctctcttttcttctttattagtcttgctagcggtctatcagttttattgatcttttcaaaaaaccagctcctggattcattgattttttgaaggcttttttgtgtctctatctccttcagttctgctctgatctcagttatttcttgccttctgctagcttttgaatatgtttgctcttgcttctctagttcttttaattgtgatgttagggtgtcaattttagatattttctgctttctcttgtgggcatttagtgctataaatttccctctacacactgctttaaatgtgtcccagagattctggtatgctgtgtctttgttctcgttggtttcaaagaacatctttatttctgccttcatttcgttatgtacccagtagtcattcaggagcaggttgttcagtttccatgtggttgagcagttttgggtgagtttcctaatgctgagttctagtttgattgcactgtggtctgagagacagtttgttataatttctgttcttttacatttgctgaggagtgctttacttccaactatgtggtcagtgttggaataagtgcgatgtggtgctcagaagaatgtatattctgttgatttggggtggagagttccgtagatgtctgttaggtctgcttggtgcagagctgagttcaattcctggatatccttgttaactttgtctcgttgatctgtctaatgttgacagtggggtgttaaagtctcccattattattgcgtgggagtctaagtctctttgtaggtctctaaggacttggtttatgaatctgggtgctcctgtattgggtgcatatatatttaggatagttagctcttcttgttgaattgaattgatccctttaccattatgtaatggccttctttgtctcttttgatctttgttggtttaaagtctgttttatcagagactaggattgcaacccctgccttttgttgttttccatttgcttggtagatcttcctccatccctttattttgagcttatgtgtgtctctgcacatgacatgggtctcctgaatacagcacactgatgggtcttgactctttatccaatttgccattctgtgtcttttaattggagcatttagcccatttacatttaaggttaatattgttatgtgtgaatttgatcctgtcattatgatgttagctggttactttgctcattaattgatgcagtttcttcctagccttgatggtctttacaatttggcatgttttttcagtggctggtaccggttgttcctttccatgtttagtgcttctttcaggagctcttgtagggcaggcgtggtggtgacaaaatctctcagcatttgcttgtctgtaaaggattttatttctccttcacttatgaagcttagtttggctggatatgaaattctgagttgaaaattcttttctttaagaatgttgaatattggcccccactctcttctggctcatagagtttctgccgagagatcagctgttagtctgatgggcttccctttgtgggtaacctaacctttctctctgaacattttttctttcatttcaactttggtgaatctgacaattatgtgtcttggagttgctcttctcgaggagtatctttgtggcattctctgtatttcctgaatttgaatgttggcctgccttgctaggttggggaagttctcctggatagtatcctgcagagtgttttccaacttggttccattctccctgtcactttcaggtacaccaaacaaacgtagatttggtcttttcacatagtcccatatttcttggaggctttgtttgtttctttttactcttttttctctaaacttttcttctcgcttcatttcattcatttgatctttgatcactgataccctttcttccagttgattgaattggctactgaggcttgtgcattcgtcacgtagttctcgtgccatggttttcagctccatcaggtcatttgaggagttctctacactggttattctagttagccattcgtctaatcttttttcaaggtttttagctcctttgcgatgcgttcgaacttcctcctttagctcggagaggtttgatcgtctgaagccttcttctctcaactcgtcaaagtcattctccgtccagctttgttccgttgctggtgaggagctgcgttcctttggggggggagaggtgctctgatttttagaattttcagcttttttgctctgttttttccccaatctttatggtttcatctatctttggtctttgatgatggtgacgtacacatggggttttggtatggatgtcctttttgtttgttagttttccttctaacagtcaggaccctcagctgcaggtctgttggagtttgctggaggcccactccagactctgcctgggtatcagcagcggaggctgcagaacagcaaatattggtgaacagcaaatgttgctgcctggtcattcctctggaagcctcgtctcagaggggtacccggccgtgtgaggtgtcagtctgcccctactggggggtgcctcccagttaggctacttgtggatcatggacccacctgtcactgaggaggcagtctgtccattctcagatctcaaactctgtgctgggagaaccactactctcttcaaagctgtcagacagggacatttaaatctgtagaggtttctgctgcctttgttcggctatgccctgcccccagaggtggagtccacagaggcaggcaggactccttgagcttcagtgggctccacccagttcgagtttcctggctgaggctgccgccttgtagttcaatctcagactgctgtgctagcaatgagtgaggctccatgggcatgggaccctctgagccaggagtgggatataatctcctggtgtgccgtttgctaagaccattggaaaagcacagtattagggtgggggtgacccaattttccaggtgctgtgtgtcacagctttgcttggctaggaaagggaattttctgaccccttgcgcttcccgggtgaggtgatgccttgccctgcttcagctcacactcggtgtgccacaccccctgttctgcgcccactgtccgacaagccctagtgagatgaacctggtacctcagttggaagtgcagaaatcacccgtcttctgcatcgctcatgctgggagctgtaggctgaagctcttcctattcgaccatcttggaaccgcttaattttgtatctttagtagagacgaggtttctccatgttggtcaggctggtctcaaactcctgacctcaggtgatctgcccaccttggcctcccaaagtgctggaattacaggtgtgagccaccactcctggccttatttttaatatatccgttaaatttgaaaagtcacaattttggcctggcacagtggctcacgcctgtaatcccagcactttgggaggctgaggtgggcggatcacttgaggtcaagagttcgagaccagcctggccaacatggtgaaaccccatctctattaaaaatacaaaagtttgccaggtatggtggctcatgcctgtaatcccagctacttgggaggctgaggcaggagaatcgcttgaacacaggagacggaggctgcaatgagccaagattgtgccactgcactccagcctgggcaacagagtgagactccatctcagaaaaaacaaaaagaaaagaacagtcacaatttcatttttaccataatatatctcatttttctcatgctgaacagtccagggagaaaaataataataaagtatatcttattttcttaatgactttatgttaaccagtttgagggagtggctgtggttttcacatttcctgttttgttctgaatttaatttaggtcttaaacagtgaaaattttatttaagaaaattgataggccgggcatagtggctcatggttttttttccgcttaacacttttttctttttgctcttgttgcccagactgcaatgcaatggcacaatctcggctcactgcaacctctgcctctgggttcaagtgattctcctgtctcagcctcctgagtagctgtgattacaggcatgcgcaaccatgcccgactaattttgtatttttagtagagatgaggtttctccatgttggtcaggctggtcttgaactcctgacctcaggtgatccacccgccttggcctcccaaagtgcagggattacaggtgtgagccaccatgcctggcccgcctaacactttttttgagacagtcttgccctgtcaccaaggctggagtccactggtgcaatctcagctcactgcaacctccaccttctgggttcaagcaattctcatgcctcagcctcctgagtagctgggattacaggtgtgtgccaccatgcccactaattttgttattttttggtagagatggagtttgccacgttggccaggctggtctcaaactcttggcctcaagcgatttgcccatctcggcttcccaaagtgctggggttacaggtgtgagccaccacacctggccaagcctaacactttggaaggccaacatgatcagttagcttcagcccaggagattggaaccagcctgggcaatgtagggagaccccatctctaccaaaagttttaaaatcagccaggtgtgtgtggtggcacatgcctgtagtcccaactgcttgagagtctgaggcaggaggattgcttgagcccaggaatttgaggtggcagtgagctgattataccactgcactccagcctgggcgacaaagcaagaccctttctcttaaaacaacaacaaagaagattgataatttaatttttcatactatcagttggttatacaaaaaacttacttttgaaattttaaggaattaccactattgaaactaatattttgtcacagatgttgatatacttaatcagaaatgtccagttttagccaggtggctgtgcactcttgtagtcctagccactcagaaggttgagtcagaagggttgcttaagcccagaagtttgaggccagcctaggcaacatagtgagactcacgtctctttaaaaaacaaagaaagaaatgttcaattttggttttctttttaaaaatagctgtttagaagtagatgattgcaggccactaagtagacttgtgacattgccccaagtttcattaaaatgggtcttcattaatttttggaaattcaggaacctttgttataccttgatttttacttgttttgatttgttctgttatttttctggaaatcggtttacgttaagattacttaaaatttgcatattttcagaaattgggcaaatggttatggtcatactagtaattttttaataaaaatttttttaaccttaaaaagtttagactttttatttaggattcatttaggttcagcctagtgaggggcgtatagctgctgggttaaacataagagactctgggccaggcacagtggctcacgcctgtaatcccagcactttgggaggccgaggcgagtggatcatgaggtcaggagttcgagacccacctggccaatatggtgaaaccctgtctttactaaaaatacaaaaattagctgggtgtggtggcgcgtacctgtagtcccagctgtttgggaggctgaggcaggagaatcacttgaacctggaaggtggaggttgcagtaagccaatacagagccactgtactccagcataggggaaagagctagactccatctctacaaaaaaacatagactttggagtcaaattgcctggttgttggatcccaggtctgagttttactgtttgtgtaacctgggataggttatttcacatctctgagcctcccttttctcacttatggaatggagataataactgtatccatctcatagtgttattgtcatttaaatgaggtactatacataaagcttttagagtagtgcctggtagatagtaagtgatcagtaaatgttaaatatttgcattaaaccttcacttgtgtgacttaaagacaatttgtattgtgagtggaatctaatgaaatgtacaaatgtgctgtgtccgtgcttcacctaatgctgatgcaggtcagctctgagagcaagggtgaggcgatggcaaaggggcttgagaaaagtcgtgaggaattcaaatagctggtttggggaaatagaaaaagagcctaccaaggacatgtggtaggccacaagggctaagtgaggttggagaccttgagcctgtcaacattcattaaaaagttgaaagtacagagttcatggttgctgcacttggaaaatacaaacgtgagtgatccttttgaattgaccttacaaaggattttccagttcattgatcctgcagtctccaggcagtttaaagtaatatgaggccaggcacggtggcttatgcctgtaatcccagcagtttgggaagccgaggcgggcagatcacgtgaggtcaggagtttgagaccagcctgaccaacatggtgaaaccccatgcaaaaaattagccaggtgtggtggcgcatgcctgtaatcccagctacttgggaggctgaggcaggagaatcgcttgaacccaggaggcggaggttgcagtgagctgagatcgcgccattgcactccaggctgggtgacagagtgagactctgtctcaaaaaaaaaaaaaaaaaaaaagtaacatgaattaacaagtgtaactgtgtcttccttactttatataatagatgtcagagacttatggttgattactaacttaaaatcatgaggcactttaaactctgtcttaagtataaaatgttttcacataattgtgattttaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtaaggataattgtgccgagattgagatcttagtgaattcccagatttaaaaaattcttatagaaatgccttttggctgggtatggtgtcttatgcctgtaatcctagcacattgggaggtcgaggcggatcacttgagctcaggagttcgtgaccagcctgggcaacatagtgagacatcgtctctaataataataataacaacaacaaagataataacgatcatgacaactaaaaaaaaaaggaaaagcctttttctgtttttggaaattgaatacatccaccaaactttttaaagaggaaagtaagtgcggatatatggtaatatggatatgtagtaattattatgtaatggtgatgggttttttgttttgtttttgtttgaggcaggtcttgttctttcacccaggcaggagtgtcgtggtgtgatcatggctcactgccacctcgacctcctgggcacaagcaattgtcctcttttttttttttatagagacaacctctcactgtgttgcccaggctggatggttaattttttgacggtttactgttttaatctctataagttcctgtatgttttaagttaggagaataccccaagaaaagatgcatttgttaaaaatcaaaagtgtcaagctgagttcgttggctcaagcctgtaatcctagcactttgggaggccaaggcaggaggatctcttgagcccaggagtttgagaccagcctagacaacatagtgatacaccatctctacaaaaatttaaaaattagcctggcatggtggcacacacctgtagtcccagttactcaggaggttgaggtgggaagatcacttacttgagcccaggaggtcaaggctgcagtgagccgtgattgtgtcactgtactccagcatgggtgacagagtgagaccgggtctctagggggaaaaaaattaataagtaaaaatgaattcacattttttgaatactactttagggttcttgcaagcagaatttttaaaaattgtatctacttacacattaaatactacatgagactattccttttgggaaaaagactggtgttctgttccagcctttcacatggaaattaggacaggtggctggcttgcttctgataaacttctgccatgtgaaggaaggaaggcacaatctctcagttagaagtggaaggaatgtgtgtggtgtaccagttaaatcctcaggtttcacttccccaggaatggcagggcgcagcacaggcacctagtaacgtagatacttgctttggtaaattgggttttatgaaaaaggtgttgcataatgaggaagccagaaactggtttaaacacctttagcgtcatttagaacctcatttacaattttatgtttctcatttgttgttcaataaaatggcgtctaaataaataagactttacactgcaaaagaggaagagacttggcaaagtctgtgattgtgtttttgaatacttaaaaatgtaatcagtatttttaaggtaaaccctaaacatttacttaaatccagtttgttaatgtgagaaattctacagcttgaagagcccttgaaatggccagggaaataaagtaggagtggggaactattatagattaaaagagattttagagacagatgaaatgaatggaccttgtctggctcttgctgagtgaataaaaaccaaaccccaaagaatatatactcatttatataacattcctgaaatgacaacatgatcaagatggagaatagagtagtggttgccaggggttggagtcggagttggggcttggggaagaggttctgtattttgactgtggtggtaaacaaaccaacccacaataaaagtaaatacatacatacgctcaaatgagtagaagtaaaatgggattgtttcaatgtcagttccctatagttgtgattgttgggctatagttttgcaaaatgttaccactggggaaaactgggtgaaggctacacaggatctttctgtattatttcatacaactgcatgtgaaactgcaattatcttagaataaaaagtttcatttttattatttatttatttatttatttatttattttttgagacggagtcttgctctcgcccaggctggagtgcagtggcgtgatctcagctcactgcaggctccacctcccgggttcactctagtctcctgcctcagcctcccaagtagctgggactacaggcgcccgctaccatgcccggctaatttttttgtatttttagtagagacggggtttcactgtgttagccaggatggtctcagtctcctgaccccgtgatccacccacctcggcctcccaaagtgctgggattacagacatgagccaccgtgcctggccaaaagtttcatttttaaatagtactgcaattatagtattttgcaactaatatgattaatataagcaaagcttagattgagatataaaagtagtgtaaatctttaatgtgctctgcatttaagtaataaaagatttgttaacaatgagaacacttaattcaagtgctaattattctgctttatatataaaaatattacctggaaaagtaaataaatcatttacttcttatttgttattttctaaaaatctttccttttcactcctgccattttacaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcattaataccttctaggggtttggttcatttggtttttgtcatgtgcaaggaaggacaatagtcctctttccaagtgtgttagcatagacttctctatatgtttctactagacctaggggatgacgtcttttaataatactggccctaaacatgtaaataatcttgtaggtgagactttttcttttgtgtttcggaaatttcctatgtggctttcagttgtctgtttgtatagcctggatttttttgaggtaaatgaaactttctcatttgt

SEQ ID NO: 8041 - DNA, 1367 bp, Homo sapiens
atggtcttaatattatctttccacgaaatggatatatttctagaaaatatatatttactaccataatttctaccaccacccccattttgctctgcattatacacagtagagaagaactgaagacactgctgtgacagtattgcagtccaaggcatcatgtgctcttggtgggatactctgattatcagcatcaacagtactttactgagcaagactttgaaggcctgagaagagagcaaagttatggaaagtatttaactcttattttatattgaacaaacaaggtttaatcatgtcatacatttttggttttctaagcagagactaatacaaatgcagccacataaaggcagtgtactgggggtgggagggaaggaaacaatcacataaaatcagctgactcaaaattgaggatagttaataggttgaaagggaaaaagtatgttgaaaatttagacataaatgaaccaagaatattccttatctggtgatgattaaagttaggaaaacatacattttttattttttaattagtagctgctatcagagacattatagcacagtggttatgagcacagattccaaagccagattacctaggttcggagacccgcttctctacctactactaatagttgggtcatgttgggccggtgacccaaattctagccttcattcactcatctgtaaaatggatataatgatagtacctactttataggttgttatgagaattgaatgaaatgaaagcccttagtttctgacacatagtaatcttttatataaatgttagttactattctgataatgatgatgctgttggttatttcatcttgctttgtcattaggtttgattctgaatactatacaaactaattttgatttcaagatcttaagtaaaggtttatttatagtacattggaaagcatgtttgtagacatgtattttgtgtttggttcctcaacttgctttgtatatattttataatactaggttgatataaaagtaaatgcagtttcgccatttcagtggcaaaaaccgcgatttcttttgtgccaacctaatgcttaaggatataatctgtgtatattgtatttcagattcatagcaacctaataacaaggatttacaaaagggtttttacttccctacttttttttggctgaaggaaggtttttgtattgacttggtttaacttacaaatcagaactttgaaaccaagaaacattatccttatttctctgctatataatagtaaacctgtttttttccagtgttctttttttttttttccagagaattgggactgaatagtatgaaagtgaaaatggaaataaattaattattaatcatcatcatatcaataa

SEQ ID NO: 8042 - DNA, 272 bp, Homo sapiens
tgggcgctgtggctcacgcctgtaatcccagcactttgggagtctgaggcgggtggatcacgaggtcaagagatcaagaccatcctggccaacatggtgaaaccccatctctactaaaaatacaaaaattagctgggcatggtggcatgcgcctgtagtcccagctacttgggagactgaggcaggagaatcgcttgaacccgggaggcggaggttgcagtgagccgagatcacgccactgcactccagcctggcgacagagcgagactcca

SEQ ID NO: 8043 - DNA, 1628 bp, Homo sapiens
gaaaaaaaattttggctgggcacggtggctcacggctgtaatcccagcactttgggaggccgaggccggtggatcacctgaggtcaggagttcaagaccagcctggccaacatgacgaaaccccgtctctactaaaaatacaaaaattagctgggctaatttcacatctgtgaacattttatcgccttcatcataaatatgaggcacagtcctccattaaaaatttttttttttctttgaggcaaagtctccttctgttgcccaggctggagtgcaatggtggctccctgcaacctccgcctcctgggttgaagcgattctcctgcctcagcctcccaagtacctaggataacaggcacccaccaccacgccctgctaattttttgtatttttagtagagacagggtttcaccatgttagccaggctggtcttgaattcctgacctcaggtgatccacccaccgcagccccccaaagtgctagggttacagacatgggccaccgtgcctggcctccccattttttttttttgagacggagttccgctcttgttgcccaagctggagtgcaatggcgcgatctcggctcactgcaacctctgcttcccgggttcaagtgattctcctgcctcagcctcctgagtagctgggattacaggcttgtgcccccacgcctggctaatttttgcatttttagtagagacggggtttcactgtgttagccaggatggtctcgatctcctgacctcgtgatctgcccacctcggcctcccaaagtgctgggattacaggcatgagacaccatgcccggcctccccattttttttaattagaaaatccaaaaacaattttttgtcagcttgagtacacaaacttttaggactataaatggaatggttgaatatcttcttatagcacttagttattaatttactcatatcaagtatttttcaatgtatggatttagaaacactttttcatctcattttattaaacatcagttttcagagcacagttatgtttacttccatttaaaaggtttatgagggtctgggtacggtggctaacgcctacaatcccagaacttttggaggccgaggtgggtttatcacctgaggtcaggagttcaagaatagcctggccaacatggggaaaccccgtctctactgaaaatacaaaaattagccaggtgtggttgtgtaggcctgtaaacccaggtactcaggaagctgaggcaggaaaatcacttgagcctgggagatgaagtttgcagtgagccaagatcacgccactgcactccagcctgggtgacagggtgagactctgtgtcaaaaaaaaaaaaaaaaaaaaaaaaggctgggcgctgtggctcacgcctgtaatcccagcactttgggagtctgaggcgggtggatcacgaggtcaagagatcaagaccatcctggccaacatggtgaaaccccatctctactaaaaatacaaaaattagctgggcatggtggcatgcgcctgtagtcccagctacttgggagactgaggcaggagaatcgcttgaacccgggaggcggaggttgcagtgagccgagatcacgccactgcactccagcctggcgacagagcgagactcca

SEQ ID NO: 8044 - DNA, 1366 bp, Homo sapiens
atggtcttaatattatctttccacgaaatggatatatttctagaaaatatatatttactaccataatttctaccaccacccccattttgctctgcattatacacagtagagaagaactgaagacactgctgtgacagtattgcagtccaaggcatcatgtgctcttggtgggatactctgattatcagcatcaacagtactttactgagcaagactttgaaggcctgagaagagagcaaagttatggaaagtatttaactcttattttatattgaacaaacaaggtttaatcatgtcatacatttttggttttctaagcagagactaatacaaatgcagccacataaaggcagtgtactgggggtgggagggaaggaaacaatcacataaaatcagctgactcaaaattgaggatagttaataggttgaaagggaaaaagtatgttgaaaatttagacataaatgaaccaagaatattccttatctggtgatgattaaagttaggaaaacatacattttttattttttaattagtagctgctatcagagacattatagcacagtggttatgagcacagattccaaagccagattacctaggttcggagacccgcttctctacctactactaatagttgggtcatgttgggccggtgacccaaattctagccttcattcactcatctgtaaaatggatataatgatagtacctactttataggttgttatgagaattgaatgaaatgaaagcccttagtttctgacacatagtaatcttttatataaatgttagttactattctgataatgatgatgctgttggttatttcatcttgctttgtcattaggtttgattctgaatactatacaaactaattttgatttcaagatcttaagtaaaggtttatttatagtacattggaaagcatgtttgtagacatgtattttgtgtttggttcctcaacttgctttgtatatattttataatactaggttgatataaaagtaaatgcagtttcgccatttcagtggcaaaaaccgcgatttcttttgtgccaacctaatgcttaaggatataatctgtgtatattgtatttcagattcatagcaacctaataacaaggatttacaaaagggtttttacttccctacttttttttggctgaaggaaggtttttgtattgacttggtttaacttacaaatcagaactttgaaaccaagaaacattatccttatttctctgctatataatagtaaacctgtttttttccagtgttcttttttttttttccagagaattgggactgaatagtatgaaagtgaaaatggaaataaattaattattaatcatcatcatatcaataa

SEQ ID NO: 8045 - DNA, 9321 bp, Homo sapiens
gctcccggagccctgcctgttccctgtccatccaggccagcagctgaaggagcctcacctgcctcccttctctgagtagcacggatttgaggtaagaaatcccccagaacccccattcccagtgcagcctgtggcagagatcggtccagtgtctcctccgactgccttagtgcccgctaaacgtttggggaggggagagctcggtgccaaactgctctcgtgtggggcaagtgctgagttaggctccttgggggactttacctcactgggccctgcttcctgggttctgtccttgcccttcagcttccaaacagggaagagcaggtgactactgagaggtgaggatggtggctctgggctaggtggccctgggaaaggtgggggatccccagtgcctggaggcagacccttctgaggatggtcacacgccttgtgcagcatcttggccaccccacagggctgaaggagaaggaacctggctgggagcttagttcatgtctgggttttccctccatgtccaggagaagcagcgaagatgtccagcgagcctccccctccttatcctgggggccccacagccccacttctggaagagaaaagtggagccccgcccaccccaggtagggggtcactgttcctgaggctccatattgcagccccctgccgccatggcatggttgggactctctaagtggtgatgcccactccagggttacccctgggccccatctgtgtcccaaaacagtggcctctggtcgagctcatcgtgcagaggctccagctcagtctcctctttctgcctctctctgtccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtgagtggggaagggatctgaggggagcatggggaactcctggctgctgtctggcctgcgctggctgtcctcagtacaggtgggcatctgctgtagggcagggactccaacacgcccaaccagcccttgcctagggctcaggctgtgtgtggacagggactgtggacgtgggaaggtgggactgctcttattcaggctggtcaggaagggctggtccttggcacaccaggacctgacatgggtggggaggggcgccttgtgtgcaggagaggggtgggtgacccgcaaggctttccctctcttggtcatgggcttgaggctgagtgccctgtccttgcatgctggagacagacagaggagcagagggaccgggccatgtgcctggctctctgccacatctgtcatgggccccaaggggtggggaccaggaagggctgggagaatgtggccccacttgacttagggccccagctgtaaggcctcccactggcccgttaggagggcggtaggaggtctgaggcgtagccttgcacgctgggcgctgtggaccgtggggctttgcgccaatctctttgtctggtgcaggtggcaggccagtgacctctcgcctccatcttctgtgccattccaggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatggggtaggtggtgtgggcactggtagggtgggggctgcaccagggtcaactggctgcctctgcctcctccgcagcaggcctcagcctgttcttccctgtctctgattcagatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgacaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaacacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggtagtagattcctattaataaaattatttaagttcatgtttctcttttagagaatgaattgtttaaatacaaatatgtgcttttttaaaacccttatttttaaatatatatatatattttaaaaaaaccttttaagtaggaaacctctaaggtatttctgagctaaaaaatagcagtgctggatacactttaaagatctttgcaagacggttagagtgactttgctttggagactagaggtgctggagagtagacccagagcaggaggtggctgctgggagccatgatggacgatgtccactccccacacagacataacatgcccttgcttctgagggactctcctatggggaggtggcttgacccacccggtgccaggaggcagggaaggaggtagcttgcaaagcccactttattgagtgctggagcatttacacagcgcggaggaggagataagctggggctgagcaaaccgcacccaaggggttagagggattctgggtgagagggatgagctcccaaggcctctgaggcttccacccacacccaccctcactcccagggtccaagagaggcccagaagttgtacagcagcatccagcaaggccccctcgcacagcttggacttacaggccactcacctccaacaggggagatagtcacccatgtactgcaaaaacagggactaccggaagcagcctagggcccagaagtgtggaagcctggagtagagctgggtcgggggccaggcttgctgcactgtgccgactgctcccagggtgacggcctgtgcccagtgcggaatatggcccatagagaggatgctgtcaggcagaggctctagcatctggcttttattggttgcctttcttaaacccagcattttttaaaaagtcacctgaggtggtagtttagtcagggctggagaaaggggtaggccagtggtcagtcgggaggagggtaccggtgtggcatgatgggtgcttcacatgtagtaccaggccaagagtccagcagctagggccacaccagcggccaggatgaactggaggctgggcttcctcagcacagccatagctgttcggaagggacagctgctgccctccagggcacctgtgtggcagcaccaataggagacatggcatcagtggagtctcctgctacacctgccccaggaggggagctcaggacacacagacctacctttgtcttgttcagcagcgtagaaagggcatttacgcatgtctcctttcccatcgtgtacagggaacccatcctccaaggtctctctggccagtgtggagccggcctggtccagttcattgaatatctgcaggagcagaggatcgactgagccatctttgggctgcccatactttttttttttttttaaatgtcttttgagatgaggtctctgttgcccaggctagagtgcagtgttatgaacatggctaactcactgcagcctcaaactcctaggctcaagtggtcctcccaccttatcctcctacgtgtgtgtaccaccatacctggctaatttttaaattttgtggggagatggtgtctcaccttggttgcccaggctggtcttcaactcctggggtcaagtaatgcccctgcctcagcctcccaaagtgctgggattacaggcatgagctactgcgcctggctacactctccttttagaggacgccctccagagagagtgagctggagcaggtgagcttgctcaggtgtgccaactacacagcaagcagcactggtgggcggcagctgcactgcctgatggtcttccctccctagcaagagctctggggaggtgtggatattggtaccccaagaaggctgccaaatgctgggtctcccctgggaactgaccagagatgtagccttctctgaggtggctcaagccactgaaactaccacagcacagacaggagggcatgagtacatccccatttctaggtgctggttatttttttatcaagaagcaacagaaaacctggaacatgggagaatgagactgtggcagggcatactcatcctgagtgccctgggaggcctcagtggaagctgacaggacctggggacagagtaagcttccccaggttcagcctcatctaaaggctacttgtaaacagagcttatttactctccttggtggcactggctctctattaacttataaagcagggcttctcagagcaaaacttgaaaagaaaattaaccattcttcaagaccagcatcctgcaatgagggaggaagccagctccattcttccagacccctctatgtgcgagaggactcacccttcccaaaacactacccactggcatctatcacaccaggcctccatgctgggaaccacccactgggcccacaagctctggtggccaatctggtggccaccttcctctcggcaccctgcagctcatctgtcctaatgccatgtgtgccttcatgggccactatggatctgctaccactgtcaaagtttccctcttcagccctagcagctggcagcccccaatagtacctgcatgttatactcaaaagccttgttggcctcctccacgatcctctctttggtcttcatgttcaggtccagggcgttcatcctggcccggtagagctgcttgaactgctgggcattgtccacattctcaaacaggtagaactgggtcccttcccctgtgctggggagtttcagtgctcgctgggccaccttcttcagcacctggccccccgagagatcccccatgtagcgggtgtatgcatgggccaccagtagctccggctcgttctgccctatgtagtggatccgctccacgtacttctgggcagccttggggcactgcacctgctcctcccagttttcaccaaagaaatactccatgtccttggtcagcgcctccttccggtgcagctccatggggaagtacaaaggggcaaaggctggatggtccttgttgcgctccatttcctcctcgagggctgagtatgtgaagtaaagtgccgtggtggccagctgtggaggtgacaggaggaggccagctatgcctgagcacaccacatccgagcagctggatgcagaggctcaagtgacaacccccaaccccaaagacccaatcctatggtccatttttatgtagtgaattatttaacacacaaggaagcttttgtttcttaaaggaatggcatggtgaagtctttggaacacgcatacttttgcttccttcacaccactatgttattctatctaagccatgagaaccaattttttttttttttggcggggtaaagagtctcgctctgtcacccaggctggagtacagtgggacgatctcggctcactgtaacctccgcctcccaggttcaagtgactctcccacctcagcctcccaagtagctgggagtacaggcacgcgccaccacacccggctaatttttgtattcttagtagagacagggtttcaccatgttggccaggctggtctcaaactcctggcctcaagtgatccacctgcctcggcctcccaaagtgctgggattacagacatgagccactgtacccagccgagagccagagcttaacgtcaagaaggaatggagtgtggagaaaagcccagcttttccctcagagtggctccaggggcacttttctcatgggaccaaggcccccaccccaaccccatatgacagtctggaacccaatgcggggcacaaaccttaaacagctccttcttaatgttgcctttcaagaagtccttgacaaactgggtgttttctgcccggtcgtgtgcttccttggtcccttccttcaggagctccgagaggtcagccattctgtggagagatgggaggtgtttgtgtgtcaattagcccttcccagctttccagaaaggaccatagagagaagattgagtccacaccccaaggtgaccacctgttgtactggaggctggggcttctcagacacttcactccaacacaaatagcagcaacttgtcagggaacacaggacaagcagacatgacattctgctccaaggactcaggacacaagggataactgtggcctgctccttgagagtagtacccacgtccatgtgtctgtgttgggaaccacccaaatgagcaatgctttgcttctgtggccacctagtggtcgaagagacacacatctgtattcccttcagtatttgctggcttctctaagaacagcctgccttggaacgtgtcttctggaattcacacacctcagtaaggctgtgaccatgggtctcctcagatggccctactgccttcctcccaccttggacccacagcttctttgagactatatgtgactaggaccaagcacggaaggatgcaaaggagacaaccgagaggctagggccaggacgctgggtttgtgctgcttaacgaaattacacagttgtaaaggtgtgtggatggatggacaaggtagaaaacatgtgatcctaaagatggtggtacttgggcaggggcttacatgtgtccacacaatccatctacaagagtgagaaaaatttggccttatcatggtctggcttctgctgtcttctttaggagattagctcgttatcatccatgtgctgagaatcaatttattattagcaattatttcaagggataaaaaaaaaacttggccaatgacagggctatgagaggctaatgatgcagaacagggcctggaagctcaggtttagcatgagctgtccctatacagagtaaggaaaggctgccctgcagtcttttatgtggtaaaagactgaacagagccagctttgcctgcgtttaccctttctcagcccagatgaggaaacgcacaagtttttaaaaagaaaaaaggataactaccatcaaatcctatcagcactcccaggagcacctgccctgcctccttggatgagacaatggaccagtggggagagttctaagcagccgaagctgtatgcggtccctgcagggccaagcaggcacccaggggtccagagctcatggcccatggccactccccagtgctgccaacagacaaaaccaggtgtgctgagcacgacaggtgctgggcccacctgattcagtgcagccagcccccatcgctcacctcatttggttctccttttctagggccccagagttctttttttctgactcgtctaccccctctgaggtttccacttccgctgacattgctgctgggtgtggttcttgctgctctcgctcctctggtcctgcagagacacaaggagctggtgatgtggcacccacggcagtcacttccccaaatacctgtcggttctgctttcctcagagcgaatgtaaccaaggtgacacccacacaccccaggattgttttctttaaaataaagc

SEQ ID NO: 8046 - DNA, 1236 bp, Homo sapiens
taaaaataagttttattgacataatttacgtaccattcaattcacccatttaaagtgtacaattcagtggtttttagttattcacagaatcgttcaactgttgctacaatcggtttcagagcatcttcgttaccccagaaggagattccatgttccccatttcccctctcccccagacctaaacagctactaatgtactttccgtttctatgggtttgcctattggggacatttcatataagtgaaatcatacagtatgtggccttttgtgtctggcttctctcaccaagcatgttttcagagttcatgctgtagggtgtcagtgcttccttcctttttatagccgaatcgtcttccattgtctgggcagcctacggttttgtttatccactttgttgatggacatttgggttgtttccactttttggctattatgattcatgctgctgtgaacatttgtgtacaaatttctgtgtagacaggttttcatttcttttgggcagataactaggggtggaattgctgggtcatctggtaactctaggtttaaccttttgaggaactgccagactgttcctcaaaaggggaacaggggctggcagttcttcaaaaggtttgcaggggctgtcccctaccagcagtgtatgagggttccagtttttctacataatgcctattactgtctttttaaattttagccatcctagtagataggaaatggtctccttgtggttttggttttcatttcccttatgaaaagacgctcagtagtttttcatgtgcttttggccatttgtcttttgagaagtctttgttcaaatccttttaaaaattgggttgtctttctgttattgagttgagttctttgtatttcttaatacaagtcctttatcagatctatgaattataaaatgtgatggtatcctttgaagcacaagagtttttcattctgatgacatccactttaagttttctttcttttgttgctttgcttttggtgtcatatctaagaaaccactgcctaatcgaaggtcataaagattgatgcctgcattttcttctaacagctttttgatctctttcagttttcaaacttccatggtactttatagttgaacccaagagcttggacttggttcctctggccctgcccctgatttgttaaactttatattcaaacttatgtgccctccatcccctgcaggtgctgggctgtctgggaaacactcctttccc

SEQ ID NO: 8047 - DNA, 771 bp, Homo sapiens
tgctaatcaccctatggaaagaataataaagcatggaatgaacaagcaaatagcaagagctcttcaaagaaagttgtcattaacactttacagagaatagaggtaggctcccccaggaaaagtttgcataaatagccctggagcagctgagaaagaggaaatgaatgacattcaattaactcctaatttgctgttgcagtttctcctgaactgagttcactccagaatttaccaagggatcaggctgcttaagaactaattacaatgaattctccatgagcctgctgacagtctgtcctttctatgtaagtcctggggttgttgccagccaaaaaaccttaggcaaagttgtcttcttttagtaaaggttttccagcctccctttaatttttaccaagaaaagcacagcatatcaaggcgttagacagctttattatttctcttaatgtcaagttatcaaaccccttagaagcctggagagagaggcaggtcatggtggctcacacctgcaatcccagcattttgggaggcctaaatgggcagatgactcgaggccaggagttcaagaccagcctggccaacatgttgaaaccctgtctctactaaacatacaaaaattagctgggcctggtggcgcatgcccataatcccagctactcaggaggctgaggcaggagaatcacttgaacctgagaggtggaggttgagtgagccgagttcatgcagcctgggtgacagaataaggctccatctcaaaaaataataataaaa

SEQ ID NO: 8048 - DNA, 771 bp, Homo sapiens
tgctaatcaccctatggaaagaataataaagcatggaatgaacaagcaaatagcaagagctcttcaaagaaagttgtcattaacactttacagagaatagaggtaggctcccccaggaaaagtttgcataaatagccctggagcagctgagaaagaggaaatgaatgacattcaattaactcctaatttgctgttgcagtttctcctgaactgagttcactccagaatttaccaagggatcaggctgcttaagaactaattacaatgaattctccatgagcctgctgacagtctgtcctttctatgtaagtcctggggttgttgccagccaaaaaaccttaggcaaagttgtcttcggagagtatagggggtccagcctccctttaattgtatccaagaaaagcacagcatatcaaggcgttagacagctttattatttctcttaatgtcaagttatcaaaccccttagaagcctggagagagaggcaggtcatggtggctcacacctgcaatcccagcattttgggaggcctaaatgggcagatgactcgaggccaggagttcaagaccagcctggccaacatgttgaaaccctgtctctactaaacatacaaaaattagctgggcctggtggcgcatgcccataatcccagctactcaggaggctgaggcaggagaatcacttgaacctgagaggtggaggttgagtgagccgagttcatgcagcctgggtgacagaataaggctccatctcaaaaaataataataaaa

SEQ ID NO: 8049 - DNA, 771 bp, Homo sapiens; identical to SEQ ID NO: 8047

SEQ ID NO: 8050 - DNA, 1489 bp, Homo sapiens
gaacataatttaagtatatagttcagtgaattttggtaaatgtatataccatgtgatgactacaccaataaaaatagtgtgtgtccatcaccccagaaagttcccttgtgcataccccacttgtagtcaattttcctattcctgccccctgctgtaggcaactaatgaaatgctttttatcactatagattaattttgctgcttcttgaactgtatatgtatagaattttacagtatgtactcttgtgtctgatgacttttgcccagtttaatgttttgagatgcatgcatatatcagttttactttttttaattgctgattattattatgtgtgaatatacaagtttatccattcacctattgatgaatattggagttgcttccagttttaggctactgtgaaaaagctgctctgaacattcatgtgcaagtgtttttgtggatatgttttattctcttgggtaaatatctaggaatagaattttgggtcatatggtaagtatgtgtttataagaaactgatgttattttttaaattggctatataatttttcagttggctttatatttctactaggagtgttccagaggctcctcatccttgccaacgcttggtattttcagtctttttagccattctactggagcagtagtattttattgtggttttaattagcacttccctgataactaataatattgacccatttcccatgtttctttttattatatgctttattttgtgaaatgtgtctatgagttttttatatattctaggtacaggtactttacaaatatttcccatttcttaataatgataccttggaagatcagatggttttaatttttaggaagtctgatgtatacatttttctaggtcactaattttgtgccctatgaaaactttatgtaccccatagtcaagtacattttttcctatgattttttaaattttataattttagccaaatagttatagtttttatgtttaggtctgtgattcattttgagttaaattttatggtttaaggtagaggtttgaggttcatgtttttttcctccgttttagttgttctgtagcagcatttattgcaaagatattctttctcaatggaattatactggcaatattgaaaatctgttatctggactctattctgttccattgatctatatgcattttctttgtatcattaccaccttgtcttgactactttagctttgtagtaattctcaaaatcaggtagtgagtccttcagctttgttctttttcaaaattgttttggcttatatctttcttatataaattttagaatcagatcatcagtttctgcaaactgagattgtgttgaatctgtagatcaattttgtgtcttaacatcccccagcaaagttagaaagccaggcagtaatatcagagggcacaagcccagattgaagctggaagacatagtgctccagaaaggtccttccaaaaaaaagaaaagaa

SEQ ID NO: 8051 - DNA, 151 bp, Homo sapiens
cccaaagatgaggcagcccccaggttagtttatttcatcagttcagggatctagtttctttctgttctgttccgttctatgttggctgccatcttggttgcaaggagatccaggcaacacatcttcagacaagatcctaggctagaagatg

SEQ ID NO: 8052 - DNA, 1130 bp, Homo sapiens
tgagcactgtgccttgtgtcagtagtcagtggtgttcctttagtccttgttatgttaataaaaaagctttggtttttgcaagactttgtttttagagattctggaaaggaacatattaaccaaaaagaagagctgacttcaattttacttgtcttgaaaataactgactactaaagggatgtcagggaacattagtgaaaatggagaacttaaggagttaaagttttagctgtttttttcaaaggatattgtccttcaaaatctttaccttgcatttttgttactgtgatttaagatggttgtaattatcattgattgatgatacctatcaaaaggcaaccctaaccaaccatttctgctggattctgaatgccgagaaagaaaaactgagaaatttgtgaactattacaagtcgtctgtaaaatgagataataatatcaacttcacaaggtaatttaggctttcgtgaaaactagagtgtgaaaatgcttagtaatgtgctgggcacactgcaggtgctctacaaataactactgataactactttttttcatgagtaattgtacattttctttcttccttcctttcttccttccttccttccttccttccttccttccttcctttcttttcttttcttttcttttctttcttttctttctttctttttttgttttcttttgttttgagacaagatcttgctctgttgcccaagctggagtgaagtggtgtgatcttggatcactgcaacctctgcctcttgggctcaagtgatcctccctccttatcctcctgagtagctgggacaacaggcgcacatcgtcacacccagctaatttttgtatttttgtagagatggggcttcacttggtgttgaattcctgggctcaagcgatccacccacttcgacctcccagcgtgctgtgattacaagagtaattgtaaatttaaaatgaatttctttcccatcccaaaccagtatcaaaatgcaaatatagtaaattactttttaaaagagagatgtttaatggcagttgttggtagtcttttgagtctttaagtgggtatattatagaaaaacaacatatctctgcttggagggaagatttaactaaaaacaagaaaaagaa

SEQ ID NO: 8053 - DNA, 1111 bp, Homo sapiens
cagtagtcagtggtgttcctttagtccttgttatgttaataaaaaagctttggtttttgcaagactttgtttttagagattctggaaaggaacatattaaccaaaaagaagagctgacttcaattttacttgtcttgaaaataactgactactaaagggatgtcagggaacattagtgaaaatggagaacttaaggagttaaagttttagctgtttttttcaaaggatattgtccttcaaaatctttaccttgcatttttgttactgtgatttaagatggttgtaattatcattgattgatgatacctatcaaaaggcaaccctaaccaaccatttctgctggattctgaatgccgagaaagaaaaactgagaaatttgtgaactattacaagtcgtctgtaaaatgagataataatatcaacttcacaaggtaatttaggctttcgtgaaaactagagtgtgaaaatgcttagtaatgtgctgggcacactgcaggtgctctacaaataactactgataactactttttttcatgagtaattgtacattttctttcttccttcctttcttccttccttccttacttccttccttacttgcttgctttcttttctttgcttttcttttctttcttttctttctttctttttttgttttcttttgttttgagacaagatcttgctctgttgcccaagctggagtgaagtggtgtgatcttggatcactgcaacctctgcctcttgggctcaagtgatcctccctccttatcctcctgagtagctgggacaacaggcgcacatcgtcacacccagctaatttttgtatttttgtagagatggggcttcacttggtgttgaattcctgggctcaagcgatccacccacttcgacctcccagcgtgctgtgattacaagagtaattgtaaatttaaaatgaatttctttcccatcccaaaccagtatcaaaatgcaaatatagtaaattactttttaaaagagagatgtttaatggcagttgttggtagtcttttgagtctttaagtgggtatattatagaaaaacaacatatctctgcttggagggaagatttaactaaaaacaagaaaaagaa

SEQ ID NO: 8054 - DNA, 541 bp, Homo sapiens
ttacatgttatcaataaaagtagcattttaacaattatcctttccacattatttgataaatgctattggttttgtctgttatttttataaatatataatttgctttaattacttaaatgttccttgagccttagaacttaaatcctgatgagggttttactttttaaaatactgaagtttattatttatgcatgttttacagaaaaatgagtggcttttaaaagatcaaaattaaaggcttaaacatggaatctctaggacatataaaatatgagtagaactgtgtatttataagatgttaatgtaagacttcaggccttgtaatatcttaaaggaaccacttcactgtaagggagcagtttgtctttctacctttccaattgtattgagattttgcccagtatgtctttttacttaaacaccttggtgaaagctatccagcatcctgttttaaatctcctttgttgcacttaccataattactttcagatctgtttccattctcagaaactgaaactgtaagctcatgtgagtggggaat

SEQ ID NO: 8055 - DNA, 6511 bp, Homo sapiens
cccgaacccccgggcctggggagctggaggaggtgccaagcgggcggaccaccgaggaggacctgggaggggaagtgttagggtaaacgttgggatcgggtttgtagttacctataaagtgattttagaaacacctgcgtggtggcagttgttgacgttcttgttcatcttttcagtcaccctccttccgtcccccattttttccttccatttgtttttcgtgttttacagtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccggtaaacatttaaacttgaaaacttatgatgagttttcttttgatctagcaaacgatatgctttttctcttttgttggctaattcctgcactttttaatttcttcatttgttgaaaatgttttcttctattgaaaacacttttgttcttcgggtatgtaaactcgagcatcctctactgggtggaaatttgcctctgcagtaacacaaacagacttcttgaaattacgaaaacattggaaagtataggcctttcacattagcacaaatgattgagcattttatgctataaagaattacatgcttattgtttttgaaatccaaatatttaaagatacaagactttttacatagaaagtaagacttaacgcattacggggcacaaatatttaatatctaccacaactaggttagaaccattaaccatatttggtatagttacctcatatttaccacaactaggttatatttggtatatttaccacaactaggttagaaccattaatcataattggtactgatttgtgagggagtgtaaaacacataccatttacttaaagtataaacgtgtaatggtaagtactagataggaatcataactgtcttctctgccgttgcaaacctgtagcctaacacaatatttggcaaatgagagctgtgcacttaaaaaaaaaaaaaaagtggaaaaaataaaatttattaaaacctagactttatcgtacttttcagaatttctgtggaatgtttaatcttctggatccatgactgtctgatacgttggcaatttaaagtccttttgaaagagagttcatgttacccagctattctctagtatgtattcatggaatactccatcgtttctgattacacttatgagacataattcttcagagcacacttagaattatttctctaacatatttatgcagacagaattccatcttgaattttatcaaattcactttaacttcttaagtcttggttattgtaagagcccaaaggtatggccccagggaacaattaagacttgatgatttgtcacctaccaaaatatgttcattatgtaaaggtttcaatgcccataaggctgtcatttggtatttagtgcagtgctcataaaagtgtgttattaggataaattgagaaattaattaagctgcttctagattaaataaatataaatatttggacaaatattgaagatacgtactttttccatcaaattttaattgaggttctgctgtatactagactctatgttcttgattttgttcttactagttaagtgaagtaagtattaacaaatgtaattattaattttaatgggaaaaggaaacaagtattagagaagtaagactttgcatatcttaacaccttttggaaaacggaggtatacatgcattacaaaataactttgaactgtatattttggctttacaatttaatgtcattgttgcttttagttgtatttggtctggtttttttttgtggtttttcctcagaacaattttggaaactatattcatcttcatatagaattatggcagtttataggcccacctgtttgaaaaaactttatccacagttgtgttcctaaaatcagttgtcccagaattgtgacaggaaagaagctcttttgaacttgaatgcatatctaagttagatgagattaatacaatttatatcctgaatgtaatttatatcctaaatgttgaactgtgattaggtttccctaaataatggtgacatctgggatagtttgagttctttctttatagtctaatttacttgaatttcgtaaaaatcaaggaatggacctgattgcgactggttagtaacttgttctagttttgccttcccttatatatttcaggtaagttaagattaatagacacacagtctactaatttgaattaagttttttgaagtatttgaagtgtttatatactgccttttattgttcattacttccagaatgaactgttgttataatactcatctttgtttcttttgtcttgaaagaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggagatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgacaggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggatggtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacgaaaagatacacaatcattctgttttttgaaattccatgtgattcaaactgctccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttccacgttaaaacttttgcctgtaagaatttgcacatgaatgttaatggaaaacacaaaactaaagatggcccaaaacaaaagccacaaacagttcatcatttggtgcttagtctttgtaagggctctctgtggtttgacttaccccagctaccgttaaatgaggacaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaaagattttgaaagcacattttgttttgtgagtcaatgacaaatatatttcctgattacaaaacagcagaa

SEQ ID NO: 8056 - DNA, 7424 bp, Homo sapiens
aaaaaatatccaaagtagggttagtacaggaaatttgggccattcacgagtaactccatattgagtgtgtgccaggcacagtcctaggcagtggggtccaggggacctcgctctcattgaagcgaggctggggaggggctggagctgggagtcacggagagatcagggaccagcgcgtcatgcatgggaagagggaagaaaaggagctgggaggtccctttaaaaggctgggcctggtggacggaacttcggtgcgacgctaaagtgtgcgcccgggaggatgagtacgctacacccggaagtgtcttcagggagaggaagccggcggcctcactgctatgggccgcaacaagaagaagaagcgagatggtgacgaccggcggccgaggctcgttcttagcttcgacgaggagaagaggcggtgagtggcaaagccggaccggactcccctcgagctgttcttcgcggccaaggccaggtctggggccgagcacgctcccgccgggggctcttccggtcccgccccctggcgtggctagagaacccctctcggccttccagcccgcgttcccgcttctcccttctcggccgccaccttctcccttcttgacctccccacctcgcctagtgtctgtgcgccgccagatagccggaagctcgggtctcagagcagtggcttcgaccaccctagcccagcccagtccatcggtccggcacacagcaggcgcccagccgtggttgataaatgatgagccaatgaaatgagagtggcttaagttcattcattcgctccctagacatttattgggctcctttggtgtgccaggtcccgtatcaggaagcagaacctctgagcctcagcgtctggccagataaataaatggcacatggtagcgggtcagcgaaaagcccagtgctggaccgtgggacaaaatgggaacagagcagctagcactgtggagatgagaaggggctgagattagaccgagggaaggaggtagggaaatgctgggcatcatcaggaaactcctagcgtgcatcaacaggccctacaggcgagtttagggtcaggtgtcctggggacatgggtgttggtccagtgcagggtttccgaaggtctggatggtggtggccctgaaaaccctgttgagagagtaatgaggtttgtaggtgtggaaggggttacctcatgtactgtgtgtggcccccccccccacccgccccacagcctggccctgttgcctgaacctgagatccctggagagtattgagtggaaagaggcagtatctcccttattttcctaaatgtatcctttctctaaccttgggcaagtaacctagactctgtgactcaacgttcccatctgtaaaatggagattgatacccaccgcacaggttattgtgagggttttttgtttgtttttgagatggagtctgtgtcgtccaggctggagtgcagtggcatgatctcggctcactgcaacctccgcctcccaggttcaagcaattctccccgctcagcctcccaagtagctgggactgcaggcatgcgccaccaagcccagctaatttttgtgtttttagtagacacggagtttcaccatgtttgccaggctggtcttgaactcctggcgtcatgtgatcttcccacctcgaccttccaaagtactgggattacaggcgtgagccaccatgcctggccattgttgtgaaggttaaatgagctaatacttacacttttttggaatggtgcctagcacatagtgagcgcggcattagccatttttctcctagagcgagcccttctctccttgtataatgactctcctgtctctgccggcttccttcctgtagggagtacctgacaggcttccacaagcggaaggtcgagcgaaagaaggcagccattgaggagattaagcagcggctgaaagaggagcagaggaagcttcgggaggaggtacgcagggggaaggtgggagggaggtctttgattcttagggcacttgcagccttggatttccctaatagaggcagctgctggcatggggcgatgtgtgtgtgggcaggactggggaatagtttatacaggtggagactctgtgggcccgggtctgggagtgatggaagatggagtctcctcctgatcttgcagtatggatcatggtctccctcaccctgggggtgattaataccccagcctgaggttggactgagaggccatactcactgtgttccctgcctgtgtggtttcagcgccaccaggaatacttgaagatgctggcagagagagaagaggctctgggtaagtggcatgcttggcctgacctggagaacagctgatgggcctggtttatacccttggtgggtggaagggatagaagctgacctccttggccctagggatcttggggggtaccctggggccaggggtggtcctaagcacctctaagtgcaagtggaacagagaccaggagaaggagtcccaaaccccatggttaaccaagcctgagaagagagcccagtttttaaggatggaaaggactaggggtggaggggagggacagcagtagctgtcacagagggtttgtctgacatggggaccagctagagcatgaaggaaacgggatcattcacaacattcatccacagaccaggctctacagccagtgaccttgtggatgcgctccacgtccacagagtagagggggcactgcactccagggcgggagggaggctggagcctggtcactcgttcccgtgactgagaccaggtctgtgtccacccccacagaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgaggtgggtcccagtctcagccctgggaggaaggggcgtgggggcagaccagcttgtcagggttgctcagtgctggcccatgtcatgggtatcccactgccagccctgggaagaaggggcgtgggggcagactggcttgtcggggttgctcagtgctggcccatgttgtgggtaccccactgctggggctccttccctttggacccttcattccctgcttccggggtgctgcaaagaccagccccactgctgagcggctgaggagcttgggcaggctccttcaccttgcctgcttccctttctccatcagtgaactgggggttgctgatggtggcacctgccttgtgggattggtatgagggtgaaagtggttaatccatgtgagtcacctggcacagtgcccagccctgtcataagtgcttcacaaaaggtagccgtttgttgtgatcgttccctttgtgcgattcgcagccctggcacgtctgtgtgcactaagtgggttttcaacctgtgggttgtgaatcatgagtaggttgcaatcagcataaaaaaaaaatataattgaaaatatccgaaagtgtcatgttaaatattgtttcatgagacagctgtttccactggagttgtatctgggtgtgcctaaggatttatggacatatatgcacacaattacgatataaaacacatttccttgtgtgggttactgtgttcttaagtcctggagccactcccctatcacatccatactgatctcagggccaggcatggtggctcacgcctgtaatcccggcattttgggaggccaaggcgggcgttatcacctggggtcaggagtttgagaccagcctggccaacatggtgaaaccccgtctctattaaaagtaaaaaaattagccagggggccaggcgcagtggctcatgcctgtaatcccagcactttgggaggccgaggcgggcgaatcacctgaggttgggagttcgagaccagactgaccaacgtggagaaaccctgtctctactaaaaatacaaaattagctgggtgtggtgggacatgcctgtaatcccagctactcgggaggctgaagcaggagaatagcttgaacctgggaggtggaggttgtggtgagccgagatcgtgccattgcactccagcctgggcaaaaagagcaaaactccgtctcaaaaaaaacttagccaggcatggtggcgtgcacctgtaatcccagctactcgggaggctgaggcaggagaattgcttgaactcaggaggcgcaggttgcagtgagccacgattgtgccactgcactccagcctgggtgacagagcgagactccatctcaaaaaacaaaacaaaacaaaaccatactgatctcacaccggtctttcattttatgctcactattctgcaagttctgatacaaagacaagtcttgtccccgttttgctaggattttcattcctgaatgtttaagtatgtcctggaagcttctaggggcaggaaagggtttggaaacagaccttcccctgtgtaatccttgctttagggcagatagacttcttccatcagaagccttctctagtcccaacccaggcctgtgatgcagcagggcgcgccaccacttgccagagccatggtggctcggggtgcccagcccaggtccccccagctactgctccatgtaagtcattgtcttgtgcctctttagggaggggctggagacaggtctgaggaggaggcgtcatccacggagaaaccaaccaaagccttgcccaggaagtccagagaccccctgctctctcagcggtgagtcttggcctgctgcctccccggtcccacccctcctggctggcagtagtgacctggcccttagggtggtgtggagcaggtgtagggcccggagcagccctctgcctgtccagtgatcctctgcctctcctcattgccccgtcctgtcccacccacccctgatagtgtctgacctccagtgcttttcgtgcctgggtgaagggcctgtgtctctgagctgagttgctggcaggcactctggaggtagagcaggccaactctggcatgaacttggcggtcctggcattcgcaacctgtcctgacatcccctccgtgagccaggtggtgagtcaccccacaatgcaatcttaaactgaggctttctgccctcccctaggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtaatgactgcacagctcaaggttgggaagccaggacctctctggcctggggccagctgcctttgcctggggtcagctgcctttgcctggggtttgaattcccgaaggagcaggcagctgagagcaggcctcccccaggaagagccttcagagccacgtgggggcatcttcccaaatgtgcaccccacctggcactcatcagatttgtgcgcttgtgatttgtttgtccttgataccacgcacaagggcaggtttttggggtggtggaaatggccagggcccatgggtctgtctccagcagttagccctgtggctgcaataaagtacagttctccctgtgttaagatcctaaccagggttaaggatcagtgtgtccgttgctagaatccagagcccacctgctgctctgaaaagcaggctcctgaggccagtgggggagcagtgccccccatgcccttcaccgaggagcctctgtgcctgtcccttgtcctcggccccaggagtctcctcaactgacactgaagtggtggaagcagttgagtgccaggtcatcccccatcaccacactggggcagcgtccccaggcttccagcagctcccaggtgggtcccaacgtggaaggattaattaattctttctaaagcagttgcagccgggcttggtggctcacgcctgtaatcccagcactttgggaggcccaggcgggcagatcacttaaggtcgggagctcgagaccagcctggccaacatggtgaaaccctgtctctactaaaaatgcaaaaattagccaggtgtggtggcacacgcgtgtaatcccagctacttgggaggctgaggtggaagaatcacttgaaccctggaggcggaggctgcagtgagccgagatcacgccattgcactccagcctgggcaacgttgtgaccttgtctcaaaaaaaaactaaaaaataaagcagttgcatcttgactcgtacaaaagtagcccccaccagagtagaccctgcgggtgccagctagaactccacaaggggccatgtcttcacactccttccagatggatgagttgatggaaaccctgtcccttccttgtcccagcttgtcagtcctgggcaggagagaatttcaggttgtgccttggttagaggagctgtgttgggtcctaaacactaggaccacaaaggggagtgaactgtgttcccagggcttgctgacgcccgtggactatggagtcaggatgacaggacagtgcggtgaggggcatctgcgacaggactgcgggctctacccgccctgatgtgggagctcctggagtgggggtgagcagtgagccagggtctgcagggctgtcctctctccacagccaacagccaggccttacagtggggcaggcttagtgactgtgcctcagttatgctgtacctgggagtgggcaggccctctcccatgtcaccatcaaaacccactgatgaaggctggtgggagtctgagggctgcacccgggtatggtgagttcccctcagggattgtgctgagcgccttggcctggcttcttggctccgcccacctgctctccctgccaccaagttgtcttccccgggtggcatgtgccacttggctgcctcgtgcctgggcacagtggtgcctattatgggccctccaggtggctctggtgctcagcctgctgtgagcaggaacagctgagtcccaggggttcttgcacacagcagggctcgggtttgaatccaggctctgctgcttggtcgctgcatgagcttctgctgtgctgacctctctggtttgtctcgtcatgtgtaaggtgacaccagatacctacctcttagggctgccccgagactaaaataagaccatgtgcatgaaccacttaccaaagtgcctgttgctctccaggtgtgcctaccgcatgttgccgctgctgtttctgctgggacgtctgactccagttccttctcccctctccagtgacaaggtcatttacaacttacatttacaatttatagtgtttaccagtattaaattctcagccactcctttcca

SEQ ID NO: 8057 - DNA, 273 bp, Homo sapiens
gcctgtaatcccagcactttgggaggccgaggtgggtggatcacctgaggtcaggagtttgagaccagcctgaccaacacggagaaaccccatctctactaaaaatacaaaattagccgggcatggtggcacatgcctataatcccagctactagggaggctaaggaaggagaatcgcttgaacctgggaggcggaggttgcagtgagccgagatcgtgccattgcactccagcctgggcaacaagagtgaaactccgtctcaaaaaaaaaaa

SEQ ID NO: 8058 - DNA, 302 bp, Homo sapiens
ccaggcgcagtggctcacacctgtaatcccagcattttgggaggccaaggcgggcagatcacgaggtcaggagatcaagaccgtcctggctaacacggtgaaaccccgtctctactaaaaatacaaaaaattagttgggcgtggtggcgggcacctgtagtcccagctacttgggaggctgaggcaggagaatggcatgaacccgggaggcggagcttgcagtgagcagagatcgcgccactgcactccagcctgggcaactgagcgagaatctgtctcaaaaaaaaaaaaaaaaaaaaaat

SEQ ID NO: 8059 - DNA, 283 bp, Homo sapiens; identical to SEQ ID NO: 7561

SEQ ID NO: 8060 - DNA, 184 bp, Homo sapiens; identical to SEQ ID NO: 7572

SEQ ID NO: 8061 - DNA, 147 bp, Homo sapiens; identical to SEQ ID NO: 6794

SEQ ID NO: 8062 - DNA, 235 bp, Homo sapiens; identical to SEQ ID NO: 7589
  misc_feature (230)..(230): n equals a,t,g, or c

SEQ ID NO: 8063 - DNA, 143 bp, Homo sapiens; identical to SEQ ID NO: 7597

SEQ ID NO: 8064 - DNA, 183 bp, Homo sapiens; identical to SEQ ID NO: 7394

SEQ ID NO: 8065 - DNA, 196 bp, Homo sapiens; identical to SEQ ID NO: 7614

SEQ ID NO: 8066 - DNA, 162 bp, Homo sapiens; identical to SEQ ID NO: 6214

SEQ ID NO: 8067 - DNA, 100 bp, Homo sapiens; identical to SEQ ID NO: 6215

SEQ ID NO: 8068 - DNA, 193 bp, Homo sapiens; identical to SEQ ID NO: 7396

SEQ ID NO: 8069 - DNA, 153 bp, Homo sapiens; identical to SEQ ID NO: 6795

SEQ ID NO: 8070 - DNA, 211 bp, Homo sapiens
ctggctaacacagtgaaaccccgtctctactaaaaatacaaaaaaattagccaggcgtggtggcgggcgcctgtagtcccagctactcgggaggctgaggcaggagaatggcatgaactcaggaggtggagcttgcagtgagccaagatcgcgccactgcactccagcctgggcgacagagtgagactctgtctcaaaaaaaaaaaaagaa

SEQ ID NO: 8071 - DNA, 280 bp, Homo sapiens; identical to SEQ ID NO: 7673

SEQ ID NO: 8072 - DNA, 193 bp, Homo sapiens; identical to SEQ ID NO: 7690

SEQ ID NO: 8073 - DNA, 175 bp, Homo sapiens; identical to SEQ ID NO: 7705

SEQ ID NO: 8074 - DNA, 279 bp, Homo sapiens
cactttgggaggccgaggcgggcggatcacgaggtcaggagatcgagaccattctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaga

SEQ ID NO: 8075 - DNA, 300 bp, Homo sapiens; identical to SEQ ID NO: 6744

SEQ ID NO: 8076 - DNA, 150 bp, Homo sapiens; identical to SEQ ID NO: 7399

SEQ ID NO: 8077 - DNA, 142 bp, Homo sapiens; identical to SEQ ID NO: 7400

SEQ ID NO: 8078 - DNA, 122 bp, Homo sapiens; identical to SEQ ID NO: 7739

SEQ ID NO: 8079 - DNA, 268 bp, Homo sapiens; identical to SEQ ID NO: 7767

SEQ ID NO: 8080 - DNA, 368 bp, Homo sapiens; identical to SEQ ID NO: 6222

SEQ ID NO: 8081 - DNA, 4704 bp, Homo sapiens; identical to SEQ ID NO: 7404

SEQ ID NO: 8082 - DNA, 1090 bp, Homo sapiens; identical to SEQ ID NO: 7782

SEQ ID NO: 8083 - DNA, 7332 bp, Homo sapiens
ccaaggactgtagcaggacaagccacagacaaaacctctcagacacggagctgtagaagaaagggctttattcagctgggagcattggcaagctactgccttaaaatccgagctccccgagtgcacaatttctgtcgcttttaagagctcacaacactaaaatttcacatgaaagggtcgtgattgatttgagcaagcaaggggtacgtgacaggggctgcatgcaccgatggtcagggagaaacagaacagggcagggagtttcacaatgttcttctatagaatgtctggaatctatgaataacatcggtttctaagtcatgagttgatttttaactactaggtttaggccaggcaggcccaggtccagttttgggcctggcgctgggctgcctgtctttgatttcacttccttttttttttaaaaaaaaaaaaaaaaacaggtactgagtataaaacaatatgagagggtctctctcttccctcgctttaactttcggagggctgaaattctttctagccttggttaatacagcaattcattccattctagctattgttatttctcttactataattttactattagtacttacgctattctattattttcttaattttccacttaattaggataacaaaccgaggccgggctcccatcctcctcaagcacacgaggggggcctggcccagcagggagcttcgcctggtttctgagggaattcccggcgggcctttccaaaacatgcccgttcccttccgctaacttcaggggccaagaattgaactttcaccctcctcaagccggtggcgctgcctcgctggcgttcccagcgcgcagccaaccggatgccagccggcggcattaccactgccagcatggggcgcccgcggacctccgactgaggcagctgccgggagccggaagtgtcccgggcgccgggactgcgagggggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggtgaggcgtgggtcccacaaccgcttggaatttgcctcccggctccgctctggaagctaagaaggggcacgagagccggagacgggaacctgagagcagggaagccagtagccggccggaggagcgcgcggccgctccagtcggaaggagccgttgcagccctgcccggcgtgtggcggggtcagcgaggcccctgcggtgcttcgcccgcgccttccgctccgcactcacccgccctctgggcctcccacaggtcggcgccgccagcggcgggtaccggcccgcagagggagggcgggctgtgaactggcagcacatcgcgttcccgcggggcccccattctgcccaggcagggagcggctgggatgggactgaggtcggtccgcgagcgcggtgccccagagacccggcttctggaagttgccgcggcctgctcttggggcccagaagtagggcggggaggcgcggggtctggagtctgcaggacctggctgcgaatccaaccagctgatttcaaacttttctgtgatcttctgcaagttaactaagtctcagttcctcgtttgcgaaatgtacttaataggcaccccagggtgaactaaatttgtccgcacagactgcagcattgcgcttgggaggcgccttagggggtaggagtcactaatatcactgagttttgacagaaatgaaggtgcattggcaaaggtgtgccccatggccgggcaggttaggaggagggcctggtaatattttttcttaaattgtaaacagccatctggatgagcaatgcattatcaaattatgattcagagaggactatcgctgactactcttttttttgggcaaacctccgcttcaggagcttctggcttgattcctaagtggaaggtagagacctaggccctctgagtcacaactccatctctctgggtgaggactgagctccaggactgctgagtggaggcagaacaattgggatagggaaaagagaggccaaactagatcagaggctggcgtgggcttcagaatctacagactggcacagttaatgcctccgggcccctattgctgcttcaagtttgaccaatcagaagtatctttagcttaagggcggcgtgttggccaatgagactttattgtgaaataaaatgccctcagtttcatttaactgagccaccatagaagagtagagaaatcgagttggccagatgagggagaggccattaagaggtattttagggattgaatgggctgggcacccagaggacagtggcatttggggtggtaatgagaaggaacattaggggcctccgcctccttccgttcctcctgtgctgagtcagtcagcacagaggctgcaggaggtatctctggttggctttggctgcctgtagggggcaccagctttggggaggtcagagggctctctcctgagctgctgtcctgcccacaatcacacctgcctgatgcctgtgaatggccgtctgagtctcttgggccttggtcacttctggcctgccctgcaccgaccagtaactgtgcctgatgactggaggtatgggaattcaccggactttattgttctttgtaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctggcaagtggagcaggggcctccatgacctgggccaggtcttccagcctaggcagaacagcaagatgggcgggtgtttcagtctgatcatctcttgagcttttagaaggtggaggggctgtgggcgggaggcaaagcgggttaaccctcgaggacaggcacccacttctgcctctgcactggtgagtgccctgccctcagcacacacagagtgggttctccatgtcagccagtctctgatgccagttgtccagaatgccagtctcttcctttacaacaaacatggtaacatcagatgggcaagatcagtggaagggtctgttctgagtggtgcctgcccctgtggacagacctttagggatggacagatgagcagcagctgcagggccagcaagagctaaggagctggggagtgagttagttgaatgacggtaattgccgggggggggcggggggggggtggtgagtctccaggctgcactgtgaagtgggcggggccccagcactcggtgtttccctctctggctcctcctcctctaaggtttcctgactgacagccttcccttgtgactgctgccgtctttccctaagtctggtcctgctttcaggttcctctcagtacagcctcagcccgaggttcccttcctcttgcatccatgtgtgtgtttcagaggcggccatccttccctacttccagatccttgtagggcagttggtggagggtgggaggcaccccggtgttgcctccatgaagccctgtgccagtcactgggctgcaaggctgaggaaattgtgtccgtgtcagaaagctcctcagctcagaggtgctggtacctcctgcgtggtaggaaggcagggggaagaggccctgcttctcctgttctctttgcccttatgagacttgagagtctgtgtcatctgtgccttgcatgtctttttttcagactccctgcgacaaggactgtgtactgcatgaatgaggctgagatagttgatgttgctctgggaatcctgattgaggtaaagtcagacaagcctcttactcatgaccagaaactctgcatgggcagaggctagacccttggtcaccgtcagtaagagagacgccctctgccgtaggctacctcttcttcctcctgccacttcccttgctcttatctcggccatgctgcccaggcctctccccatgtgggtgtgcgctcgtggggtgtctttgaggctagaagcctgggagggcatgcgtgtgttagggagggcgtgtgtgtgttagggagagcgtgactgtgcactggtgtgtatgtggatgggacatgaagcgtttacctgtttgtgttcttggaaaggttcccagttgggtagatgacttcttagccattgcccctctcctgagcagaggatgctgagcttcctagcttcctgcagtaataattgcagtgcctcagagttgcacagcattctacagtttaccaggtgccttgaaagcatgcgttatgtcattttagccttgcaataaccctgtggtgtgggacttttcctagtgctaaggcatgggcccacacccaggttttgtatcctgggttctgtcaccggcctttctagacatgtttcttccatttctttttcctttcccctcagctaatcctcatgcctttgcttgcttctctcccgagtgggttctggtttcttcaagagctgtgaagagggggtcaggggaaggagtggggtgaagagagggtgggtgctcaggatatgggtacattgcctggcctggtcacattggctttgtagttgcttctagatacatcctgtgttactgacagatcagcatgttagggaaataaaacacgtatgttgagcctgcgttttcccgtactccacagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgtaagttgtgctaatgtctttccaagttctgggttgggaagtggagggtggcagcgtttgtttgtgtgcagccgtccagtcctgttcacagcgaggatttggagtcctccagggtctcatcatgggagtgatttgtcagcggacgcctctgccctgtctggcttcaggtccagggaagctttgaagcagtcaagccttgtctttgtaccccatgtgtcctgtctttgttgagtcactcagagatcactcctggacctctggggttggagttccagtgatggcttatggcggcccactcactatggtgggctgagtggaagctccttaaccatgtccccagagacactgaggtgctcgctcttttaatgtcctcgtttgttgccgtaagttctttgctaggtttcattttggcatttggcaaatcagcctggaagtctggccccatgacagcaatcactccctccccaccctcctgaagctagaggaagatttgctcagatccattaattaaagcaggaattggtgtgacaatgagctgcatggtttagggagtctttgggagccttggaagtcctgaaggacagacaatcttgtactaagaagtcacaggtgccctggctgcccttgctgcccctcggcctctttgacacaggggccccacctcctctgtagtgggttccatcgctggagctggagatcagcgttagctgtaaaatgagatggctgagcagatgtgccacctctgaccatggttggaactgaacccttgcaatcacgtaagcctttagcagctctcaagcttgctctcagccctctcagccctcagagggaacacagccatggctataagcaagaggatgagtaaggcctgggcgctgcccagagctagaaacccaggccccgggagggagagcctgacccacttccacacataggagaggaagaggcccaggccgcctgccagcagcacagaggacacagccaggaagcccactgccagccgccacgctctctcatcactgttgcactgggctaggaggagaggctggggggcaaagagggtgaggaccagggacccgtacacgccaagcctggccaggcccaggccaacccgaggcacccccagggcttccagctcagggaactggtgacactgtagggtgctggtgtcctcattccacaggcagaagttatagaagccgattctcaggttgggcaggtcagtgaggttgccagcctcccagagaagagcgtaaaacatcaggcagatgaccacaatcacgaggactatgatgctcatgaacagcagctggtcgcgccaccgaggccttgggccggccatctctactgccctctgccgggggac

SEQ ID NO: 8084 - DNA, 7334 bp, Homo sapiens
ccaaggactgtagcaggacaagccacagacaaaacctctcagacacggagctgtagaagaaagggctttattcagctgggagcattggcaagctactgccttaaaatccgagctccccgagtgcacaatttctgtcgcttttaagagctcacaacactaaaatttcacatgaaagggtcgtgattgatttgagcaagcaaggggtacgtgacaggggctgcatgcaccgatggtcagagagaaacagaacagggcagggagtttcacaatgttcttctatagaatgtctggaatctatgaataacatcggtttctaagtcatgagttgatttttaactactaggtttaggccaggcaggcccaggtccagttttgggcctggcgctgggctgcctgtctttgatttcacttcctttttttaaaaaaaaaaaaaaaaaacaggtactgagtataaaacaatatgagagggtctctctcttccctcgctttaactttcggagggctgaaattctttctagccttggttaatacagcaattcattccattctagctattgttatttctcttactataattttactattagtacttacgctattctattattttcttaattttccacttaattaggataacaaaccgaggccgggctcccatcctcctcaagcacacgaggggggcctggcccagcagggagcttcgcctggtttctgagggaattcccggcgggcctttccaaaacatgcccgttcccttccgctaacttcaggggccaagaattgaactttcaccctcctcaagccggtggcgctgcctcgctggcgttcccagcgcgcagccaaccggatgccagccggcggcattagcactgccagcatggggcgcccgcggacctccgactgaggcagctgccgggagccggaagtgtcccgggcgccgggactgcgagggggccgggagttccccaagaccggaagtgtcccgaggccgggagcccgcgggaccctggagcgcgcggggccggaagaggcgggcggccagtggaggtccgcagagtttgggcgccaggcgagacggcagggcttaaagttccgggtgaggcgtgggtcccacaaccgcttggaatttgcctcccggctccgctctggaagctaagaaggggcacgagagccggagacgggaacctgagagcagggaagccagtagccggccggaggagcgcgcggccgctccagtcggaaggagccgttgcagccctgcccggcgtgtggcggggtcagcgaggcccctgcggtgcttcgcccgcgccttccgctccgcactcacccgccctctgggcctcccacaggtcggcgccgccagcggcgggtaccggcccgcagagggagggcgggctgtgaactggcagcacatcgcgttcccgcggggcccccattctgcccaggcagggagcggctgggatgggactgaggtcggtccgcgagcgcggtgccccagagacccggcttctggaagttgctgcggcctgctcttggggcccagaagtagggcggggaggcgcggggtctggagtctgcaggacctggctgcgaatccaaccagctgatttcaaacttttctgtgatcttctgcaagttaactaagtctcagttcctcgtttgcgaaatgtacttaataggcaccccagggtgaactaaatttgtccgcacagactgcagcattgcgcttgggaggcgccttagggggtaggagtcactaatatcactgagttttgacagaaatgaaggtgcattggcaaaggtgtgccccatggccgggcaggttaggaggagggcctggtaatattttttcttaaattgtaaacagccatctggatgagcaatgcattatcaaattatgattcagagaggactatcgctgactactcttttttttgggcaaacctccgcttcaggagcttctggcttgattcctaagtggaaggtagagacctaggccctctgagtcacaactccatctctctgggtgaggactgagctccaggactgctgagtggaggcagaacaattgggatagggaaaagagaggccaaactagatcagaggctggcgtgggcttcagaatctacagactggcacagttaatgcctccgggcccctattgctgcttcaagtttgaccaatcagaagtatctttagcttaagggcggcgtgttggccaatgagactttattgtgaaataaaatgccctcagtttcatttaactgagccaccatagaagagtagagaaatcgagttggccagatgagggagaggccattaagaggtattttagggattgaatgggctgggcacccagaggacagtggcatttggggtggtaatgagaaggaacattaggggcctccgcctccttccgttcctcctgtgctgagtcagtcagcacagaggctgcaggaggtatctctggttggctttggctgcctgtagggggcaccagctttggggaggtcagagggctctctcctgagctgctgtcctgcccacaatcacacctgcctgatgcctgtgaatggccgtctgagtctcttgggccttggtcacttctggcctgccctgcaccgaccagtaactgtgcctgatgactggaggtatgggaattcaccggactttattgttctttgtaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctggcaagtggagcaggggcctccatgacctgggccaggtcttccagcctaggcagaacagcaagatgggcgggtgtttcagtctgatcatctcttgagcttttagaaggtggaggggctgtgggcgggaggcaaagcgggttaaccctcgaggacaggcacccacttctgcctctgcactggtgagtgccctgccctcagcacacacagagtgggttctccatgtcagccagtctctgatgccagttgtccagaatgccagtctcttcctttacaacaaacatggtaacatcagatgggcaagatcagtggaagggtctgttctgagtggtgcctgcccctgtggacagacctttagggatggacagatgagcagcagctgcagggccagcaagagctaaggagctggggagtgagttagttgaatgacggtaattgccggggggggggggggcgggggggggtggtgagtctccaggctgcactgtgaagtgggcggggccccagcactcggtgtttccctctctggctcctcctcctctaaggtttcctgactgacagccttcccttgtgactgctgccgtctttccctaagtctggtcctgctttcaggttcctctcagtacagcctcagcccgaggttcccttcctcttgcatccatgtgtgtgtttcagaggcggccatccttccctacttccagatccttgtagggcagttggtggagggtgggaggcaccccggtgttgcctccatgaagccctgtgccagtcactgggctgcaaggctgaggaaattgtgtccgtgtcagaaagctcctcagctcagaggtgctggtacctcctgcgtggtaggaaggcagggggaagaggccctgcttctcctgttctctttgcccttatgagacttgagagtctgtgtcatctgtgccttgcatgtctttttttcagactccctgcgacaaggactgtgtactgcatgaatgaggctgagatagttgatgttgctctgggaatcctgattgaggtaaagtcagacaagcctcttactcatgaccagaaactctgcatgggcagaagctagacccttggtcaccgtcagtaagagagacgccctctgccgtaggctacctcttcttcctcctgccacttcccttgctcttatctcggccatgctgcccaggcctctccccatgtgggtgtgcgctcgtggggtgtctttgaggctagaagcctgggagggcatgcgtgtgttagggagggcgtgtgtgtgttagggagagcgtgactgtgcactggtgtgtatgtggatgggacatgaagcgtttacctgtttgtgttcttggaaaggttcccagttgggtagatgacttcttagccattgcccctctcctgagcagaggatgctgagcttcctagcttcctgcagtaataattgcagtgcctcagagttgcacagcattctacagtttaccaggtgccttgaaagcatgcgttatgtcattttagccttgcaataaccctgtggtgtgggacttttcctagtgctaaggcatgggcccacacccaggttttgtatcctgggttctgtcaccggcctttctagacatgtttcttccatttctttttcctttcccctcagctaatcctcatgcctttgcttgcttctctcccgagtgggttctggtttcttcaagagctgtgaagagggggtcaggggaaggagtggggtgaagagagggtgggtgctcaggatatgggtacattgcctggcctggtcacattggctttgtagttgcttctagatacatcctgtgttactgacagatcagcatgttagggaaataaaacacgtatgttgagcctgcgttttcccgtactccacagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactatgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtctccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgtaagttgtgctaatgtctttccaagttctgggttgggaagtggagggtggcagcgtttgtttgtgcgcaaccgtccagtcctgttcacagcgaggatttggagtcctccagggtctcatcatgggagtgatttgtcagcggacgcctctgccctgtctggcttcaggtccagggaagctttgaagcagtcaagccttgtctttgtaccccatgtgtcctgtctttgttgagtcactcagagatcactcctggacctctggggttggagttccagtgatggcttatggcggcccactcactatggtgggctgagtggaagctccttaaccatgtccccagagacactgaggtgctcgctcttttaatgtcctcgtttgttgccgtaagttctttgctaggtttcattttggcatttggcaaatcagcctggaagtctggccccatgacagcaatcactccctccccaccctcctgaagctagaggaagatttgctcagatccattaattaaagcaggaattggtgtgacaatgagctgcatggtttagggagtctttgggagccttggaagtcctgaaggacagacaatcttgtactaagaagtcacaggtgccctggctgcccttgctgcccctcggcctctttgacacaggggccccacctcctctgtagtgggttccatcgctggagctggagatcagcgttagctgtaaaatgagatggctgagcagatgtgccacctctgaccatggttggaactgaacccttgcaatcacgtaagcctttagcagctctcaagcttgctctcagccctctcagccctcagagggaacacagccatggctataagcaagaggatgagtaaggcctgggcgctgcccagagctagaaacccaggccccgggagggagagcctgacccacttccacacataggagaggaagaggcccaggccgcctgccagcagcacagaggacacagccaggaagcccactgccagccgccacactctctcatcactgttgcactgggctaggaggagaggctggggggcaaagagggtgaggaccagggacccgtacacgccaagcctggccaggcccaggccaacccgaggcacccccagggcttccagctcagggaactggtgacactgtagggtgctggtgtcctcattccacaggcagaagttatagaagccgattctcaggttgggcaggtcagtgaggttgccagcctcccagagaagagcgtataacatcaggcagatgaccacaatcacgaggactatgatgctcatgaacagcagctggtcgcgccaccgagaccttgggccggccatctctactgccctctgccgggggac

SEQ ID NO: 8085 - DNA, 5071 bp, Homo sapiens
agctcatgttctccctttggcatttcttacaaactcatggcaagtttccctcctaccctgccctccaccaaggaccagaagtctgaggtaacctcctgccaggacctatttgcaaataagtcattagctgccctctgatttgaggtcaggaggaaaagtctctcccaagcagctttgaaagtgtgaaacatcttaaactgagtgaagtgctctttagccaaaggctttgctccagtccaaatacaacaagccattggaaacattagtgaggggatttctcagatcttttttgaaggtgggttttgactgaggtgaagggcaaggcccacccttaatggagacctgaaggtggaggaagctattggttttcaccacagctgccaagacaaccacctggggagctgtaagaactacccattgctgggccacagatcaatcagagctcaacttatgtgcttcgggctgggcactggtgtgtttctgaagctctgaagctcattcgaaggtgagcctgggtcaaggaccactgacacacccactctgattttacctgcagtgctctgggaactcattactgggtcaagacaagatgtcacctggtgatgaaatcccatcatatactcattactttaaaaactaatacatattttttcctgacaatggtagtatgaattatagaaaacttagacgtttttgtttgtttgtttgtttttgagatggagcctcactctgtcacccaggctggagtgcagtggtgcgatcttggctcactgcaatctctgcctcccggggtcaagcaagtctcctgcctcagcctcccgagtagctgggactacaggcacccgccaccatgcctggctaatttttgtatttttggtagagatgggtttcaccatgttggccaggctggtcttgattgaactcctgacctcaaatgatccacccaccttggcctcccaaagtgctgggattacaggcatgagccaccatgcctggccagaagatattttaaaaataataataaaaaagataaccttttatcccatcatacacataaaaccactgttaatattctaccaatattttcttcctgtactgatgtatttttacataatcatgatgttgaatgtaatgttttttcactagatttagtaaacatttttcaaagctgttaaatattcttcaaaaacatgatcaatggctgtgcaatagttcatgtgggatcatccattacactattactagacaaattgtttccacttttcaccattataagtgaagacgctgtgtgaatcgtgtttggaatctgatttttctcaggtgatctacctataagtgcaatcattggatcaagggtagaaatatcttttagtgatcttgctaaatactgcctaactggcctacagaaaatttgctaatcatagtccctctaattgtatataaaagtgcccactttgttatactcttttaaaaaattcttttcactccgttttaaatcagaagggctttgtccagttggtctctgaaacagtggtctgcacactgtattttacatatgtgtattttccagtatgggataagtttcggctgatatggtttggctgtgtccctacccaaatctcatcttgaattatagctcccataatccccacattgtgggagggacccagtgggaggtaattggatcatgggggtgggtttcccccatactgtactcatggtagtgagtctcatgatatctgatggttttataaagggcatttcccctgcacatgttctcttgcctgctgccatgtaagatgtgcttttgctcttcctttgcctttcaccatgattgtgaggcctccctaaccatgtggaactatgagtccattaaacctctttttcttttcaaattactgggtatctcttcatagcagtatgaaaatggactaatacaacagcattcaccaggaagtgactaggaacacagagcttcaagctttgtgaggcacaaggtactggggccatgataccaaatggcctcctggaagccccagcagggagtcccaggtggtgttcagcagcaaaatgagtcgtggccctgggaagggacctgaaggctacacagccctgatgatcagtttctgaggggacccctctgggggaacagctccctcctctttcccagagctgactggaaggtctgtctcattctacacactgcatttgttacagaaagggaccaagtggggaaaataaagaacatggaacaggctgagagagagggcagctccattcaaaggacctaggtgtatgccaaaaatgagaatgaagattgaccagcgacttctttggcagagacctgggcaggctggctgatggagagctggggcctgtgaatacagtaagggtggggtccacactgccaccgcctcccctcagatgccgcttctctggactcagcagcactgggcagtctgcccagttctgcccgtggcttctgctccagagaagcccagtggggacagtcagagtggaggagtgaggggctgtcccagcagaagccctggctgctgccttgggtggcactgtcaaaggctctggaggtcccagagggccaagggtctgaagactcgggtttgaatgtagttgagagattcttggagcaatgatgcttgttacggaaggaattattgggaattgaaaaggtggcattagtctgggatgataaggagttttaaccatttgagtccatggtatgggaaaaattgccgacgggaacatattttgtatggttttgcttatttagtaaatgtttgtaaaagcctatatctgtgcttttaatgggtttgggtattttagggtgtggaatagatttccaggacttccctgatttataccatcatgctgtggaaaagaaggtttgacctcctccattgttcaggaccaactgggaagggacttggggatgcctttgtttaaacactccctctcacttttcccatttgaattctgttacactggggttccaaaaaaaattattaaacgttttgctttgaaaacagctgcctttttaaaaattaatgtggctcctcggggagattgcatcagccaccttgcggcagctcctgccagacgccaggagcctttgttttgacttcctcattttctctcaactgaccttttaatgtagagcaaaacaaaacgagccaagaagcccaggaccaggcatgtggagaaggtggtggcctctcacctttttatattcagtcccagctcttatgaggctcgccatcatctggtgcgacttggaacttgaacttggaattctctggtgaggcccagcttcccctcttgccttgtgcagtccagcacctgctcagctgctcaggctgtgtatgaatacattcccatctgcccatcctcagccaccccccagctcctagagtcctactctactttctgcttctctaaatctgatccatgcagcaagagcattcctgggctccttcagcccacactctggtttagctataaattaggatttattctccactctagtgtcatgtctctgaggaacagtcttcagttttgttattttgatacacagtaggggctcttttttttgttttttttttttaaatgagcgaatgaaaatgctacataggctccctgagttctttcatgtacgaatcctggttacacatcttaggacagcagagctgcctgagggagggttgtgtttaatgtcgtatgcatgctcagcacagtgctggcatggcccatccatgctttctgttgaactatggacagaattcaggaacttgtgtatggagagggtggaagtcagtcctcgcttctttccctaaacattttgcagtgacagcatatggatcttgggttggaaaccccatgacactcttctctacttccccatgggccttccctggtttttgtttttcttttcttaaacaatcctggtaatgacacttccaccacaatgagcttttaaatgtcctttaatgataagccagtgtttccttcagagggcaaaggggagactgctgagtcactgtggccatttttagataaaccttttcctgtttataataacacatgctgattgtaggaaactagaaaatacatgaaagtgcagagaaaagactaaaagtcatctatacttcaggtcgtagaaataaccactctgaacagcacacttctttttacactattgttttacactgttgggattacataaatatatatgtttgtatcccactttgtgaacatcattctatgtgaactagaaatggttcctaaacattaagggctgcatatagctgtatcatagtttatagtttatacatagatgctttgtaacattattttataatgctatgaatgctatggtgaatatttttgtgaatcaacttatgtttccaccagcagtttcagagagtgcctgtctcatcccatcctccccagtattgcatattcttgagtcttttattctttgataatgacaaatgatgaatcattgatagtttttcttcataataagtaaagtttaacattttcaagtgtttgttgaccatctgtatttcttcttttgtgaagtgctgtcagttcttttgctattttaaaaataattttgagtttcagtttttgtttgttggtctgtatgaaccctttaaaaataaaggctgttagccttttgccatcttagttgtgacagtaaagtataatgctttgctgcactaggtcctctggaacaagatgcagatttagattccaggtcagcatgtaacttgaccactgtcactcaagagttacagcctgagcagggccttaggagggagatgatttctgcttaaaggcgatacaaattcctagttagggaaatagaaggaaagtattctcaggagattaatttaaggcagcttttttgttggtttaagcacctctaacattttcatactaataagggagaatgggatggcggctgaaagagacacaaatattgtatcatttaattctaaattatgtatttgtcaggttcttattgaaagagtaaattttcgaaaggatc

SEQ ID NO: 8086 - DNA, 512 bp, Homo sapiens
ttttttccagacaaaataccacgctcacaccacacataccacaagacaaagaacaggtaaagagggcacacacacttttaccgtttataccaaaccaaaatcacgaaattcaaaatccgagtaccaaaaaattcaagccaagtcaaaaccaaaaccaaagtatccagcaattcaagtcaagtcaaaaccagaacaagagtgcccatgcaggcatgctgtgggtgatcaggccacgtttccactcagatggagtggggcaagttccaaagactagtcttaccaagtcaagccaagtcaaaaccagaacaaaagtgccaatacaggcacaccgtgggtgatcaggccacgcttccactcacgtggagtggggcaagttccaaagactagtcttaccaagtcaagccaagtcaaaaccagaacaaagatgtcaatacaggcacaccgtgggtgatcaggccatgcttccactcacatggagtggggcaagttccaaaaactagtcttgacaagct

SEQ ID NO: 8087 - DNA, 5072 bp, Homo sapiens
agctcatgttctccctttggcatttcttacaaactcatggcaagtttccctcctaccctgccctccaccaaggaccagaagtctgaggtaacctcctgccaggacctatttgcaaataagtcattagctgccctctgatttgaggtcaggaggaaaagtctctcccaagcagctttgaaagtgtgaaacatcttaaactgagtgaagtgctctttagccaaaggctttgctccagtccaaatacaacaagccattggaaacattagtgaggggatttctcagatcttttttgaaggtgggttttgactgaggtgaagggcaaggcccacccttaatggagacctgaaggtggaggaagctattggttttcaccacagctgccaagacaaccacctggggagctgtaagaactacccattgctgggccacagatcaatcagagctcaacttatgtgcttcgggctgggcactggtgtgtttctgaagctctgaagctcattcgaaggtgagcctgggtcaaggaccactgacacacccactctgattttacctgcagtgctctgggaactcattactgggtcaagacaagatgtcacctggtgatgaaatcccatcatatactcattactttaaaaactaatacatattttttcctgacaatggtagtatgaattatagaaaacttagacgtttttgtttgtttgtttgtttttgagatggagcctcactctgtcacccaggctggagtgcagtggtgcgatcttggctcactgcaatctctgcctcccggggtcaagcaagtctcctgcctcagcctcccgagtagctgggactacaggcacccgccaccatgcctggctaatttttgtatttttggtagagatgggtttcaccatgttggccaggctggtcttgattgaactcctgacctcaaatgatccacccaccttggcctcccaaagtgctgggattacaggcatgagccaccatgcctggccagaagatattttaaaaataataataaaaaagataaccttttatcccatcatacacataaaaccactgttaatattctaccaatattttcttcctgtactgatgtatttttacataatcatgatgttgaatgtaatgttttttcactagatttagtaaacatttttcaaagctgttaaatattcttcaaaaacatgatcaatggctgtgcaatagttcatgtgggatcatccattacactattactagacaaattgtttccacttttcaccattataagtgaagacgctgtgtgaatcgtgtttggaatctgatttttctcaggtgatctacctataagtgcaatcattggatcaagggtagaaatatcttttagtgatcttgctaaatactgcctaactggcctacagaaaatttgctaatcatagtccctctaattgtatataaaagtgcccactttgttatactcttttaaaaaattcttttcactccgttttaaatcagaagggctttgtccagttggtctctgaaacagtggtctgcacactgtattttacatatgtgtattttccagtatgggataaggttcggctgatatggtttggctgtgtccctacccaaatctcatcttgaattatagctcccataatccccacattgtgggagggacccagtgggaggtaattggatcatgggggtgggtttcccccatactgtactcatggtagtgagtctcatgatatctgatggttttataaagggcatttcccctgcacatgttctcttgcctgctgccatgtaagatgtgcttttgctcttcctttgcctttcaccatgattgtgaggcctccctaaccatgtggaactatgagtccattaaacctctttttcttttcaaattactgggtatctcttcatagcagtatgaaaatggactaatacaacagcattcaccaggaagtgactaggaacacagagcttcaagctttgtgaggcacaaggtactggggccatgataccaaatggcctcctggaagccccagcagggagtcccaggtggtgttcagcagcaaaatgagtcgtggccctgggaagggacctgaaggctacacagccctgatgatcagtttctgaggggacccctctgggggaacagctccctcctctttcccagagctgactggaaggtctgtctcattctacacactgcatttgttacagaaagggaccaagtggggaaaataaagaacatggaacaggctgagagagagggcagctccattcaaaggacctaggtgtatgccaaaaatgagaatgaagattgaccagcgacttctttggcagagacctgggcaggctggctgatggagagctggggcctgtgaatacagtaagggtggggtccacactgccaccgcctcccctcagatgccgcttctctggactcagcagcactgggcagtctgcccagttctgcccgtggcttctgctccagagaagcccagtggggacagtcagagtggaggagtgaggggctgtcccagcagaagccctggctgctgccttgggtggcactgtcaaaggctctggaggtcccagagggccaagggtctgaagactcgggtttgaatgtagttgagagattcttggagcaatgatgcttgttacggaaggaattattgggaattgaaaaggtggcattagtctgggatgataaggagttttaaccatttgagtccatggtatgggaaaaattgccgacgggaacatattttgtatggttttgcttatttagtaaatgtttgtaaaagcctatatctgtgcttttaatgggtttgggtattttagggtgtggaatagatttccaggacttccctgatttataccatcatgctgtggaaaagaaggtttgacctcctccattgttcaggaccaactgggaagggacttggggatgcctttgtttaaacactccctctcacttttcccatttgaattctgttacactggggttccaaaaaaaattattaaacgttttgctttgaaaacagctgcctttttaaaaattaatgtggctcctcggggagattgcatcagccaccttgcggcagctcctgccagacgccaggagcctttgttttgacttcctcattttctctcaactgaccttttaatgtagagcaaaacaaaacgagccaagaagcccaggaccaggcatgtggagaaggtggtggcctctcacctttttatattcagtcccagctcttatgaggctcgccatcatctggtgcgacttggaacttgaacttggaattctctggtgaggcccagcttcccctcttgccttgtgcagtccagcacctgctcagctgctcaggctgtgtatgaatacattcccatctgcccatcctcagccaccccccagctcctagagtcctactctactttctgcttctctaaatctgatccatgcagcaagagcattcctgggctccttcagcccacactctggtttagctataaattaggatttattctccactctagtgtcatgtctctgaggaacagtcttcagttttgttattttgatacacagtaggggctcttttttttgtttttttttttttaaatgagcgaatgaaaatgctacataggctccctgagttctttcatgtacgaatcctggttacacatcttaggacagcagagctgcctgagggagggttgtgtttaatgtcgtatgcatgctcagcacagtgctggcatggcccatccatgctttctgttgaactatggacagaattcaggaacttgtgtatggagagggtggaagtcagtcctcgcttctttccctaaacattttgcagtgacagcatatggatctttggttggaaaccccatgacactcttctctacttccccatgggccttccctggtttttgtttttcttttcttaaacaatcctggtaatgacacttccaccacaatgagcttttaaatgtcctttaatgataagccagtgtttccttcagagggcaaaggggagactgctgagtcactgtggccatttttagataaaccttttcctgtttataataacacatgctgattgtaggaaactagaaaatacatgaaagtgcagagaaaagactaaaagtcatctatacttcaggtcgtagaaataaccactctgaacagcacacttctttttacactattgttttacactgttgggattacataaatatatatgtttgtatcccactttgtgaacatcattctatgtgaactagaaatggttcctaaacattaagggctgcatatagctgtatcatagtttatagtttatacatagatgctttgtaacattattttataatgctatgaatgctatggtgaatatttttgtgaatcaacttatgtttccaccagcagtttcagagagtgcctgtctcatcccatcctccccagtattgcatattcttgagtcttttattctttgataatgacaaatgatgaatcattgatagtttttcttcataataagtaaagtttaacattttcaagtgtttgttgaccatctgtatttcttcttttgtgaagtgctgtcagttcttttgctattttaaaaataattttgagtttcagtttttgtttgttggtctgtatgaaccctttaaaaataaaggctgttagccttttgccatcttagttgtgacagtaaagtataatgctttgctgcactaggtcctctggaacaagatgcagatttagattccaggtcagcatgtaacttgaccactgtcactcaagagttacagcctgagcagggccttaggagggagatgatttctgcttaaaggcgatacaaattcctagttagggaaatagaaggaaagtattctcaggagattaatttaaggcagcttttttgttggtttaagcacctctaacattttcatactaataagggagaatgggatggcggctgaaagagacacaaatattgtatcatttaattctaaattatgtatttgtcaggttcttattgaaagagtaaattttcgaaaggatc

SEQ ID NO: 8088 - DNA, 512 bp, Homo sapiens
ttttttccagacaaaataccacgctcacaccacacataccacaagacaaagaacaggtaaagagggcacacacacttttaccgtttataccaaaccaaaatcacgaaattcaaaatccgagtaccaaaaaattcaagccaagtcaaaaccaaaaccaaagtatccagcaattcaagtcaagtcaaaaccagaacaagagtgcccatgcaggcatgctgtgggtgatcaggccacgtttccactcagatggagtggggcaagttccaaagactagtcttaccaagtcaagccaagtcaaaaccagaacaaaagtgccaatacaggcacaccgtgggtgatcaggccacgcttccactcacgtggagtggggcaagttccaaagactagtcttaccaagtcaagccaagtcaaaaccagaacaaagatgtcaatacaggcacaccgtgggtgatcaggccatgcttccactcacatggagtggggcaagttccaaagactagtcttgacaagct

SEQ ID NO: 8089 - DNA, 9717 bp, Homo sapiens
aagttatataccttgaaagtccctgccatgacacttattagaccagattttttgatatgttgttaagtcatcctgaccctgtttatgtacaaactcaatctttgtgtggttgatggtctacatgagatatgtcaagtgtttgtcaatggatttggtccatagtaaatgttcactaagaggaagaggcagtatttaggaacatatattctatgttaaacagcctaggttgaaatgttgacttctcttatttgctatgcgatcccgtgcaagttcctgaattttgctgtgccttggttttgttatataactcctggaagtgtgacgatggccacatgagttcatacatgaaaacctcttagaaaatgcttgggacacattaaaaactcagtaactgttagctactattaccttcaaaatataaccaagtgacaaaaggggagtacaactaatcctcagaaaatcagattaatattctggctttgcgacctgtacaaagtacttaatttcccagtttagtgcctttgtctgtgaaatgatacgtaacttttatggctattatgatgataaagtaagaaatgcatgccaagtgcctaacataaaatcaatgctaagaaatggtagctattattagtaataatgataaagaattttgcaaaaatttccctttaaatcctaggcgttggtcatattgaattacttgtagtttctcaaacatgttctcttgttttcatgtgtacctgctgtcttgctttgctactccactgtattcttcacttgattgcctcctactagttcttcaagatgcaggtgtttccttccctggaaaacatttcctaaagtcaggggacgtgttttctgttttcctctattattgtacttcttatactctctaattttctattgacctattttcttccaatataagacactttcttcttgtgtgattttcagataagctactaaagtcttggtttcctcatctgtgaaacagggatgtaaaaattaaatgagatgcacttggcacttaggccaatgtctagcaccttccccaatcccaagaacataataggcagtcaacaggtgtttacttatgaaatgaaaataatgatttacaaattttattcaatctaaaaaaaaaatcagaatgtgtagaccatacataggagagagggcatccccccaaaatctgatgttaagtgaataaaatcaatgtcatgaagcagaatggtggttgccagaggctggggaaaagagggaatagacagttattgtttaatgaatacagtttcaattgtataagatgaaaataattctgaagatggatggtggtgatggttgtacaacttatgaacatatgtaatatactgaactgtacacttaaaatagttatgacaaattttattgtatatattgcaccacattgaaaaaaaatcaacatcatgaatgagattaaaacaaaggtcattttaagagaatatttctcaggccaggaaagacctggttatagcctaattagtagtgatattaacagtaggggactagtcagcatggaaacacacacaaaaaacagagtcacgttgccaggggagatgatcaatctggggactagataattccagtcactttaaaataattttgttacaaagcaggggtggtttatcaacttcaccacggcctaaaagaaatatgctcatgcataaacctctgaacaggtgatttggtgtgcagagtgctttggctttgctgtttagagagaagaacactggaaaacaggtgggtgtaggtgttgtcaatgaaaagaaagattatcctttgtaaattaatgagatggtatcctgatttatgcatatgtcccttctgttctgagtctgtttattaggagtaagtttccctttctctgatcaactcaagattgactttataggtatgaaaaatccaaagcaaaaccctcagcaatcatgacctaccaataaatgaaatgacagtttaggaatccttctgatcccccaaaaccacaacagggcaaagttcattggtaaacagcaaaaaaaattacatgaacactataaacattttttagatattttgtctttttttcaaaggaataatagtaacaaaaaaacaagagagctcataaaaagtattctgagtataaggaacataatcttaatattccatactactcatttttcaaagaatatatccaagactttgaaagtggaatcagaaatggaaaaaggaccaaaaagaaaaaaaaagatagtgaagagaatccagaaataatttggtggcaggtttttattttattcatttatttttgagacagagtcttgctgtgttgcccaggctggtgtgcagtggcaagatctcagctcactgcaacctctgcctcccaggctcaagcgattctcgtgcctcagcctcctgagtagctgagattataggtgtgcgccaccatgcctggctgattttatatttttagtagagacagggttttgccatattggccaggctggtcttgaactcctagactcaagtgatttgcccatcttggcctcccaaagtgctgggaattataggtgttagccaccgcgcccagccctgaagcaggcttttagataagattgcatgtccatgaaaattttgagggaagaaaaaaacttccaccctgttgcaaagattaaggcagtgaaaggaatctgaaaaacactggatctattatgaccaagcttgtctgctcttaatgcattccaaactcctagttccactttgcatttcaatgtagaaatataacagtgttggtaacaaagtaacatctgacattccatgataattcttggggaaaggaagtctcttttgtgaaatatagatggagtcaaatgccttaggagaagttttggtcaaaacgtggtcctctacatgagctctagaagaaatcattcggctccttctactgctgtcgtggaaacaggtttcacatagtatggcccttcactcaggtaagttctgagcctcaaataatttgggttcccaaagatttctgcaattgtcttggaattggcaagtgctttcactagttcatatttggcatcctttgaagctttgtcatgctccacagaccggtccaccacatattctacaaaacctggactgttaaacataagtttctgagcccagggttggtttgcaatggcctgaaatggaaggcagaaagaatacaattcccctgagtggaagttgtttgttaatgggatggcacaatatttacaaagaaatctggcaacatgaactttaaaaatgttaccttttgtctaagtaaattccttcctgagaatctaacttaataaaataatcttaaatatgaaaaatctttgtatacaaaaatgttcataatagtgtgaaagttacaatataaatatctaataatgggagaatggttaagtaaattatggtatatagcaataaaaataaacattaacaataatgtttacaaaaaataggaaatgatacaggtaaacctgttatataaaaaaagcagattcaaattataaacaatgcatgattacaacagtggaaaaataaaaactaaagtagaaaagactaacctcaagatactcatatagtgcacaaacattttcaagaatgttcattgtggtatcatttgtaagatactatctaaatcttcatttataggagaatgatatattgtggctattcaatgaaataccaactttctaactgcctcttttaacatagacaaattttaaaaaaacgtaacattgaagagaaaaaaaaaaaaagcaaaaactgcaattacttttgcaccaacctaatggaatgatacaaacagcatgataccacttacaaagtttatgaatatctaaaatactgtgttttatttaaggatacacacaatatgtagtagaaatatgaaatcatttatgggccctgactttgtgatagtgattttatctaagaacagaggaaggggaataggactgggcagaggtagcaagatacaactatatttgaaatatttcaccaaaaataaacacacactaatacaaaaactaaaaggaaatacaccaaaaggtagaactttctgtgattttaaaaaattctacttctaagtcttttccaaattttaagattaagtttttcaaaacctattacgttttaatgaaaaagaagtaacaagtttatggcctagttttttcctctcaaaatgtgttccacagacaagtagcatcagcaacacctgcgagcttgttagactttcaggatcccaggctctgccccacaactactgaattagaatctacattttaataagattcctaagattaatgtttgagaaactttggcctgcttcacaaccaagcatgaaagtaggcagaaataaaaatagttatcccaaccagtaaatagaaaattatttctacaatggaaccagctaagcacaggataaggtagaagagcaaaaccaaaataaactaataatgaaaatactaagcaggatccaaaatggccatctcatacaatgaccatttacaagggtgaagcagtcttaaagaaatgtttctggctaggcgcggtggctcacgcctgtaatcccagcactctgggaggccgaggcgggcggatcacaaggtcaggagatcgagaccatcctggctaacacagtgaaaccccgtctctactagaaatacaaaaagaaattagtcgggcatggtggtgggcgcccgtaggctagctgctcgggaggctgaggcaggagaatggcgtgaacccgggaggtggtgcttgcagtgagccaagatcacgccactgcattccagcctgggcgacagagcgagactctgtctcaaaaaaaaaaatgtttctgaagattataggaatacctgtatccttcaagacccagatcctgtatcgcatcctcaggaagccttccctcttttgtccctgccattttccttattccctcccagtctaggccatgtatgctgtctgagatcccattattgatatgattactaaagcgattactatcttgctatgctggggctacaaagataaatcagatatgcttcctgctctcagccaactctacttaataggtaagacaagtcgataaataaacatttgcaaaataatataacaaatagaacacaaaggtataatccttaccacagctgtaattatataagtaactgtacaattatatttactgcctggctccttcaatagacaggaaactacatgaaaggaaggtctttatatattttcttcactgttgtatgcccttcactgagcaaaaacggaaactcaacaaatatttgctgaataaataaatgcaacatatgagaaccaacattgtttaactcaaccttgtcaatctgggcaaagtgtgctgaagacaaggagttagtccttgacgagtgagtaagaggttaagaagcaaagttaaggaagagtgttagatacggagaccccagcaaaggtccagagacacaaaacaaacagtttggtaccactggagcattaggtgccagaagccttattttctgcacgggaaataaggattaggaagaccagggctaggttaatagaggatggcagataaaaagtctggaattaactgtgtgatcccatagcatcctgttcaaacctcaaacagcacctaatatcttttactgaaacaatctgtttacacatctgtctccttacttagtctctaaggtagcagaaggtagaaactatactatgcacttgtgcatccccagagatggcacaggctctggctcactgttaagtactcaagtgttgagctggcagggtcccagaaggacctatggaagtgaatacctaccgtaaacacttttaaggcagcacagtgtagttcagggaagggctgactactaatgccacggaagagctccagtggatcccgagataaagaagaaaaccaggattctgtcatcctcagaaggtcatcagtctgctgctcaggctacaggaaagaaaaggaaaatctcatcaaaagttaactgatctggagaaaagcacttatttagaagtcagacacctgagtgctgatggcactctgtcattaatttgttgtgtgaaactggctaagtctggaggactctttctcaaatccagcccagacctttcccagttttctttgaatgtggttgattaagcagtctctagagtctcttcagttctaacactctatgattccattttaaattaaaaatgtcactagtcatataatgagggttatcttcttgtatttacttcatcacatttatcatgttgattcatacagatttattctcccaaacatatcccactgtccttcattatttccctacctacttactggtaagtacagaagagatgaaattgcatccaaacatctaatttttagctccactggggcattctttgattgatgtcctattctcataagcaagcgttcaaagcgagttcctttgaaggataacagtgagattcttctttattatggtaaaatatacacaacataaaatttaccattttaaccatttttagtgtatagttcagtgctattaagtacattcacactgttgggcaaccatcataaccatccatctctagaactttttcatcaacccaaactgaaactctgtatccatcaaacaataattccctttcttctctaccctcatcccctgccaaccactattctacctcctgtgaactggactcttttaggcatctcatctaagtggaatcatacaatatctgtccttatgtgtttggcttacttcacttagcataatgttatcagtggcgcaggcttcctccatgctgtagcatgtgccagaatctcattctttttaaaggctgagtaatattcaattgtatgtatataccacattttgtttattgattcatctatcaatgaacattgggttgcttgcacctttttttggttattgtgaataacgctgctatgaacatgactgtacaaacatttgtttgagtctctgctttcaattttttttggtatatacctgaaagtggagctgctggatgaaggaaatataaaatgtacaagggttacaatttctccacatcctaacacttattattttatgggtttttttttaaagtaatagccatcctaatggatatgaagtgaaaaatgagatttttttaaagtatgctctcatacactatgacctctaccaacctaaaccaatacaaaaataagcatgtagtcagagaaccagtgacaggcctagaacacataattacacgcaacacagcatatataaggcaaagttataaaactggaatcaaaggacctggacttgagtagcagctgccataatttgtatgaccttagaaattttcttaactcctctaagtttcatctaccttatctggaaaatgaaaatgacaatgtatgttctttgcaggactgtaaaacgattgtcataggtaaaagcacttagaaaacgacatataacaaaaatattagctgtgatacacaacagcgtattaattttctttttttctttttctattttctaatttttatttttttgagatggagtcttgctgtgtcacccaggctggagtgcaatggcgcaatctcgactcacggcccaggttcaagcgattctcctgcctcaacctcccgagtagctgggattacaggcgcctgccatcacacctagctaatttttgtatttttagtagagaccatgttggccaggctggtctcgaactcttgacctcaggtaatctacccaccttggcctcccaaagtgttgggattacaggcatgagccacctcgcctggcctctttttaaattttttttttgagatggggtctcactctgtcacctaggctgcagtgcaactgagtgatcaaggctcactacagccttcacctcctgggctcaaatgattctcccacctcagcctcccgagtggctgggactataggcatgcaccaccacagctggctaattttttttgttgttgttgttgacgaagctggtcttgaattcctgggctcaaacgatcctcccgccttggcctcctgaagtgctgggattacaggtgagataattttcaacatatgtgtctcaagaattttaataattgggctgcatattattttgtgtgtaaaatttgttgtgctgttgatcctcatggatgttccataaaagtatctttctttctttctttttttttttttttacagagtctcgcactgtcgcccaggctggagtgcagtggtgtgatctcggctcactgcaacctttacctcctgtgttcatgccattctcctgcctcagcctcccgagtagctgggactgcaggcatgcaccaccacgcttggctgatttttgtacttttagtagagacagggtttcaccatgttggccaggctggtctcgagctcctgacctcaagtgatccacctgctttggcctcccaaaatgctgggattacaggcatgagccaccatacctggcctctttttttttttttttttttgagatagaatttcactctgtcacccaggctggagtgtagtggcatgatctcagctcactgcaacctccacctgccaggttcaagagattctccttcctcagcttctcaagtagctgggactacagttgtgcagtaccatgcctggttaatttttgtattcttgagtagagataggattttgccatgttgcccagcctggtcttgaactcctgagctcaggcaacccacccaccttagcctcccaaagtgctggattacaggcatgaaccattgtatctcttaacatgccaaaagtatctcttaacatgaaatcttataacaaacttttattttcctttctcaaaatttcataaatattcacaacaaccctgagaagcagttgttatgccatttttataaatgaagaaaatgaggcctagaaaagtgaagtgagtaaatgaagttcaaaaagcaaagtcagggctggatacaatggtgtggacctgtagacccagccaatcaagaggatgaggcaggaggattgcttgagcccgggagttcggggccagcctgggtaacagagagacactctcaatctcttaaaaaaaaaaaaaaaaaaaaaaagaatagaaaacccaaggacatgaatccagacctttctgactctagcccgtggtctttgtaccatgaaatctagtcaaagaagacatcatagaggggaaacaggaaacaatgtttggttgaaatcgattggtagaaacctaaaccaatgaaaacctaaaccagtgaaaagtcaaaaaaaaaaaaaaaaaggttttccgtaataattattagattttcagacatgagtacaaggtcatggttaacaagactgccacccataaaatagtttctacaatgtagttaacccaccagcaaatgaacttacatattgaacccctgtcaaagattaagatatccctgaacagggccaagtcataccaacctgttttctgtaaaacctgttttccttcaacattggatcccaagattccaactgtgtctacagctacaccaatcatagtggggtcctgactttctatcatttcaaagactttttccacaaagataggataacgctcacagatctgttgaggactatccatgacagccaggtttccaaaaaacttcacgaatcc

SEQ ID NO: 8090 - DNA, 6490 bp, Homo sapiens
aagttatataccttgaaagtccctgccatgacacttattagaccagattttttgatatgttgttaagtcatcctgacccctgttatgtacaaactcaatctttgtgtggttgatggtctacatgagatatgtcaagtgtttgtcaatggatttggtccatagtaaatgttcactaagaggaagaggcagtatttaggaacatatattctatgttaaccagctagggttgaaatgttgacttctcttatttgctatgcgatcccgtgcaagttcctgaattttgctgtgccttggttttgttatataactcctgaaagtgtgacgatggcacatgagtttcatacatgaaacctcttagaaaatgcttgggacacataaaaactcagtactgtttagctactattacttccaagatataaccgagtgacaaaaggggagtacaactaatcctcagaaaatcagattaatattctggctttgcgacctgtacaaaagtacttaatttcccagtttagtgcctttgtctgtgaaatgatacgtaacttttatggctattatgatgataaagtaagaaatgcatgccaagtgcctaacataaaatcaatgctaagaaatggtagctattattagtaataatgataaagaattttgcaaaaatttccctttaaatcctaggcgttggtcatattgaattacttgtagtttctcaaacatgttctcttgttttcatgtgtacctgctgtcttgctttgctactccactgtattcttcacttgattgcctcctactagttcttcaagatgcaggtgtttccttccctggaaaacatttcctaaagtcaggggacgtgttttctgttttcctctattattgtacttcttatactctctaattttctattgacctattttcttccaatataagacactttcttcttgtgtgattttcagataagctactaaagtcttggtttcctcatctgtgaaacagggatgtaaaaattaaatgagatgcacttggcacttaggccaatgtctagcaccttccccaatcccaagaacataataggcagtcaacaggtgtttacttatgaaatgaaaataatgatttacaaattttattcaatctaaaaaaaaaatcagaatgtgtagaccatacataggagagagggcatccccccaaaatctgatgttaagtgaataaaatcaatgtcatgaagcagaatggtggttgccagcaggctgggaaaagagggaatagacagttattgtttaatgaatacagtttcaattgtataagatgaaaatattctgaagatggatggtggtgatggttgtacaacttatgaacatatgtaatatactgaactgtacacttaaaatagttatgacaaattttattgtatatattgcaccacattgaaaaaaaatcaacatcatgaatgagattaaaacaaaggtcattttaagagaatatttctcaggccaggaaagacctggttatagcctaattagtagtgatattaacagtaggggactagtcagcatggaaacacacacaaaaaacagagtcacgttgccaggggagatgatcaatctggggactagataattccagtcactttaaaataattttgttacaaagcaggggtggtttatcaacttcaccacggcctaaaagaaatatgctcatgcataaacctctgaacaggtgatttggtgtgcagagtgctttggctttgctgtttagagagaagaacactggaaaacaggtgggtgtaggtgttgtcaatgaaaagaaagattatcctttgtaaattaatgagatggtatcctgatttatgcatatgtcccttctgttctgagtctgtttattaggagtaagtttccctttctctgatcaactcaagattgactttataggtatgaaaaatccaaagcaaaaccctcagcaatcatgacctaccaataaatgaaatgacagtttaggaatccttctgatcccccaaaaccacaacagggcaaagttcattggtaaacagcaaaaaaaattacatgaacactataaacattttttagatattttgtctttttttcaaaggaataatagtaacaaaaaaacaagagagctcataaaaagtattctgagtataaggaacataatcttaatattccatactactcatttttcaaagaatatatccaagactttgaaagtggaatcagaaatggaaaaaggaccaaaaagaaaaaaaaagatagtgaagagaatccagaaataatttggtggcaggtttttattttattcatttatttttgagacagagtcttgctgtgttgcccaggctggtgtgcagtggcaagatctcagctcactgcaacctctgcctcccaggctcaagcgattctcgtgcctcagcctcctgagtagctgagattataggtgtgcgccaccatgcctggctgattttatatttttagtagagacagggttttgccatattggccaggctggtcttgaactcctagactcaagtgatttgcccatcttggcctcccaaagtgctgggaattataggtgttagccaccgcgcccagccctgaagcaggcttttagataagattgcatgtccatgaaaattttgagggaagaaaaaaacttccaccctgttgcaaagattaaggcagtgaaaggaatctgaaaaacactggatctattatgaccaagcttgtctgctcttaatgcattccaaactcctagttccactttgcatttcaatgtagaaatataacagtgttggtaacaaagtaacatctgacattccatgataattcttggggaaaggaagtctcttttgtgaaatatagatggagtcaaatgccttaggagaagttttggtcaaaacgtggtcctctacatgagctctagaagaaatcattcggctccttctactgctgtcgtggaaacaggtttcacatagtatggcccttcactcaggtaagttctgagcctcaaataatttgggttcccaaagatttctgcaattgtcttggaattggcaagtgctttcactagttcatatttggcatcctttgaagctttgtcatgctccacagaccggtccaccacatattctacaaaacctggactgttaaacataagtttctgagcccagggttggtttgcaatggcctgaaatggaaggcagaaagaatacaattcccctgagtggaagttgtttgttaatgggatggcacaatatttacaaagaaatctggcaacatgaactttaaaaatgttaccttttgtctaagtaaattccttcctgagaatctaacttaataaaataatcttaaatatgaaaaatctttgtatacaaaaatgttcataatagtgtgaaagttacaatataaatatctaataatgggagaatggttaagtaaattatggtatatagcaataaaaataaacattaacaataatgtttacaaaaaataggaaatgatacaggtaaacctgttatataaaaaaagcagattcaaattataaacaatgcatgattacaacagtggaaaaataaaaactaaagtagaaaagactaacctcaagatactcatatagtgcacaaacattttcaagaatgttcattgtggtatcatttgtaagatactatctaaatcttcatttataggagaatgatatattgtggctattcaatgaaataccaactttctaactgcctcttttaacatagacaaattttaaaaaaacgtaacattgaagagaaaaaaaaaaaaagcaaaaactgcaattacttttgcaccaacctaatggaatgatacaaacagcatgataccacttacaaagtttatgaatatctaaaatactgtgttttatttaaggatacacacaatatgtagtagaaatatgaaatcatttatgggccctgactttgtgatagtgattttatctaagaacagaggaaggggaataggactgggcagaggtagcaagatacaactatatttgaaatatttcaccaaaaataaacacacactaatacaaaaactaaaaggaaatacaccaaaaggtagaactttctgtgattttaaaaaattctacttctaagtcttttccaaattttaagattaagtttttcaaaacctattacgttttaatgaaaaagaagtaacaagtttatggcctagttttttcctctcaaaatgtgttccacagacaagtagcatcagcaacacctgcgagcttgttagactttcaggatcacaggctctgcgccacaactactgaattagaatctacattttaataagattcctaagattaatgtttgagaaactgtggcctgcttcacaaccaagcatgaaagtaggcagaaataaaaatagttatcccaaccagtaaatagaaaattatttctacaatggaaccagctaagcacaggataaggtagaagagcaaaaccaaaataaactaataatgaaaatactaagcaggatccaaaatggccatctcatacaatgaccatttacaagggtgaagcagtcttaaagaaatgtttctggctaggcgcggtggctcacgcctgtaatcccagcactctgggaggccgaggcgggcggatcacaaggtcaggagatcgagaccatcctggctaacacagtgaaaccccgtctctactagaaatacaaaaagaaattagtcgggcatggtggtgggcgcccgtaggctagctgctcgggaggctgaggcaggagaatggcgtgaacccgggaggtggtgcttgcagtgagccaagatcacgccactgcattccagcctgggcgacagagcgagactctgtctcaaaaaaaaaaatgtttctgaagattataggaatacctgtatccttcaagacccagatcctgtatcgcatcctcaggaagccttccctcttttgtccctgccattttccttattccctcccagtctaggccatgtatgctgtctgagatcccattattgatatgattactaaagcgattactatcttgctatgctggggctacaaagataaatcagatatgcttcctgctctcagccaactctacttaataggtaagacaagtcgataaataaacatttgcaaaataatataacaaatagaacacaaaggtataatccttaccacagctgtaattatataagtaactgtacaattatatttactgcctggctccttcaatagacaggaaactacatgaaaggaaggtctttatatattttcttcactgttgtatgcccttcactgagcaaaaacggaaactcaacaaatatttgctgaataaataaatgcaacatatgagaaccaacattgtttaactcaaccttgtcaatctgggcaaagtgtgctgaagacaaggagttagtccttgacgagtgagtaagaggttaagaagcaaagttaaggaagagtgttagatacggagaccccagcaaaggtccagagacacaaaacaaacagtttggtaccactggagcattaggtgccagaagccttattttctgcacgggaaataaggattaggaagaccagggctaggttaatagaggatggcagataaaaagtctggaattaactgtgtgatcccatagcatcctgttcaaacctcaaacagcacctaatatcttttactgaaacaatctgtttacacatctgtctccttacttagtctctaaggtagcagaaggtagaaactatactatgcacttgtgcatccccagagatggcacaggctctggctcactgttaagtactcaagtgttgagctggcagggtcccagaaggacctatggaagtgaatacctaccgtaaacacttttaaggcagcacagtgtagttcagggaagggctgactactaatgccacggaagagctccagtggatcccgagataaagaagaaaaccaggattctgtcatcctcagaaggtcatcagtctgctgctcaggctacaggaaagaaaaggaaaatctcatcaaaagttaactgatctggagaaaagcacttatttagaagtcagacacctgagtgctgatggcactctgtcattaatttgttgtgtgaaactggctaagtctggaggactctttctcaaatccagcccagacctttcccagttttctttgaatgtggttgattaagcagtctctagagtctcttcagttctaacactctatgattccattttaaattaaaaatgtcactagtcatataatgagggttatcttcttgtatttacttcatcacatttatcatgttgattcatacagatttattctcccaaacatatcccactgtccttcattatttccctacctacttactggtaagtacagaagagatgaaattgcatccaaacatctaatttttagctccactggggcattctttgattgatgtcctattctcataagcaagcgttcaaagcgag

SEQ ID NO: 8091 - DNA, 353 bp, Homo sapiens
tacattgtggaaaaaaagtgtgtgtgtgtgtgtgtgtgtgtgtgtgtgtgtgcttacatatctataaccaagaaaaatgtaaccaagtcttattttgctttataattagtggacttttaaaaatcattctatggtactgttatgactcagtgatggcagcagtgactcagtgatggtggtgaatgctcagaattaaaaggaaaaccttaaataggggaatttttgtaataaaatgttattcttggctgggcgcggcagctcatgcctgtaatcccagcactttgggaggctgaggcaggcatatcacctgaggttgggcattcgagaccagcctggccaacgcggtaaaaccc

SEQ ID NO: 8092 - DNA, 339 bp, Homo sapiens
aaaaatgagatttttttaaagtatgctctcatacactatgacctctaccaacctaaaccaatacaaaaataagcatgtagtcagagaaccagtgacaggcctagaacacataattacacgcaacacagcatatataaggcaaagttataaaactggaatctaaggacctggacttgagtagcagctgccataatttgtatgaccttagaaattttcttaactcctctaagtttcatctaccttatctggaaaatgaaaatgtcaatgtatgttctttgcaggactgtggaccattgtcataggattaagcacctagttatcgacatataacaaaattat

SEQ ID NO: 8093 - DNA, 353 bp, Homo sapiens; identical to SEQ ID NO: 8091

SEQ ID NO: 8094 - DNA, 9717 bp, Homo sapiens; identical to SEQ ID NO: 8089

SEQ ID NO: 8095 - DNA, 6490 bp, Homo sapiens; identical to SEQ ID NO: 8090

SEQ ID NO: 8096 - DNA, 353 bp, Homo sapiens; identical to SEQ ID NO: 8091

SEQ ID NO: 8097 - DNA, 339 bp, Homo sapiens; identical to SEQ ID NO: 8092

SEQ ID NO: 8098 - DNA, 353 bp, Homo sapiens; identical to SEQ ID NO: 8091

SEQ ID NO: 8099 - DNA, 699 bp, Homo sapiens
aaacaagctcattgttaattcatgcagttttaatttatgcataggagaattatgcaggataattacctgcagttgaaggaaaatgaatagcgtcagatgtggttaattcacgcatggtttacccttctatctctctatcagaaaagatttaaagtggtaaccaatctgaatgatatgcaaaattgcattggtttgctaagtagaagtattttttttatttgcatcacaaatagagttctcagatttggactgactagatttgaatataatttccagaacaatagctgtgattcactgacttaactcatatgttatctcttccagaagtgcccatttttcaaatcagtgcaaaagaagctatcttcatgggccccatgttagcctgagtatagtttcctttatgaggataattcaatgagaatgataattatttcctatatcaagatttgtgggagatttacggtaatgatcacactacttgttcccacattgtccctgaaccttcatgatccagtggcttccaaaaactgaaacaaacagctggaacaaattatggggcaatgaatggacatcagtggaaatttccttgtgacttttgtcaagcaatagatagctgctaaggcctctttgaactcacacctagtaattgagagaaggctaagaggtggttcaagtttactgaaaaaaaaaaaaaaaaaa

SEQ ID NO: 8100 - DNA, 915 bp, Homo sapiens
caccacacccagctaatttttgtattttttgtagagatggggtttcaccatgttggccaggctggtctcgaactcctgggctcaagcatctccctgcatcggtctcccaaagtgctgggattacaggtgggagccaccacgcctggccaagcttctcatacaatgaaacatccaatctaaataaacatgttttatattattataaaagtaatagctatcactaaatagcatttctaatgtgccaggcacatgtactaattcattgagtgctcacaacaccctgaggtaattactccattttatagatgagagaatggaggctctgaaaaattactaagaggcagagcttggttttaaacctaggccgtctggcatcagagtctgggctgtgctgcggctgtggatgtaaatacacagactccaaattcagagccacagttcccacagcaactgccagtttgtagcatgttcaaaaagcccgagttctcccacataacttagctgagttgtggctgccagatcttttggcttagcaactcgaaacagagactgtccacgtaggctgaggttctcagttgataccaaggcgttgatgagactcttcaggcttctattataatcaagaagaagatttttcacatcctccatctgaaaggttcattattccagctgggtaagctgtgtgtctgcaaagatgccctatcatcaggaaatgaaatgggcactttttctccaagtaagcaatgcatgctgataaataacgccatatcagtggcgtgccttctccttcctcttgcaaacgattgacgcctcagagatctgaacaaccccacaaaaggggaggaaaatggagaaaaaacaaacttgagagaaaaaaggaatcattccttttcttttgtgaggacttttgtctga

SEQ ID NO: 8101 - DNA, 1956 bp, Homo sapiens
cactgggagctgcagaccagagctgttcctatttggccatcttgccagcaatcagaccagagttttaaatggactacaaaataggtcaaactctatttcagaactagaggctaggaataatgtccaaacttggttatgaaagttttttttttttttggtctggtaggataagagggtttttactcatcttaagtttgaattaaactttgtaacaaagttattgtttttttaaacaatgcatgtatcaaattatctgtctcattagataactaggtagacttttccaagatggtttcaaaatcaaatatatattcaaagatcttccagtgtaaagcaataggaatgaaacaagccatgagaaagcagaatattttgagtatattctcatgcctttctttaaaggagaagcgcctatctaaacagttacagaaacccaaattcaaagtagattaaacaagaagtaaatttgtaaactcttttaactgggagacaggaagtagggagggctccaggcacaatatcattagcagttcaatgtgaacgaagacccatgtcctttccaagcctccctctgccatcagcattgccctccttcccagggtcacagatggctatcaatggcaaaactggggttccgcgttctcttctcctcatctggcaagagaaaatgggaaatctctatcccaagcttggattaaaaattattttcatttttgtgttccagcaaacttgggtcctatgcccagccatggaccaaaaataggcttaatgtgaatgttatgtgctgattggattaaaataagttctgactctgaatctgggaatgtggtcaccttcctcagagacaagttgagaggttggcttatctgaataaaagcagagaatatgagatgctggagaggtgttcattaaggagaacattccctgaggtgaattaacggttagaattatctatctctgtatttatctatccacccatctatcatcatcatcacctcatctccctcctttctctctctctaaatatatacatgcgggtatgttgagtgtgtatatatttatttttttgtgtgtttatatggtgtgtgtgtgtgtgtattccaggcagatgtgtgcatatatacccaaactttcctgatgaccttgaaattaaatgggtcatgtgaagctaaagattatagaaccccttgattcctttataaacagtatttctaagataagatcaacactaatctttcaaattagttgactgtgtatagaacaacttgtttatttaaagtcatctagtctaatgcaatcaaggagtaaattataaataaccagttagcataaatggaaagaaaatagttccttttctttgaattcatttcatgtttaatttttcttgcgcacatatagaaatgaatagaaatattcccatttcaatatgcaaattcagccactatatagtttgtttctttttggtagctaataataataaatttttaagtaagatctgattttgaaatatgaaaagaagtttatcctttcctgttttaataccacctgatacccgtttaacttactgtgtttgattcttggggacatttatgttcaaggttctgtcaaagcaatctattattcttgtttttacctgatggatcatggagaaaaataatggattcagttatgagaaacagtaatagatttttttaactgccataaatttctctccctgtattaaataaaaggatcaggaaaagataagttgaattttcctacaatgagccagctcttcttaaatttacctcccataaattgtagcaaagcacttttcatataatgttttatttatgtaattcagttatttggagatggtggtgagggatgtgagtacatcatttcatgttgtatttcaaatctcttttgacagaaaccctaagaatttgcaataaagaaaattcaatgttccattaa

SEQ ID NO: 8102 - DNA, 1957 bp, Homo sapiens
cactgggagctgcagaccagagctgttcctatttggccatcttgccagcaatcagaccagagttttaaatggactacaaaataggtcaaactctatttcagaactagaggctaggaataatgtccaaacttggttatgaaagtttttttttttttttggtctggtaggataagagggtttttactcatcttaagtttgaattaaactttgtaacaaagttattgtttttttaaacaatgcatgtatcaaattatctgtctcattagataactaggtagacttttccaagatggtttcaaaatcaaatatatattcaaagatcttccagtgtaaagcaataggaatgaaacaagccatgagaaagcagaatattttgagtatattctcatgcctttctttaaaggagaagcgcctatctaaacagttacagaaacccaaattcaaagtagattaaacaagaagtaaatttgtaaactcttttaactgggagacaggaagtagggagggctccaggcacaatatcattagcagttcaatgtgaacgaagacccatgtcctttccaagcctccctctgccatcagcattgccctccttcccagggtcacagatggctatcaatggcaaaactggggttccgcgttctcttctcctcatctggcaagagaaaatgggaaatctctatcccaagcttggattaaaaattattttcatttttgtgttccagcaaacttgggtcctatgcccagccatggaccaaaaataggcttaatgtgaatgttatgtgctgattggattaaaataagttctgactctgaatctgggaatgtggtcaccttcctcagagacaagttgagaggttggcttatctgaataaaagcagagaatatgagatgctggagaggtgttcattaaggagaacattccctgaggtgaattaacggttagaattatctatctctgtatttatctatccacccatctatcatcatcatcacctcatctccctcctttctctctctctaaatatatacatgcgggtatgttgagtgtgtatatatttatttttttgtgtgtttatatggtgtgtgtgtgtgtgtattccaggcagatgtgtgcatatatacccaaactttcctgatgaccttgaaattaaatgggtcatgtgaagctaaagattatagaaccccttgattcctttataaacagtatttctaagataagatcaacactaatctttcaaattagttgactgtgtatagaacaacttgtttatttaaagtcatctagtctaatgcaatcaaggagtaaattataaataaccagttagcataaatggaaagaaaatagttccttttctttgaattcatttcatgtttaatttttcttgcgcacatatagaaatgaatagaaatattcccatttcaatgtgcaaattcagccactatatagtttgtttctttttggtagctaataataataaatttttaagtaagatctgattttgaaatatgaaaagaagtttatcctttcctgttttaataccacctgatacccgtttaacttactgtgtttgattcttggggacatttatgttcaaggttctgtcaaagcaatctattattcttgtttttacctgatggatcatggagaaaaataatggattcagttatgagaaacagtaatagatttttttaactgccataaatttctctccctgtattaaataaaaggatcaggaaaagataagttgaattttcctacaatgagccagctcttcttaaatttacctcccataaattgtagcaaagcacttttcatataatgttttatttatgtaattcagttatttggagatggtggtgagggatgtgagtacatcatttcatgttgtatttcaaatctcttttgacagaaaccctaagaatttgcaataaagaaaattcaatgttccattaa

SEQ ID NO: 8103 - DNA, 546 bp, Homo sapiens
gatgatctttacaatttggtatgtttttgcagtggctggtattgattgttcctctctatgtttagtgcttccttcaggagctcttttagggcaggcctggtggtaacaaaatctctcagcatttgcttgtctgtaaaggattttatttctccttcgcttatgaaactgagtttggttggatatgaaattctgggttgaaaattcttttctttaagaatgttgaatattggcccctactctattctggcttgtaaggtgtctgcagagagatcctctgttagtctgatgggcttccctttgtggctaacctgacctttctctctggctgcccttaacattttttccttcatttcaaccttggtgaatatgacgattatatgtcttggggttgctctgctcgaggagtatctttgtggcgttctctgtatttccttaatttgaatgttgacctgtcttgctaggttggggatgttctcctggataatatcctgaggagtgttttccaacttggttccattctccccgtcactttcaggtacaccaatc

SEQ ID NO: 8104 - DNA, 1215 bp, Homo sapiens
cccccccacactcagtaaagaattttccaacccaaaatatcattagtcctgaggttgagaaaccctgtcctagcctaactgtgtacctctatagctatgttttatagttttagaatattaaaacctcagatatttatgtgggtaggtacttaaatggccaaaaactttaactatgaaatgttactgtgtagtatattgaatataggaagtgatgaagattataggtattttattcccatgtttccatctataaatagccttctcagattcagaaaacaatacagagaacatcagaaattttctaaaatgggtcactttgaaaagaattctttttctcactattaatgctttagaagcaagacgcaattttaaagctttagttccttttctttcagtcattgtcttagtttgggtacaaaaatgtcatttcagtaatgtactgaaatcttataagtgaatagttgaagctagtaaaaatgataccagtataaaaatggtacttgtagtccatgagcttgaacccaatgactgattgtttgacttttaaaataagtaatagcagccatttgggagtagggggtaggtggggaagatgtactccgtatcaaataataatgatgttgaaataatgatagtaggtatgtattatggattggagaagcacttattacactatctaacctaatatgtagaacaattcttgagagttgtatctgtcgttatttctgaatgtgaagctcagagaagtgacacagagtaaatggctgatcttctatattgtagtatattttgtccttccctcttccctgaggaacaaagcacgtatctttagtctctttgatatttattctgagaccaagggcttgcttgacctgatgattttccttcagctctctgaaggtgctttttccacaatccaagtgattctgatacacactaaagttgagaatcactgcactagatcactttgtgttttctgattttcaaggttgatacgtagctttaatacagctcttctgttgacagttattactttaattttgcatttgttccttgtaagaatggctggaaactgtgtgttgacatttgaggatgggtatgcaaggaaaaaatatacttctgtttacttactctgactttgaaatagtgttatttttctatatctgaaataaatgcttctaccatagaaataaatttgcctatactatctgagaa

SEQ ID NO: 8105 - DNA, 2687 bp, Homo sapiens
agatgaaaagattggattccgaaatgatgcaaattttgactggcaaaatgtggcagatttcagggatgcaggtggatccttaactgaggtcaaggtggaagaggaagaaagggatccgcagagtcctgaagtaagtattagcctctgtaccctcttttaatcttttcaattctgatgtgggagattattgttcaggaactgttaacacattccaagattttcaagcttatttaaaaatagtacataacaagtcattctgcttttctctttacatcgttaatacttttcttcccacctaaatataattacctaggttatatgtattacagacatcaagtaattcagtgtaaatgatattcaaaattcaaattaagtatttttccccaaacgacgcagaaagcttttaagaaatatttagacaaattgccacaaagtagaagtcaatactgaaaattgcttttctctttgctcttagtttgaaattgaggaggaggaagaaatgttgtcatccgtcataccagattccaggagagaaaatgaacttcccgatttcccccacattgatgagttttttacccttaactcaacaccatctagatctgcatatgatgagcctcatttgctcgtaaatattgagaaacagaaactagagttggaaaaacgacgactggatatcgaggccgaaaggctgcaggtagaaaaggaacgcctacaaatcgagaaagagaggctgcggcatttagacatggaacatgagcggcttcagctagagaaggagcggctgcagattgaaagagaaaagttgaggttacagatagtcaattcagagaaaccgtccttggaaaatgaacttggtcaaggagaaaaatccatgcttcaaccacaggacatagaaacagagaagttaaaacttgagcgagaacgcttgcaactggaaaaggataggctgcagtttttgaagtttgaatctgagaagctgcagattgaaaaggaacgcttacaggtagagaaagacagacttcgaattcagaaagaaggacacttgcagtgatttttccaggcttccatttagcaaatgtttgaaaactctagatttttctcatatcaggtgatataatgatggttgctggattagctgtggtttcttgtctaatgtcagtgttcagtaggaaaaagttatatgtggataactgtatgcctaagtagtatataaaagctgtgccctagcgtaaacagtatagcagaaacttactgtgctggactctttaccttataatattacatagagtcttgtattgtctgtgtacccagagtttacaattatgtccatataaaattctagcccagaagttctcatctggggtagattttggccttcagaagaccaatttggtgatgtctggagacatgttgggttgtcaaaactggggtggggaaaaggttgctactgtgcaatgcatacctcctcaacacccccccacactcagtaaagaattttccaacccaaaatatcattagtcctgaggttgagaaaccctgtcctagcctaactgtgtacctctatagctatgttttatagttttagaatattaaaacctcagatatttatgtgggtaggtacttaaatggccaaaaactttaactatgaaatgttactgtgtagtatattgaatataggaagtgatgaagattataggtattttattcccatgtttccatctataaatagccttctcagattcagaaaacaatacagagaacatcagaaattttctaaaatgggtcactttgaaaagaattctttttctcactattaatgctttagaagcaagacgcaattttaaagctttagttccttttctttcagtcattgtcttagtttgggtacaaaaatgtcatttcagtaatgtactgaaatcttataagtgaatagttgaagctagtaaaaatgataccagtataaaaatggtacttgtagtccatgagcttgaacccaatgactgattgtttgacttttaaaataagtaatagcagccatttgggagtagggggtaggtggggaagatgtactccgtatcaaataataatgatgttgaaataatgatagtaggtatgtattatggattggagaagcacttattacactatctaacctaatatgtagaacaattcttgagagttgtatctgtcgttatttctgaatgtgaagctcagagaagtgacacagagtaaatggctgatcttctatattgtagtatattttgtccttccctcttccctgaggaacaaagcacgtatctttagtctctttgatatttattctgagaccaagggcttgcttgacctgatgattttccttcagctctctgaaggtgctttttccacaatccaagtgattctgatacacactaaagttgagaatcactgcactagatcactttgtgttttctgattttcaaggttgatacatagctttaatacagctcttctgttgacagttattactttaattttgcatttgttccttgtaagaatggctggaaactgtgtgttgacatttgaggatgggtatgcaaggaaaaaatatacttctgtttacttactctgactttgaaatagtgttatttttctatatctgaaataaatgcttctaccatagaaataaatttgcctatactatctgagaa

SEQ ID NO: 8106 - DNA, 498 bp, Homo sapiens
tgtcgttatttctgaatgtgaagctcagagaagtgacacagagtaatggctgatcttctatatgtagtatatttgtccttccctcttccctgaggaacaaagcacgtatctttagtctctttgatatttattctgagaccaagggcttgcttgacctgatgattttccttcagctctctgaaggtgctttttccacaatccaagtgattctgatacacactaaagttgagaatcactgcactagatcactttgtgttttctgattttcaaggttgatacgtagctttaatacagctcttctgttgacagttattactttaattttgcatttgttccttgtaagaatggctggaaactgtgtgttgacatttgaggatgggtatgcaaggaaaaaatatacttctgtttacttactctgactttgaaatagtgttatttttctatatctgaaataaatgcttctaccatagaaataaatttgcctatactatctgagaa

SEQ ID NO: 8107 - DNA, 310 bp, Homo sapiens
acatctcttaccataaaaactgcattgaaattgaaaatgaagcagttgaaaagaaaaaggaaaagcaattttagtgttcaagaaactcagacccttttgaaagaaattacgaaaaggaaagaagtcattttttccaagcagctcaatacaacaattaatgtgatgaagcgaatggcttgggaagagattgcacagtgtgtgaatgctgtaggagaaggagaacagaggacagggacagaggtgaaaagaaggtaccttgactggcgagcacttatgaagagaaagaggatgaaggccaacattaagctgg

SEQ ID NO: 8108 - DNA, 82 bp, Homo sapiens
tttgttttgagacagagtcttactctgtcacccaggctggagtgcagtggcgcgatctcagctcactgcaagctccacctcc

SEQ ID NO: 8109 - DNA, 956 bp, Homo sapiens
gtacttcaaaacccccgaggcctagatctgctatttctctcccaaggagggttatgcgcagctctaggagagagttgttgtttctatgccaatcagtctggggtcataaaggatactctccaaaaagttcgagaaaatctagatagacgctaacaggaattggaaaataacacccctggtaccaaaacatgtttaactggaatctatggctaactactctaatcactggattggcgggaccccttctcctcctcttgttaggtttagtcttcgggccttgtatattaaattggtttcttaaatttataaagcagttcatagcttctgtcaaacttacgtatcttaaaacccaatataactcccttgttgtgactgaagaatcaatgatttgattacccaaaacatgagtggggaatgtgatacctaccctgttttaacctgccccaagtttacgtgtacagtgggtcagaagggtgacttctgacccttctgctcagagtgactctctcttagctgagatagctggacactctccattttagcttcttcacttgcagtccccttatccccctcccttaagggaataactagtgcaagctgactccaagcacatccaggaatgcacttactgataagatattgaggcaagctgtaccagcagctcctggggacgtgctcggcggatggtacccaagcccctgcatttatctctttgtgatagtttaagcccctgcacctggaactgtatttttctgtaactatctctgtaaccattaatttttttaactttttgcctgttctgcttctgtaaaaattgcttcaagtaggctccccctcccctatttagaccatggtttaaaaagaaatctatcccgttcttcgaggccaagagaattttgagctctagccatctctcggtcgccggcaataaaaggactcctgaattagcctcagaa

SEQ ID NO: 8110 - DNA, 954 bp, Homo sapiens
gtacttcaaaacccccgaggcctagatctgctatttctctcccaaggagggttatgcgcctctaggagagagttgttgtttctatgccaatcagtctggggtcataaaggatactctccaaaaagttcgagaaaatctagatagacgctaacaggaattggaaaataacacccctggtaccaaaacatgtttaactggaatctatggctaactactctaatcactggattggcgggaccccttctcctcctcttgttaggtttagtcttcgggccttgtatattaaattggtttcttaaatttataaagcagttcatagcttctgtcaaacttacgtatcttaaaacccaatataactcccttgttgtgactgaagaatcaatgatttgattacccaaaacatgagtggggaatgtgatacctaccctgttttaacctgccccaagtttacgtgtacagtgggtcagaagggtgacttctgacccttctgctcagagtgactctctcttagctgagatagctggacactctccattttagcttcttcacttgcagtccccttatccccctcccttaagggaataactagtgcaagctgactccaagcacatccaggaatgcacttactgataagatattgaggcaagctgtaccagcagctcctggggacgtgctcggcggatggtacccaagcccctgcatttatctctttgtgatagtttaagcccctgcacctggaactgtatttttctgtaactatctctgtaaccattaatttttttaactttttgcctgttctgcttctgtaaaaattgcttcaagtaggctccccctcccctatttagaccatggtttaaaaagaaatctatcccgttcttcgaggccaagagaattttgagctctagccatctctcggtcgccggcaataaaaggactcctgaattagcctcagaa

SEQ ID NO: 8111 - DNA, 182 bp, Homo sapiens
gtcgaattagcaccaggtataacttatctgcttctccctttcaggctacctgtaatcagtctctacttacttccttaaacacctcagtctcctaccaggcacccaacaatacctggctggcctacacttcaggctcactcattgcatcaatgggactgaacctggacctctcctgtgcgtgt

SEQ ID NO: 8112 - DNA, 182 bp, Homo sapiens; identical to SEQ ID NO: 8111

SEQ ID NO: 8113 - DNA, 1869 bp, Homo sapiens
gaaagctgaaaggtgctggaagcctcctgcactttgggaatatacagtcaggaacaattgtcaggagttctgtagttgattctgtaggttgggattgccataaggttggttagaaaaaagatgtgcgaaagctttcctgagggtttttgcccttgctttcacatgtcccataattgaaattaagaactgctggcaactggttagtgaccagtgttgaaatgggaaaatattactggcttatgcttttgcttatagatattgaaatttaataaaatttaaccatagttacatatgattctatgaaattaggtaggctcttcaagaaaaatgtgagcaatgtaaggcagggtatttttgggaggggggtgctttattgtataggcaagctctcgaacagtgtctgataattagtagtgtctgacaatatttgctgaatgagtgaactcatggtaacataactccagtatggcagattgattcttggtgctttttttccagtggcaaacttttatagaaattggagagtttcgtaaagacttttaaaaagttgtcagaattacctattatgtcctttcctagataatcaatttggaaacaattgctggtaccttaagcccgatgtatgcctcctattatagtgttgaaaatgttcttttgacaaatgcatcaatgaccaggcacatgagaacagtgcacagctgtagaaaaacaacaatgaaggtcttcgacacaggagagagtctgcactgcatcacagctgatccgaaagttaaattcaatgaaaaggcaaatattttggtcaggagaggaattcttcctagggagtattagcacagtgtatttttagttgtgtggctatttatagctgcccaatggcttgcgtctgagtctttatttggtttttaggacatgctaaggattgagggtcgtgggccttaattgtatagaagacgcagttgcgtttggttgcctggaggcttctctgtgaagcctggtgggacacctgctggccagtttggcccttcttagtgaaggtgatagagacaagggcagaaggtcattgtatttataggatatttgaagcttatcttgtttactttgttaataatacttgagtcatttttctaaacattctttgcataacagcaaagattaaaaagataagtaatgtaatatattaggccctagttgtcattcacctgttcttgtagagctgatacttttttcttgatcaaattttaggtttaatcatatttagcttagaagagtggtctgtcttaagagtattctgattatttaggaacatctagatgaaacttctttgccttagtccatcgtttctcctttaaattcctaaaggcaggaatgagtgtttcttaaaaccaacatgtataaagcaacattttaggcaaactgggatgaggaaaaacatcttgaagggggcttcataatggtgttggagcctgttaaaaatgtggaatggaaagccgatcatgaaaacagatagtactgacttttggcaaaatgagtctttatgaaaacataccttaatgattatctgacaaatgcaagtgctttttgaggttaacagaattataaacaggagactgcagacactaaggtcactactgagcagcacgataattcgtgtggtgtgttctttttaaagattaacaatcttaagtcttttgtatgttatgttgctaagttatttgggggaaagtgttaaaataagtgctcttactttctttctccactgcttttgcacaaaaactttactgttcaaagaatattgtccattcagtttactttttatttttaagatgaagtatcccccaaactggtcatgccaggaaaaaaaaaaaaaaa

SEQ ID NO: 8114 - DNA, 221 bp, Homo sapiens
cagcatgctttcttccgtcagagtgctggagagggagctgttagttatcttggacctggaaagggcccagaaaataggtgatttattcctggttgactttcagagttaacaacacattgaagtgtgaactctgttcgctgtatgtgtgtcttgcatgctactagatgagatggtgacagaagcaagacatagaaaaaataggttatttattaaactcaaac

SEQ ID NO: 8115 - DNA, 27382 bp, Homo sapiens
ggtccactgtatagtttatagaattagttttttagtggagttgatgatgcctttccagttactaaaaaatcttcatttagcattcagtcgtagtacctgggaatcatggaggtggggagtgaatgaattgccatgtgggaggaagtgagagtaagtggaaagtggcttttccaggctgacatttgatgccattgggatctctgatttttttcctctctccctcccctccccctgaggaaacaatgcccttttgataataatttgctctctgcctgcctgacaagtactcagctgagatttctcagccaacaagacagtacaaacacttgcggtaccaagcaccactttctcaaaccctggcctcattgaggtgataacaactgtcctgctcaagggattccccctttccccctcttcctcactccttcccccacctcctcttggtgttatacagggatatcatgtccatttataaggagcctcctccaggaatgttcgttgtacctgatactgttgacatgactaaggtatgtaacttgatgggggtttggggggttttgggaaattgggggccataaggttgcaaaagcctaaaagagattattcagctcacctctccgattacacagatgaagaaatcaagaccccaggagagtaagtggcttgtccaaggtcacatagtgaggtggagcagcactttgaagaggtgtctgttattagtgtaccccataggtactgattggcttggaaaatcccagttcatgtctgttgtcgcagcttgactatttatagggcattctttcactctcaaaaatgctcctgtttggataataaattatatggtcaccctatccattgtactacccagctcttcccccatcccgttactcttgacattaactatgctatggtactataaatcagatgtagggaaggttgggaatagggcaagcttgactgaagtgtttgtggttaaaggactttgctcaggatcctgtccttactggttgcgtttaagtatcccttccaccccaaagactatacctctcttgtcctcctctcagagagaaagcttaatacataatgtcacatttctctggcatagatacctaggtttctctgtcactgaatgctctacccacagaagtgcagttgcacttaaactgatgttagaaagaaatcatatttcctaaacctaatgctgtttaagtgaaacacatagttttcttacagtaaatttcttacagtaaaaattcagattttgtattgttggtgtatctttttttgttgttttgaatagatttcccttcatattttttttttatgtagttagaaatgtttttcctaggacatctcgtcctcagtcaagtaccagtgttaatagcctagtacctggggtcccagagttgatgccatgttgagaccagttgagtttactattccaaatgactgagagccagaatatgacgtagggtcttgccaggagggcaaggtgggaactatagacttaggcattggattgccacgtccctttccttttgctgttcaaatgcttagcagacctaaatgcctaggagcctttgtggaagaagaaatataactgagtcagttcaggttttcctcccttcagggggggaaatcctgttgaagaattatggcttgagggggaagagaatttagtgtcgttttcaggacggctgattttttttttttttttttttttaaacagtattggggaaagttctgggactggtctaatggctctgagtggaccctgagtcttccccattttcagtcatgatgtgctgcctgagccacatcctccacaataggtttgatcctctgcagaggaagcaagcagataccctaggcatccatcacaccccctaaccctgctgtgttactggcactgggctgtggcctccaatccctttcttcgtctcctttcatcatactttcccttcgtgccacataaatgtagggtggggttgcatcatatgcatgtttggcctgggcaaatccaaacatatattcagtcaaaatctgtgtcgatttctcaaaattaaaaacgctagggttatattttatagataagcatattatatttttccacagtggtgttttatccattatatgtaacactgatcagggaggtctgcacaaaaaaaaaaaatgctttaagagagttttaggggatactcaagagtgattttgactagattcagttttcgccttgggctctaactttagaagtaacccctgagtaagatgtcattccactgtaatgagatttcttaaaattccaaacctacgtattagtatgagtgaatacaggatgttccttctgcatggtgaggatatagaacatgtgtaccagattatggactctgcttctggtgtgggtagtaggtggagggtagccaggagggcttggggtgggtcatcacctcacaattttgagatggggttttattttgcagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctagggtaagaggagacttttaagtagccaagtcggttgttagcagataattactctaggtcagcctttatcaaccggagtccctcatctgaactacagaacacagaaaatgattgagtgactcttctcaaatctcctcaggatggtatgtgactagtatcattctagatgcagaggggagaagttaatttattacagtggtaacctttgagaagtggttctcttaagagtgtggccctgagcatctgggaacttgtagccgagcagtttctggggccctatcttagacctacaaaagaaactctggggttggggccaaaaatctggtttttttggttgttgttttttgtttgttttgagacggagtcttgctctgtcgccaggctggagtgcagtggcacgatcttggctcactgcaacctctgcctcccagattcaagcgattctcctgcctcagtctcccaagtagctggggctacaggcgtgcaccaccacacctagctaatttttgtatctttagtagagacggagtttcaccatgttggccaggatggtctcgatctcttgacctcatcatccactcaccttggcctcccaaagtgctgggattagaggcatgagccaccgtgcccggcccagaaatctgttttttacaagctctccagatgattgtggtgcatactgcagtttcagaaccactctcttggggtgttaaggccttattttctctcctgaacaggttgagaaaggctgcaggtctgtgccattcaagatttggggtgtcttaatttgagtcttgcaataagttgctttgaaggcagtggcggtggtggtggtggtgatcattatggtttcatttttgttttgttttgtttgtttttgttttgttttgttttgttggtagaggcaggtatctcactatgttgcccaggctggtcttgaattcttgtcctcaagcagtcgtcctcttgtggctcccaaagcactggggttacaggcatgagcctccatgcctgacctgattataatattttaataatgacaaatgtctgagattggaaatcacattagatatgaaatgagtttctagtgcatcttctttctggatgcttctgaggttttgcttcatagagttcccattttagttgcctttgggggctgaaaactcagtgtggacatcttctcgcatattttggattggtgtttttatagtggtctgaacttctctgggacagagaacacgtgcaggttgaagttgagaaagtacccccaaactgattattctgttttcctgctatccaacatgtttccaggtttgtgtgagggaagagcagcatttgaaataaacttagagacatgattcatttttctaggacttgctcagacccagggatatgttctgctgtgattttggcagtgaagaagtcttttaaaggaggttgtccttaaagaagtacttcatctcgttagggtacttaattaattgtctttgctggtaggctaaaacccatgatgataaagaaatttagtcgttgcttctgtatgaaatttgttcgcgaaagcgtgtctcaaagtaggctctccctcattgggtcaatataaaactcttttgagataccagccacaggacagtggggtaaaagtagtagaagtgtgttaggtagaaaaggagaagctgccctgaaattgaaaatttgccataaagaatcacagagtagaaaatttcagccgggtgcggtggctcacacctgtaatcccagcactttgggaggccgaggcgggtggatcacctgaggtcaggagttcgagaccagcctagcctggcgaaaccccgtctctactaaaaatacaaaaattagccaggcatggtggcgcatgcctctagtcccagctactcgggaggctgaggcacaagaattgcttgaacctgggaggcagaggttgcagtgagccaagatcacgccactgcactccagcctgggtgacagagggagactttgtctcaaaaaagaaagaaaagaaaattcttaggtgttcctagttgactgtattagctttatcagccatgttttttttttcctctttacctagaaaacaatgttgggctgacttactgacaaaagaaatttaacgagagttgactctgttgtaaagcttcagagagcagtaggtctagagttcctgggggagcaaagctgaaaagatagaggcacttaagagcagtccccagtgaagttactattaggcattactgacttgggctttcctcaagtacagcagggaaacagaagcaggcagtcaacttgaacaagccagtcctggcttaggttgtgttcggcttccagctccggtgccatctcttcaattaattgagctaaaaataaatgtcattaacatccaagctgtcccctccccctaatacttggttgggtttatgaaagagaggagcaattttggtatttgacgttttccatatattattttcagaccttccactgtctggaagcaccccttattctcttcctgttctttggaagagttgtgtagtcttaagagaatttgacactccttgggggtttgatacagaactggatccccaatagccccaccacatggcctctaaccagatggcttcagtcacctgtgtccctttatgctcaacttccctctcccctcactaactccatcaccacccataaacaagctctttgagatccacggagattaacatttagacaactttggagctaattgcttacctaatttcttttgttttgattgtcgtaactgtttctagtacaaagaaaatcccttcaaagttacatagcttgctattacctgttcttttgccccccccccttgatttgaggattaggcaattgactgatttctggtgaaatcagaacatgagcatgagacagaggctgggaaattccagagtattaatagtgaaagagaaacttatggtgagtcacttatggtggtgttgccgggccccagggtacttgttccctattctttctctgcctcaccctccattccttctgatgtgtttacagtacatggactggacctgcctggagcccagcccagagcatctcctcagtgctcatctctatccagtccctgatgactgagaacccctatcacaatgagcccggctttgaacaggtaaggccagatgggcctggctctggggtgtagactattgtttttgtttgtttggttggttggtttttttgtttttttttttttttgagacagagtcttcctctgtcacctaggctgtagtgcagtggtgcaatctcagcttactgcaacctccgcctcccgggttcaagccattctgtctcagcctcccaagtagctgggactacaggcgtgtaccaccatgcctggctaatttttatatttttagtagagatggggtttcaccatattggccaggctggtctccagctcctgacctggtgatccgcctgcctcggcctcccagagtgctgggattacaggcgtgagccaccgcgcccagccagaatagtgttttaagagatctgcttgggaggttttttttgttttgttttgttttgttttgttttggacctagcacagccccatgtactacatttgttggtatagggaaaaaaagggaattgacacgtgttttttagtaatgaaattttttgccgaccactgtggctcacacctgtaatcccagcactttgggaggctgaggcaggcaggtggatcacctgaggtcaggagtttgagaccagcctggccaacctggtaaaaccccatctctactaaaaattaactggtcagaagtttgagaccagcctggccaacatggtgaaaacctgtctctactaaaaataaaagaaattagctgggtgtgatcacttgaaccctggaggcagaggttgcagtgagctgagatcacgccattacactccagcctgggtaaggagcgaaactcggtccccccacccccaaaaaaataataatggccaggcgcggtggctcacacctgtaatcccagcactttgggaggccgaggcgggcagatcacaaggtcagaagtttgagatcatcctggctaacacagtgaaacccagtctgtactaaaaatacaaaaaattagctgggtgtggtggcaggcgcctgtagtcccagctactcggaggctgagacaggagaatggcgtgaacccaggtggtggagcttacagtgagccaagattgggccattgcattccagcctgagcgacagagcgagacaccgtcttaaaaaaataataataataatgaatttttttatttgtgagagttacaataagtatgtgacttggattcctttatagcatggaagtcaatggactcctttggaaattaattctgacctgctttgggggttgtggcatccagtgggttctatgtgcctatattctcagcatcccctaaagttgctctgtagggactactacccagccagctgttcttctggggttatgaaggactgttacctgcagagtcaaaggagctagtcattaggagtcccgggcaagactttttgagttaacagtgccaacgagaaggtggagaaaactcacatttttccaagagcatgctctgtgctggacactaccaagtttttatatataatttcttgtttaaccttcatactatgtgaggttaaatatggttattcccattttcaagtgaaataatgttgcctcagagaggttaattaactttcacaaagacacacagatcaggataggaccccagacttacattggagcccaacttctcccactcttccgatgtgccttcctgaattactcatgagcacgggaaaaagttccagtgatagtcccaaaagaaaatgattccggataggtgattagaacagcttaattaatttatttattttttgagacagagtttcactattgttacccaggctggagtgtaatggcacaatctcggctcacagcaacttctgcctcccaggttcaagtgattcctctgcctcagcctcccgagtagctgggattacgggcacgcaccaccacacctggctaattttttgtatttttagtagagaaggggtttcaccatcttggccaggctggtttcgaatttcggacctcaggtgatccactcgccttggcctctgaaagtgctgggattacaggcgtgagcaaccatgcctggccaacttaatttatttttaaactattacatatgacaccaactttgattcttcctctatagacctgaacaaaggataataaaatgcctttcaaaaatgaaaaataaaaattttttttgagacagagtctcactccatcactcaggctggagtgcagtggtgtgatctcggctcactgcagcctccacctcccagggtcaagcaattctcctgcctcagcctcctgagtagctgggactacaggcgcacaccaccacgcctggctaatttttgtatttttagtagaggtggcgtttcaccatgttggccagctggtcttgaactcctgaccttaggtgatcagcctgcctcggcctcacaaagtggtaggatcacaggtgtgagccacagagtctggcctcaaaagttaacaaaaattatttcctaacccatcctttctccaaacattcatttcaggaggagagtctaattgaaatagacctcattagcaggagctgatttttaggtcttgtctttttttttttttttttggaggcagactctcactctgtcacccaggctggagtgcagtggtgtgatctcagctcactgcaacctctgcctcccaggttcaagcgattctagtacctcagcctcccaagtagctgggattacaggcacacaccatgacgcctggctaatttttgtatttgtagtagagatggggtttcgccctgttggccaggcttgtcttgaacatatggcctcaagcagtctgcccacgtccgcctcccaaagtgctgggattacaggtgtgagccaccatgcccagccttgtgttttttattttttacttccagaatgacttgcagttgtttttattttatttatttatttattttttatttatttacaggcacacaccaccacacccagctgatttttgtatttttagtagagacggggtttcactgttttggccaggctggtctccacctcctgaccttatgatccacctgcctcggcctcccaaagtgctgggattacaggtgtgagctaccgcgcctggcccatcagctatttttatcagaggccagggctctaattgactggggttggtggtaagaggagaagagcacaggaaaaattaaaggagtagaggccatactccccttctattcacaccatagtgagaccctgtttatattggctttctagaccaaagttgaagtttatctttcgaagcttctgatagatttatttctaattgtactatttctttgagacaaagtcttgctttgtcacccaggctggagtacagtggcacagtcatagctcactgaagcctcgaactcctgggctttagccatcctctcacctcagccttctgagtagctgggacgacaggtgcacaccaccaatgcccagctaatttttgtattttttatagagacgggatctcaccatgttgccaatgctgatcctgaactcctgaactcaagcgatccgcctgcatcggcttcccaaagtgtcgggagtacaggcatgagccatcgggcccagccctacttctgatttataataattggttcaatgatggtgggaccctagagacatataacaggtaaaggggttaaccaggaagcatcctttacttgttgatgcctgaaggttttctacactgagactcttcacttcatttatacctttttgtcccaccatcattctttctgtcttttttttttctccccctaaagagacaagtgtttcccagcctgggcaacgtagtgagaccttgtctctaccgaaaaacttttttaaaaaaatagctgggcattgtgacatgtgccttgagtcccagctacttgggaagctgaggagaggagcatcgcttgagcccaggaattcgaggcagcagtaacctctgatcatgccaccactctccagcctggatgacaaagcaagagcctgcctcttaaaaattttttaaataaaagacaagccgggtgcggtggctcatgcctgtaatcccagcgctttggaaggctgaggcaggtggattacctgaggtcaggcgttcaggaccagcctggccaacgtggtgaaacactgtctctactaaaaaatacaaaaactagctgggcgtggtgacaggcgcctgtaatcccagctacttggaaggcttgagacaggagaatcgcttgaacccaggaggcggaggttgcagtgagctgagatcgtgccattgcactccagcctgggtgacgagcaaaactcaaaaaaacaaataaataataaaaaataaaaactcggggcccaccatggtgacgaatgtctttagtcccagctactcaggaggctgaggtgggaggatcgctagagcccaggagtttgaggattgctggagcccaggaagtcaaggctgcagttagctgtgatggtgccgctgcactccagcctgggcaacagcaaagaccctgtctccaaaaagaaaaactgaaaaaacaggaacttactttgttgtctaggctgaacccaaactcttgggctcaagtgatcctcacaccttggcttcctgagtagctgggactattagtttatgccaccaggcttagcaaccctaccatcattcttatgtttggttatttcccacataatctttacttgatagacctttcacttcacattcaggaaaatatgatggatctagtttgctggtgataggccaaatgacctgtaacctgttggtatatttggagggtggtggaggtgaatggtgtcaaaaataaaggtgtggttgctcttcatggatctgccatacagtgggaaaggtatctttttagtttgtgtgactggctgacataccccatactaatcttgaagtcccttcccattggttttctttttgcttaatttttggaatactctggcatctgttacattataggagagacatccaggagacagcaaaaactataatgaatgtatccggcacgagaccatcagagttgcagtctgtgacatgatggaaggaaagtgtccctgtcctgaacccctacggtatgtgtcaagcgggcttgcttggtattcctttcgggcatttgggtagttggcatctttggggcagagtacagtgttgggtaccagagggagatagagaagaaggaaagatgtggttcctgcttttaaagaacaagtggctgagggttacccaagaggaagttcagagagctactctgttgttggagaatgccatgcctttgggagaggcagtccacacgctcagggagcttccagtttgatgaaggcttggacgtacttttttccagccaaatgtgtagagtacttcataataagactcatttcttagtgctgaagttatttttaagtgccaaaactggatgagcaacgtcagggttaaataaataaacttctaggagaattttgagtaaggtttgggattggggatggctgatgaaaagcaatggaggtggagcaagtcatgagttgaagttgggattcaaatggtgagtattggcttggtggtggctcacgcctgtaatcctagtactttgggaggctgaggcgggaggatcacttgagcccaagagttcgagaccagcctgggcaacacagggagaccccatctctacagaaattttaaaattagccaggtgtgatggcacgctcctgcagtcacagccagtcaggaggctgaggtgggaggattgcttgagcctaagaggttgaggctgcagtgagctgtgatgacaccactgcactccagcctgggtaacacagcaagaccctgcctcaaaaagaaaactaatggtgaatattacagtcacactcataattcctgatgtgtaggggaagtcaaccacgggcagttaggtgttcctttttccaaaaggaactgtaatcccagcactttgggaggccaaggaaggcagatcaccaggtcaggagttcaagaccagcctgaccaacatggtgaaaccacatctttactaaaaatacaaaaattacccgggtgtggtggcacgcacctgtaatcccagctactcaggaggctgaagcatgagaatcacttgaacctgggaggcggaggttgcagtgagccgagattgcgccactgtattccagcctgggcaaaagagcgagactcagtctcaaaaaaataaaaaataaataaaatgaaaagatctttgtagaaaacagatctggacttgggaatggtaggtatttaatttggcattaaggttaggtaaagaggccaggtgtggtggcttgcgcctgtagtcctagcactttgggaggccgacgcaggcagatcagttgaggtcaggagttcctgaccagcctgggcaacatggtgaaaccccgtctctactaaaaacaaaaattagccaggcgtggtggcatatgcctgtaatcccagcttctcaggaggctgaggcaggagaattgcatgaatccgggaggcagaggtcacagtgagctgaggttgcaccactgcactccaacatgggctacagagcaagactccatctgaaaaaaaaaaaaggttaggtaaggaaggggtgacctgtacccctgggtttctcacttacacttttctgcttgttttccagaggggtgatggagaagtcctttctggagtattacgacttctacgaggtggcctgcaaagatcgcctgcaccttcaaggccaaactatgcaggtaatacaacccctgctgctaattgcagaagccctacagctggccatgtaaaagccccccacaagcgtggcatcgacagctgtcatagaatgacacagctaagcctgggttcagtggctcatgcctgtaatcccagcactttgggaggccaaggcgggcggatcacgaggtcgggaaattgagaccatcctggctaacacggtgaaaccccgtctctactaaaaatacaaaaaattagccgggcatcgtggcgtgtacctgtagtcccatctactcaggaggctgaggcaggagaatcacttgaacccaggaggcagaagttgcagtgagctgaaattgtgccactgcacttcagcctggacaacagaccgagactctgtctcaaaaaaaaaaaaaaaaaaaaaaaaaaatagccaggcgcggtggctcacgcctgtaatcccagcactttgggaggctgaggtgggcagatcacctgaggtcgggagtgtgagaccagcctggccaacatgatgaaaccccgcctctactaaaaacacaaaaaattggctcagcgtggtagcatgtgcctataatcccggctacttgggaggctgaggcaggagaatcgcttgaacctgggaggccgaggttgcagtgagctgagtgcactccagtctgggcaacaagagcgaaactcggtctcaaaaaaaaaagctaaaagcaacctatatcatttgagggactgagagccagagaggagactgattttcatgaagtcatagggaactctttactttccttggtcagtagcctcttttttttttttttttaaaggcaggttctcactctgttactcaggctggagtgcagtagctgggtcacagctcactgcaactccaaactcccaagctcaagcagtcctcccacctcagcctcccaagctgggacttacaggtgtgcaccaccacagctagtttttgttttgttttgttttttgagacagagtcttgctctgttgctcaggctagagcaatctcagctcattgcaacttcagcctcccaagtagttgggattacaggcatacgccatcatgcccagctaattttttgtgtttttagtagagacggggtttcaccatgttggccaggctagtcttgaactcctcacctcaagtgatctacctccctcggcctcccaaagtgctgggattacaggccctgttttgttttgtttggttgtagagatagggtcccactctattgcccaggcaactcctgggttcaggtgatcctcctcccttagcctccaaactgggaggctgagattattacaggtgtgagccactgcacccagcccatagtgttttgaagctaagatgcgttcagccctcccagaatcttagggattatatgaatcctctatttaaattctgttcccagccctgagggttgatcacagaaacagtagcttagagaaacaacatacctgtagtgtcacatgttgaaagattcctattcaaagatgataaccattgttcattctttgcctctactgggaaaagtgtgcttttgcttcccataagaactcaaaatttaggcttgttttaaggaaggaggctatcattgaccaaattgtagatagacagccaggtgcggtggcttatgcctataatcccagcactttgggaggcagaggtggacagatctcttgaggccaggagtccaagaccagcctggccaacatggtgaaaccccatctctactaaaaatacaaaaattagccaggcatgatggctcatgcctgtaatctcagctacttgggaagctgagggatgagaaatgcttgaacctgggaggcagaggttgcagtaaactgagattgcactactgcactccagcctgggcaacagaacaagattctgtctcaaaaaaaaaaaaaaaaaaaagacaaaaattatagatagactaatgtaaaccacctggttggtaagagaatgagaattctcctgtcctggagaatcagttcttgggtgtttggatcatcttactggtggtcttgcttagaaatgggatactcgtggggcctggcgcaatggctcatgcctgtgatcccagtactttggtaggccgaggcagacagatcacttgagatcaggagtttgagaccagcctggccaacacagtgaaatcctgcctctactaaaaatacaaaaattagccagatgtagtggtgcgtgcctgtggtcccagctacttaggagactgaggcacaagaattttgcttgaacctgggaggtgaaggttgcagtgacccgagatcacgttgcactctagccttggcgatggagccagactccacctcaaaaaaaaaaaaaaaaagaaagaaaaagaaatgggagacttggataattgactaagatttcttaaggctctctccagctctcgtactatgtctgttcacccaccccaacaccaacagcgtaggaggagatgacttatgccctccagtgctacttataaatggtagttttcccttccttctttcaaggactttccacccacctgtctcatttaagcacaaagggcagggctggctcaggactaagttgtctcctaaaccctttttgagagtatatcaatgacatatgtcctagtttgttccccatcaggaattctaattgctggtatccaacagcattagcaatatcagtgtgtaaaggaaaaacaactggtgatgagggatgggagggagtacagcatctgggcaggaggagcattagaggagctggagccacggatgaaagaaacaagatttgcagaattgacagctccatagtagtaaatgtggagctcagtcttgagggagttaactctcatgaaggagaagtgcaggctgtagtcccagtgacagtgactagcatccactgccatcccactcaggatgagggtaatgtgtgggcagaagtatggaaggagtttttgtgagagaagcaaacaatgtgagagggaaagttgtgtaccttttgggggctgttgcactgctttgctgcctaagtccctatatagtattttaaactcttttttataccatccactcaactagttgtttttgagactttggggacaattaaacctttctgtacaacgtttagggatctttgatctagaacaagaaggactaagatcgaggctgggtggccctggagcaatgcccagaaacctggatgggaatggagtgacgagtccctggggaggagtacaggtgcttatctgaaagtcagaactcttgaattctagacctgcttctgaccttagaaaagcagattaccatttttgagtacagagaataaagagcaacttttaccttctgtggtttttatgaggttaattaaaaacataggcatacttaacaattataattctggtcttgaatttctcattcctatctatctcacccttattgtcccttcttccggatattggtttgcttttgaggaataccaatacattttcactctagcccaagctacacctatttggggcggtaagagtgtcttttttttttttttttttgagaccaagttttactcttgttgcccaggctggagtgtaatggtgcgatctcgatctcagctgactgcaacctccgcctcccgggttcaagtgattctcctgcctcagcctcccgagtagctgggattacaggcatgcgccacgacacccggctaattttgcatttttagtagagacagggtttcaccatgttggtcaggctggtctcaaactcccaacctcaggtgatccgcccgcctcggccgcccaaagtgctgggattacaggtgtgagccaccgcgcctggcccaggtgtcatatttttaagcaaaggttattttgcctgctgtttgggactgcctgtgctgttaggccttcctgctcccatggctcagaagttgagctttcatttcacatgggcccgaagttgctttctctaggatcagccacccagacttgaatcttccatccccttgtctcctttccccacaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaggaggaagtgcctgtgggtgtgggagggcttgtgtaaaggacgaatgggatcatcttgtcaaccacacctcacctaggcctggaactgttagggagaaggaaagtgccatgaattgtctggaaaccgaagacttgcataacatggtggaagggcagggctgggtggggagagcaggacaagttttctcattggaaatggggtccatgctctggcagtcagtgacatcttagtttgagtggtttccaaagacagacctattccagagcttggagtgagcatgtcctacaaggataggcagaggaagagatgggcccaggctatatcctgctaaaggaagggtctcagtatggaaaaaccattgagttttcagatttccagtactaaactagcacttttaggatcttagcctttagaccataaggactttgggagccttaaacaactctggcctcttccctcatcaccacttctacttgctataggagattcttgctttctgatgcagaggcttttactcttggctgaccacgtgtgtagaaaaatgtctacacacagtatgtgctgccattctgtactatgcagtgatacatgaaggcatgggctcgggttaataggcctaggcaccagctttagctcggctgaagctggcgcccctggcaaattactttgattgaatcacctgtgatgttgaaggctgcctacttggtgaaatttaagtgagctgtatgtaaaatggcacagggtaggtgttcagtaaatgactccctttcccactactgaggctagagggacctggcaatcactacaggagggtgagaaagctagtagggaatttaagaaaatagaacattccctaactattgtttgattcccctcagattccattgttttctttcctccaatttagccacgattggacattgacttctatttccttcatactcacagctaactctgtcataacctagagcctctacagaggaagccagaagagactgaaagtgaatattatttactggtccattaggaccagctagtttgagataaggaacattttatttaaaaggtttgaattagcataggctgtaatctatgtctcacagctacaaagactagacaggccaggaaacaacccacattctaggcccagctcttccatgaacttgcagatgacctacaaaaatcattttatatgtgcttgccgttctctgtgttaatcagattatgcttactgaacgagcgaggttttcctccaataaaaatgcaacgtgaaggcacttttcaaaaataaaagaatgagggaagaaagaaaaacttggaactttttttctattttttgtataaacaaaattgcccaggtttatttgccacctccgcctcctccctgcctgctgctgtgtgcccttccacatgcagtcaggggagggcttctctggcctcctcagctgtaatctcctgggagtagaggtcagtgaagagagctggcagccagtagtgggcctcccctggggcctgtaagtccagccacgccaacccttccttcagcaggtgttcctggagggaaaagggaagaagagcagtttgagaacagggaggttccatagacaaagggtaggtaagcaacccccacacctattttggcttcagtgaggttttcaaactaaatctactaagtgccttcaaacctttacacaaccaactaaacgagctgtttggccttggcctttgcctgaatttgaaaaatgctacgaagtcatttaacttgtgctgctggggaagaggggtaaagcctagcatagtggaatatagtggaaagaacatagctacagaaatatttgctgtgtggccttcagcaaatcactgcctccattttcccagaaactgttaaacagagatcactgtttagctacctttgaattaagttattccgggtagcaaacatgattgaccatacttatgcaagaatagactcagttcctagagctggaaataatatgctcaaaatgggtggtttctgtccaatatcattaggtaaataattatgttatccccattttacagatgaaaggtttagacagttgaattgtttggataaggaaaaaaggtactgaagccggagttcttacattgctccctcttcacatcattcattcttcagtacgatgaaatttgtatatataaagctagagtatatactatgcaatataatgcttagtggataattagatatgtaattaacgtagttaataattcactgtactaacagtgttacttccagtacaaactacattaatctcctgaccagcaactccaggctcagcatgttcaggagagagagtgtcagttccccaagtagcaggggcagcctggtattgtgtgcatgccagagttaggaacctgccttcctagttctacctttttggtgccatcttcagagaagtgctgggcttccttctagcatggcagcagtagccttcaaggcagaaggccagcaaagcaatgctgaagttcctgcatttgtggaacccacatcctcccaactggggcctgcctgtcttttctggactgttccaaagttgcataccagcacttgccgcgctcgctcggtctcccatttaagactggctttgatctcactgacagtcacgtagccattcttctgaaggaaggaggaatggggattgaatcagttaagagtgcaccttcccttagaacccaggatctgcccaggaacaagagacttacccagacaggaggaaaagctgtcaagcatgagagaacacagaaaatgtttaaaggttccagcggggagagagagaagtgactttcagcatgacagaggtaggttggtgggttcaatcctaaaactggggtaccggccaggcacggcagctcatgcctgtaatcctagcactttttgggaggccgaggtgggtggatcacctgacgtcaggagttcgagaccagcctggccaacatggtgaaaccccatctctactaaaaatacaaaaattagccaggcatggtggcacacgcctgtaatcccagctactcgggaggctgaggcagaagaatcactggaacctgggagatggaggctgcagtgagccggagattgcaccactgcacaccagcctgggtgacagagcgagactccatctcaaaaaacaaaaaagtggggtcccttgtactaacatactgagttagacttctgcaaagcactctagagcatgacaagggaagattctggacaattaattgatgggaagaaatgatgataatcataaactgctaataacctccattatttaaatattcagcccttgccctgcctcattctactcatcctccaatacagaaaagcccctcccttatttagttctgttttacgtcataaaggaaactgggccgggtgcggtggctcacccctgtaatcccagcacttagagaggctaaggtgggtggatcacctgaggtcgggagttcgagaccaaactcaggcctggccaacatggagaaaccccatctctactaaaaatacaaaattagctgggcgtggtggcacacacctgtaatcccagctactcgggaggctgaggcaggagaatcacttgaacccgggaggctgacattgtagtgagctgagatcacgccattgcactctggcctaggcaacgagtgaaactccatctcaaaaataataaaactgaacacatctaaatacctgatggggatttgggggaagatggcatatgcttaaggcatgatgagggatgggggcatggcaaacaagattttttaaaatctgtttttgaagaatccataaagtagtttcaaaagacatcaaagagtctggctacccaaagaaatctagttagttgtctgcatgtctgtctacctgactagactgtaagctccttgagagcaggaattttatcatctttatatgccccacagcctggcccagtgctttgcactgtagctgctcaataaatgtctgctgaacaagcacaggcctgagtagttcatccactggatagtctcagcaaaagacctgcataatggggagcacgagctgagaactgctccagacttgcctcacagactgtcccttgcacacacacacactcgaaggtgcaccagtacctctgccagctgcagcaccacggtgtgatccatattgagctcagctggaacagactgaatgaggtaagtgccgcccacagggatgatgccgaagccagtgccaagtgcctttagtttcttgatggctctgatcaggtcatctctgaggtaaggaagagttgcttaacgacccttggcagaatcagacctaacaacacagtttcagctctgccctgggcaggatactgacagaaaatttagaagactgcacaactgccaggcgcaatggctcatacccataatcgcaacacttttgggatgcccacattgagaagactgcttgagcccaggggttagagaccagcctgggcaacacagcaagaccttatctttactaaaaataaaaaattagcagggcatggtggcaatcgcctataatccttgggaggctgaggcaggaggatcacttgagcccaggagttcaaggctgcagtgagctgtgattgtgcaccactgtactccagcctgggtgacagagcgagaccctgcctctaaaataaaaggctgcacaacactcaactacgtcagtaaaaagacagggtcaaggagcaataagtgatgcttggacaatcatgggagatacacaggagtcaggctgtctgctcagcgaaccactcattccaacatccagacagcggtcaaagatacacctgcagatgcccatcaggaaatgtgaatgagtgagctgaagaggcaatgggggtagtgtcacctgtggcaaactagagaatgcttatctattttaaagggggcaacccagctgactattattgccaagtggcaattcaaacccaatactgccaagttttctgattctaattgaaatcagagaaaaagaaaacctacaaaacagtgtgtagatcacatatccagcccacatacagagtttaaaacctctgccaaagctcaaaaaatgttatcacccaaacagccagggaaagggcacttttaggtagattggaatgcattctccaacccccaaagaatagcaaactgaaatgcttcaaatgctcaccctctcttcatgaaatctgcaatgagtatggctagtaatcttttgttatcactttccttttttttttttttaggagatgaggtcttggctgggcgcggtggctcacgcctgtaatcccagcattttgggaggccgagagttcgagaccagcctagccaacatggtgaaaccccatctccactaaaaatacaagaactagcagggcgccagtggcaggtacctgtaatcccagctactcaggaggctgaggcagaagaatcatttgaacccaggaggcggaggttgcagtgagccgagattgtaccactgcgctccagcctagacaacagagcaagagtccatttcaaaaaacaaaaaaaaaaagtagagatgacgtcttgctctatatcccaggctggagtgcagtggtgcaatcatagctcactgcagcctagaacaatgagtgcatgcctcaacacccaactaattttattttttgtagagacaaggtctcactacactgcccagactggtctcgaactcctgtcctcaagcgatcctcccacctcagcctcccaaagggctaggattacaggtgtaagctattgcacccagcctcgttacttttctttgaatattctaggtcttcaagatctcatagtaggctgactctttggaagttacatcaaaaacagccttttatcttttctcaaactggactcgcacatagaggctggagaactagatcaatttatattccatcatctcactaccacctccttccccagcctttctaggcacctacactactctccttggcctcaaataatctcacgactatatacagccctggccagccgtggtgtctcacacctgtaatcccagcactttgggaagctgaggcaggcagatcacttgaggccaggagttcaaaaccagcctggccaacaacgtgaaaccccatcactactaaaaatacaaaaattagccaggcggccaggcgcggtggcagacacctgtaatcccagcactttgggaggctgaggcgggtggatcacgaggtcaggagatcgagaccatcctggctaacacagtgaaaccccgtctctactaaaaatacaaaaaattagccgggcgtggtggcgggcgcctgtagtcccagctactcgggaggctgaggcaggagaatggcgtgaacccaggaggcagagcttgcagtgagcagagatcacgccactgcactccagcctgggcgacagagtgagactctgtctcaaaaaaaaaaaaaaaaaaattagccgggcatggtggtgcacacctgtaattccagttactggggagactgtggcacgagaattgcttgaacccagaaggcagaggttgcagtgagctaagatcgggtcactgcactccagcctgggtgacagcaagactctttctcaaagaaaaaaaagactatatatagccccaagtttgttaaaaaataatacatgaaaaaatgcttagaaggaactacattaaaatatatagcagttgtaatctcttaattgagaaataatggtttttgtttccttttttaaatctatattttctgttttctaaaaatagccagccatactggcccatgcctataatcccaactacttgggaggctgaggtgggaggattacttgagcccaagagtttgaggctgcagtaagcaatgatcttggtagcagtaagctgtgatcatgccactgtactccagcccgggcaaaagtgagaccctatctcttattttttgtttgttttttgtttttttttttcctgtatgatatggagatcatacagatttctaagctagcctagacatgaggaatagggagaaaagagttccatctgaattttaaagacctctttctgtactccaagggattggaagacaagacctactgactgacatcctgggcgaacttgccccttcccttcaacacctgttgatgtagttcctccaaagttatcagacctgtttggagacagggaacagaaatcagaaaaagagattccccactttaaataagttgacagtcattacaattccagtggcctacaagtagcaaataacattctagttcctaatttttttttaacactctccttatgaaataactgaccataatatgagaaatggattctgagaccttgctaggcctgtcaacagagagctacgaaaatctaaaaacaaaagcagtatcatctttgaaaaactataaatgtcctcttgacatcaaggccgtgtctatttatagttgatgatgatttgtaaatggttttaagttttctttctgtaacttcaatccacaccatttaacgtgcttactaagaaagatggcatcaccagatgacaaattttaaggtcacattttagggaacacagactcagttggcattcccatacgtcggagagacagtgcaggactatagttactaatgagaaaatcactccagacacatcagacatcaggggaaaaggcctacttcctacctctctactattttctgtactgactagggactagaccttcctggccaaagatctttggagaacagagacaatcgttcaggtaattctatttacccttggccatggagacttgccatggattcaactgcatgaaacagctaagatgtctctcaagtccttagaggcctgtagactgcaggatggaaacgataatcttttacggttttctccctctcagagaagtccagagtccagttcacaggacctagccaccctcacctccattccgatgcttcagcgccaggcacacttcgataatttggacacctagttcgtaatagaagtcccccacgcccagcatctcagaccaaaatccttttccagctacaagacagaaaaacaaaatctcggttattgattaatttacatcccttcttttctttcaaacctgcattaaaacatctatcatatgggaagtcttccctgcatggcatgaagttcttctgctccatctgctactcaggaaacaatcggactcacggtaactcctgctgaagaacagggtcagacggctccagagggcaggcaatctaaaagtcatttctggccgggcgcagtggctcacgcctgtaattccaacactttgggacatcgagctaggtggatcgctcgagaccaagagttcaagaccagcctggccaacatggcaaaaccccatctctaataataataataataaattagccaggagtggtggcgtgcgcctgtaatcccagctacttgggaggctgaggcaggagaattgctggaacccaggaggcagaagttgcagtgagccaagatcgcgccaccatactccagcctgggcaataagagcacaactctctctcaaaaaaaaaaaatacagccggggacagtgggtcacgcctgtaattccagcactttgggaagccaaagctggtggatcacaaggtcaagagatagagaccatcctgg

SEQ ID NO: 8116 - DNA, 88 bp, Homo sapiens
gagaatcgcttgaacccgggaggcagaggttgcagtgagccgggattacgccactgcactccagcctggcaacagagtgagactccgt

SEQ ID NO: 8117 - DNA, 1380 bp, Homo sapiens
gaggtcaagtgagggcagcagcaggtgaggtgagggatggaggtgaggccagatcacctggtggtttaaaagccgcagtgaggtgtttagacctaattttaaaaacaatgaaaagcacttgatttagtttagccatccatatgtggcttgtattagctcaattagactcctgccttttcgcaaggacagcagtctctctgtatcccatacacaagagaatgatgtgttttctctttttaaatgagatctgtttagctagttgtatggagaatgaactctgctggtcaattgtggaaacagagacttagttaagtagaccttcctgagcttaccccttgcagccttccctgagatggcaaacaggagggctgcaccaatcctataccgtcagcaaaggtctggatcgctttgcaaggattagaaagcctgcacatgtggggcctcagaccatctgtccccatgtctacagaaaagttccaactgctgaatggttttgaaatgcatggttatttcctgggcccaatccagtccttcataatttggccaaacctttatgcagagggctatgaggcatttttcctccagattctgagggtcaaagcagtcccaatggttcaagatacactgcagagtagtataagctgggggcagtaaggagaactggttgtccattttgaaagacagggagtagaggcatccctcattcagggtgtgatggggaaagcaagcaagtgtccttccttcactttccacctgttgtccctgagccttggtgaccttggcaggtactggccataggtaacaatacccacgaagcagggaaaacctggagaataggaattaaccacccttagctgtgcctccctttctccctgctgccagcaacctttgagttccctgggcctgtttataccgtgaagcatggcctccttccgtggggtggggttcagtcagcaggaattggtcctgcgcatttacattttgcctgttgcttggctttgagcccctcagacctggtctgtctttctagggcctcagcctaaagcttggaattgagtttggaactgaaaaggtattttagaggctgtttgtatctgtttagagtgtctcaaatgtgccctgccgaatttgcggttatcagccagaaggggtttttcctccgttaacttccctgtcagaaacagctggtggggggtgggggaggcctctcacttagaaaaagaaaaaagaaaaacagtttaaggggcaaaagggggaggttctgggggaagaaccccttgttagtgcaactgggcatttccaatccttatatctttcccctgggtcagactgaattgaattccttggccaggggaggaaagggttccattggtacagcgg

SEQ ID NO: 8118 - DNA, 1112 bp, Homo sapiens
aagttctggataaatacttgatttgatgtgatagtgtgtattactctatcagaaatgcagagcgttgtatgatttttctgtgtacacgcgataagagcaatattagttgcaaaaggaagttttcatctttgaacattaaaggtatcctttattcttgatcactatagcatgcaaaaaagaaactatattttctgtcctgttctttgtattactgttaaagagttggtaaactgccgtcttgctgtgagactgggaagtcggcaatgaagttagatttgtattcatgaacatgatctgcctgtcatataggcttgctttgacttgttttttttttcagtagtggcaaagggttttctgccactcaatccacactttcctccgcattggtatctccgttgaccattttgcaaaatagtttattgagattaggggtctgatcttttgtataacctgttgtagtgaactgatcatatgcgacttgactttggccaatagtacctcgtgcagtgtacagtactactatttagacttactgatttgggtaatagaaaagctatgatgttagaaatgttgtcgttgtatattggagaaattttgaagttgcatattggagtaatttagtcctgtatgctttgtaaatgagtgcattctattgtcgagagtaaatacagtattttgtagtataaacttaagcttttagctgaagaaattggcagcatagttggagtgtggagactattcttaaaacgcaaatgttttaaattacaaggaactgtagtggtgtgtaggctgtaacaattcctggtgccaaatttgggagattatttggttgagctactttctataaagaaacatattaagtatctgcaataaaagtggatttgtagctatacacaagggattttacattataaataataactcaataaggcacctttctttgctctttgtgtatctgccagttaagaccaaaacatctcatattttcactggagcttcctgccaaaacaaatactggttttgcattggctttgctgctcagtttgaaagctaggggaatctcttagagcctactctggttctggaggctgcctgattaaaaaaaaaaaaaa

SEQ ID NO: 8119 - DNA, 168 bp, Homo sapiens
ggcgtggtggggggcgcctgtagtcccagctactgggaaggctgaggcaggagaatggcgtgaacccgggaggcggagcttgtagtgagccgagatcgtgccactgcactccagcctgggagacagagcgagactccgtctcaaaaaaaaaaaaaaaaaaaaaagatg

SEQ ID NO: 8120 - DNA, 184 bp, Homo sapiens; identical to SEQ ID NO: 7572

SEQ ID NO: 8121 - DNA, 147 bp, Homo sapiens; identical to SEQ ID NO: 6794

SEQ ID NO: 8122 - DNA, 143 bp, Homo sapiens; identical to SEQ ID NO: 7597

SEQ ID NO: 8123 - DNA, 170 bp, Homo sapiens; identical to SEQ ID NO: 7598

SEQ ID NO: 8124 - DNA, 141 bp, Homo sapiens; identical to SEQ ID NO: 7393

SEQ ID NO: 8125 - DNA, 125 bp, Homo sapiens; identical to SEQ ID NO: 7605

SEQ ID NO: 8126 - DNA, 175 bp, Homo sapiens; identical to SEQ ID NO: 7613

SEQ ID NO: 8127 - DNA, 162 bp, Homo sapiens; identical to SEQ ID NO: 6214

SEQ ID NO: 8128 - DNA, 100 bp, Homo sapiens; identical to SEQ ID NO: 6215

SEQ ID NO: 8129 - DNA, 140 bp, Homo sapiens; identical to SEQ ID NO: 6216

SEQ ID NO: 8130 - DNA, 153 bp, Homo sapiens; identical to SEQ ID NO: 6795

SEQ ID NO: 8131 - DNA, 193 bp, Homo sapiens; identical to SEQ ID NO: 7690

SEQ ID NO: 8132 - DNA, 136 bp, Homo sapiens; identical to SEQ ID NO: 6219

SEQ ID NO: 8133 - DNA, 150 bp, Homo sapiens; identical to SEQ ID NO: 7399

SEQ ID NO: 8134 - DNA, 142 bp, Homo sapiens; identical to SEQ ID NO: 7400

SEQ ID NO: 8135 - DNA, 123 bp, Homo sapiens; identical to SEQ ID NO: 6220

SEQ ID NO: 8136 - DNA, 177 bp, Homo sapiens; identical to SEQ ID NO: 7751

SEQ ID NO: 8137 - DNA, 166 bp, Homo sapiens; identical to SEQ ID NO: 7759

SEQ ID NO: 8138 - DNA, 142 bp, Homo sapiens; identical to SEQ ID NO: 7402

SEQ ID NO: 8139 - DNA, 268 bp, Homo sapiens; identical to SEQ ID NO: 7767

SEQ ID NO: 8140 - DNA, 368 bp, Homo sapiens; identical to SEQ ID NO: 6222

SEQ ID NO: 8141 - DNA, 2925 bp, Homo sapiens; identical to SEQ ID NO: 6223

SEQ ID NO: 8142 - DNA, 4704 bp, Homo sapiens; identical to SEQ ID NO: 7404

SEQ ID NO: 8143 - DNA, 1831 bp, Homo sapiens
tccaagaccagcctggtcaacctagcgagaccctatatctatgtgtatttaaaaattaagaattttgtaaaataataaaaataatagaatccaggctgcccatctttgtagtttagagatggtaggttcttctaaggggtagtaattggcctttgaaagttcacattcataacttctttcttaagttgggtggagagagggaagccaatggcgttttttttttttttggtttttttgttttttttaaacatcaaagtgcactgtcagagtgccgagtcctgattggtggaatgatgatggtatgatttgattctcccaaatcatctttgaaaaactgtgaaacatacaataagcttattccttgcctaattaccggttgctgggtcccagggggttgctggaacacggagactaatcagatgattcttgtctttaaggagcatgtggaagaggggacagatgaataccccatcttcctgctctccatcagtccgccctggtgtgatgtgccttagcagttccgagtaatcttcctggaaaaaataaataggcaactgcgatgagtttgtgcaaggatcctaatggtaatgaataataataacacaccactgacagcgaacgctgagtgttcactgcgtgctaggcaccatgcagagggtttcccctcacatgtactttaggggtagaaagagggacaaagaggaaagtctattaggtgcagatctgtgaactctgaataggccatccaccatctgagactcagaaacctgcagggacctggccgatgggcaggctgcatgctggctgcaccatgagtcagcaccagactgggagacgcagccactcagggatccaagggactcaaacatctgcaacctggccccaggccaagagaacaaactgcaggctccggatttgcggccctgtaggataggctcaaaatgaaacatgtttgttatttctaagtggatgggaactgaaagaacccgaacaatcagtgtacaaggattcatgaatggaccaaacatgcttgctttttgttcttgaaagatgtttgttgtatttaatatataacgagaagagtggtcaacgctgactgggtgctgagcactttaagtgcattacctgggtggctggctgggctgtgccagggttgaagggtgtggggagcttctttcaaggtgccccttctgcctcctggcacaggactctggctccagcacaccccaagctgaccctggtgggggtagggcccctcacccaaacctggcctctcccgtctcttgttctgctgcctcagctttctcctgtctgtggtagagtctgcttggacagactctgggcagggcagggggcagggcaagctggagagagaattcgttctaggttgatgtgggatgatagtggctggtagggcgcttgtatcctattggaaatccatgatgagatcccattcattcccacccttctcttaacaatgtctccttaagtccaagtctcaagtcgggtgcccagtttcataccatccttcctctccctctcacaaccttcgggcaggaccaaccccctcagaggaacccctgctgccccagccctttcaggctctgtgcccaggatctcccctccactccctggaaattccacatttggccaggtgtggtggtgcacacccttgttcccagctactcaaaaggttgaggtggaggtagaggctgcagtgagctgtgatctcactactgcactccagcctgtgcaagagagtgagaccccgtctctaaataataataataataataataataataataataataaatttaaagaaaaagaa

SEQ ID NO: 8144 - DNA, 1466 bp, Homo sapiens
gtttcctcaggtgtaaaatcaggatacacccgttcagcaaggatgctgtgagagcatccacctacaacagtgatgctcgcaggcccggggctggcaccgtcgctctgtgggcctcggcctctgggtccccacaaggcagggctgggacacccgcccgacctcctcccgaaccagaaccccggctgcccccagctccgcgggtctgcccccgacacatccctcccgaaggccacttggcttggacacaaatcgaaaccgaaaagctcatgtgacactggaggcagggatgcggcctcgcccgctctcagcccagggagacgctgtctccacccaactcggccatcttgagaggcccgagcagacaaagcgaccccattgttttgggtgacggcagacggggacccctttcccctccccgcgaccaggagcggggcgccctgggggctccgggccgggcagtgggtgtggcgagggcgagccccgggcgccgcgccggcctctgcggggcgtctgcggccctggggacccggccggcgggacgtctgcggccgccgggctctgcccatccaggggtcatctgcagctgccgggctcctcccatcccggggacatctgcgaccccggaggacctggcaggccctgcattccgcgaggcctggctctggcgaccctgccctccgcggccccgcacctttgagcgtggagcgctccaccagcaccgtgtggacctgcgggtccgaaaggaacttgcgcatctgctccagggcgctcttctcctccagcgccgcctccagcgcggccggcgcctcgccgccgtcctccagcagcagcggcaccagcttgcgcaggtgcttctgcagcaccgacacgtccgccacattctgcacggccgacacttccaatccggccgagccgtcctcgccgccgccgcccccgggctccgacatggtgtcgcgctcgggaccttccaggagcgatgagaaggcggccgcgactcagcgagacagccagcaagagacagaaacggccgccggaagccggaccgtccgctagcccaccgcagactgaggagagcgggagccggctccgccctaaaggcagccactgccaggtggccccgccccgccccgccggccgcagccgccgcagccacccgcgctcgctcgcggccttagcgtcacggcgccgcgcgtgcgcggggggcgggcccggcgatgtcgccgcgcgcccttctgggacttgtagtctcggcgctggtcggggcccgcagcctccgcactgcgagtcctaggagatggggacttggctcaacgtcctggctcggcgcccgggcttggcgaggttggtcaggggctgcgtctgtcttcttcactgctgtggacgcagcgaatagcacacagccagagaaactttatagtgaatcagtgatgttattggcgagagctaacgtttagtgagcgcttagc

SEQ ID NO: 8145 - DNA, 6154 bp, Homo sapiens
aagctgaaattggaagaagagaagaagaataaagtgagagaggggcgggggccggggttgggggcagtggctaatccctgaggccggctgagcagtgaggcctggagggactctggtggggcagcctgagcagctggtgtctcctgtcggcagggcagagagatctcttgaccagcggctgatggctggcatggtcttgtcttctgccccagcttgaaagatttaacagtaccagatttaatctggataacctggctgacttggaaaacttggttcaaagacggaaaaagcgactgagacacagagtcccccccaggaaacctgagcccctggttaaggtgagtgggaggtcggggttagggcagtgcacacaccagggctccagttccagaggaagggcttggggcagagtgggcactgcaggccaggaccacacagccagtgcctggggagcccattaaatccactccagagcccccgcggatgtgtccgccagggctgccataacaaagtcccacagcctggacagcctcaacagcaggcatgtgtcacctcgctgtcctgggggctggaaggctaacaggaaggtgttggcgaggctggttccctctgagggtggtgagggagaatcccttcatgcctctccggcttctggtggatgctggtgatctttggcgttccttggcttgtagatgtatcacccaactattgccttcatgtttgctgggcgttctgcctgtgtgcatgcctgtgtccatgtgtctcccccaactttttttttttttttttttttttttttgagacggagtctcgctctgttgcccaggctggagagcagtggcacgatctcggattactgcaagctctgcctcccgggttcatgccattctcctgcctcagcctcccgagtagctgggaccacaggcacccgccaccacgcccggctaatttttttttgtatttttagtagagatggggtttcaccgtgttagccaggatggtctcaatctcctgtccttgtggtctgcccgcctcagcctcccaaagtgctgggattacaggcatgagccaccgcatccggcccacgtgtcccctttcataaggacatcagtcacattggattagagcccactttaacacaagtcatattggtgaggggcccaccatacgccggtgtgacctcatcttaactaattacatcctcagtgactctgtttccaaataaggtcacattctgaggtacctggggttagtacttcatacgaatcttggggagatacaagtcaatccataacacacacgctcacacacacacagtctattcaatctcctggcgtgggattagaataagaaactgcattagtacgagccagcagtgttccttggtgggctgcatgggacccgtgggccagactggtgaagctgtgacatcttgggcacctgcggccttcgggagtgatttggtcttgtcttcaactgaaccagccgcagtcccaggcccaggtggagcctgtgggcctggagatgttcctgaaggcagctgctgagaaccaggagtacctgattgacaagtacttgacagacggaggggaccccaatgcccatgacaaggtagcacaggttgggtgagtcggctggcagcagctgcagctgcaggagcgctgccttcagtgtgttcaagtcctggcctaggaggctgcagggattttcactcttatgggcatgaatccagtggcacctgcagacggaggagagggagcggcccatcgcgtggtgggggaagtggcaattccattcagggacctggccctgggaaggggaccgcgtggggtctctaggggtggctgcactccctctgcctaatcttccatctctgccctcagctccaccgcaccgccttgcactgggcctgtctgaagggtcacagccagctggtgaacaagctgctggtggcaggtgccacagtggacgcgcgagacttggtgaggatggggaaaggcccagcctctggtcgacgcccagcttcacatcccagcagctgagtgcttgggtgcttttgttttgcagctggacaggacacctgtgttctgggcctgccgcggaggacatctggtcatcctcaaacagctgcttaaccagggagcccgggtcaatgcccgggacaaggtgaggggcacggtgctttgggggcctgtcgggaacacgggagcagacgctgttcctggagaagagagcacgtagtcccatgggttagggaggcctcaccaatccagacccagcactgacccccacttgctctcagatcgggagcacccccctgcacgtggcagtgcgcacccggcaccccgactgcctggagcacctcatcgagtgtggcgcccacctgaacgcacaggataaggtaaggcaggcgcttggtcttttccggctcggacagctccagaggagcagggactgaggagccccagccaggaccagaggtgctgtctgctcggtgacagcagccctgaccttcctgcatgaggagggcagcacgcggaggcagaagcttgactgcctgcgttctcagcaggaaggggacacggctctgcacgaggccgtgcggcacggcagctacaaagccatgaagctactgctgctctatggggccgagctgggggtgcggaacgcggtgagtgtgggcgcagccctggctcctgacccgagggcgggtggagcgcctgcaagggactgacccacaccgttgctcccaggcctccgtgaccccggtgcagctggctcgagactggcagcgcggcatccgggaggccctgcaggcccacgtggcgcatccccgcacccggtgctgaccgcagcaccgccccccgccgcgcctttcgcactgccaccattccatcctgtgccccgcccccgcgtctgcacctctgtggttcctgccctcagccctggttcctccctctctggcctgtgccgcctcagcagccctggcagaactgaagagcggcaccgggcccagcaggcaaagagagaggcctccctggcttcgagtgtcaggggagccgcgttccctcccagggctggagcagaggaccacaaggcagcagaaagcgcgggtccagatgagggccaggaaggggaggagagtgagggccaagaacgagccttaagggagcagtcccaagctggagccacccagggctgggtctgggagtcctcagtgtccacttgtcccaggttagggggcttgccttgctctctccagggccagtctgtgtgtgtggggactcagcccgtggccggcagatgccatccaggatgtacaaggtgcagccaaggcaggccatgcaggggccgggcctgtctgcagctggtggatgcctgtgggcatggctttctctggggaccccattcctgtcagtagcaaccctggcagtgtccggagcggctctagacaactttggtcataggaactctggaggtgggttctggtcatctgaggtggctactcaacaggtttgaggccccacagcaacagaagtccaggacccactaggttgcctcagaagccctaagactgatgagctggagcgcgcatttgagagaagcctcgcacccactgtgtactggccccgctcaggccggcctggcacaccgttgcctgctggcggctctcatggggaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaaggtgagcccccgccgccccccagcccttcccatcccttccctgctccctggtggtctaaggacccaagctccctagacttcctcttccaccgtctgtacgtttcaaattacactggtgtaggcctgtactgctggtggggctgggcccctaaacgccagaaagtgaatcttaagaagctctgccctaaactgagaaccacatgctgagggaagggctgaaaggtgaaggctcagcctccctcacatgggtcctgggttacattaggtaccgggctgattgataggcatttggccatggttccttttcgtctacctttgggggccttctcaggcccagaacaaggctgttgttactatgtggaaaagctgaccagtgctgcacactaggggcacacacctttccatgagcagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccattacagcctagccgtctttcctgggccgagaggagcccatgcttcagtcaccagggactgtctgatagggcccacgcctgttagccatgccggccgacagcaagataggccgagtgcagagtgggcgggatgcggggtcctggcactaggcttttgtgcttaaggcacctctgctcactgacgacaaggtcaaagagcagtggttctccacctcagctgcttatcagaatcaccaggaaggtttaaaaagtcctgatgtccagaccctaagtcagaagccctgaggggaggatccaggtattctcatgcagaggccatgcttgtctatgtgggaaatcctaggaatctacagaaagcagacaactagggagtccagcaaaatctcgggtgcaagataaacacacaaaaacctgtttctacctcctagaaatgaacatgtagacacaaaagttaaaaatatgtactgtttacaattgctgaaaaagggaaatacttcggtttaaatctaacaaaatatgcaaggacttgtatgctgaaaattataaaacgtgatgaaatcaaagatttaaatagacatgccatgttcatggattgctagacagaatacagtaaagatatcaattctcctcaaattaacatacaggttaaatgcagttcctatcaaaatcctagaagatgttttgtagatgtagacaaggttattctaaaattcatatacaaatttatagcaaaaatattttgaaaaagaatagagtgagaggaggaatcagtccagctgatttcaagatctactatatagctatgtgaaccaagagtgcaatgctggcagaggcacagacacacagatcgacagagccgagatcatcacgggaacaggaccacacaaatatgcccagctgactttaaggtgcaaaagtaattcaatggaggaaggacagcctttcaacaaacggtgctggagcagctggaccagctataggattaaaaaaaaagaactttagcctaagtcttacacattatacaaaaattaacatggctcacatgcatacttaaatttaaaactataaaacttcttttaggaaaaaacagataacctttgggatctaagactaggtagagttgttcttaaatgcaacactaaaagcaacagtccataaaggaaatatcagtaaagtggactttatcaaaactgaaaacttttgctctgtataaaaccctgttaagagggtgaaaagatggccgggcacggtggctcacacctgtaattgtagtactttgggaggttgaggcaggcagatcacttgagctcatgagtttgagaccaggtgtgggcaacatggtgaaaccccatctctataaaaaattagctgggcataggctgggcatggtggctcatgcctataattccagcactttggtaggctgaggcgggcagatcatctgaggtcaggagtttgagaccagcctgaccaacatggagaaaccccatctctactgaaaatacaaaattagccaggcgtggtggcacatgcctgtaatcccagctactcgggaggctgaggcagtagaatcacttgaactgggaggcggaggttgcagtgagccgagaccacgccattgaactccagcctgggcaacaagagtgaaactacatctcaaaaaaaaaaaaaaaa

SEQ ID NO: 8146 - DNA, 452 bp, Homo sapiens
ctgggaaatgcaaatgaaaaaccaccgtgaggcatcacgacacacctgtcagaacggctgaagtaaaaacatgtggacaccactaagtgctgtggaggattcagggaaactgatcatcctaggttgccggtgaggacatgagtttgacagtttgtggccaggtgcggtggctcacgcctgtaatcccagaactttgggaggctgaggcgggcagatcacgaagtcaggagatcgagaccatcctggctaacatggtgaaaccccgtctctactaaaaatacaaaaaactagccgggcgtggtggcgggcgcctgtagtcccagctatggggaggctgaggcaggagaatggcatgaacccgggaggcagagcttgcagtgagccgagactgcgccactgcactccagcctgggcaaaagagtgagactccgtctcaaaaaaaaaaaaaaaaa

SEQ ID NO: 8147 - DNA, 618 bp, Homo sapiens
cctgtctgccagcagcagagtccagcaatgagccctctatatggcactgttccttggggtgttcagccagctacctgtggcaggttgattacattggaccacttccattatggaagggacaggatttgttctctactggaatattcttactcaggatatggatttgcctttcctacatgcaattcttctgccaagagtaccatccatgcacttgcagaactgccttgtcgactgccatggtattacacatagcattgcttttgaccaaggaactcactctacagacaaaaatgcgacaatgcattcgtgatcatggcgttcactggtcttaccatgctccccttgatcctgaagcagctggcttgagagagcaatagaatggctatttgaagtcataattacaatgccaaccaggtgacaatactttgcagggctagggaaaagttccccagaagactgtatatgctctgaatcagcatatagtatatggtactgtttctcccataggtaggattcataggtccaggaatcaatgggtgaaagtagaatgggactccactcacaattacccctagtgagccactagcaacatttttgcatcatattcccatgacatta

SEQ ID NO: 8148 - DNA, 634 bp, Homo sapiens
cctgtctgccagcagcagagaccagcaatgagccctctatatggcactgttccttggggtgttcagccagctacctgtggcaggttgattacattggaccacttccattatggaagggacaggatttgttcttactggaatattcttactcaggatatggatttgcctttcctacatgcaattcttctgccaagagtaccatccatggacttgcagaactgccttgtcgactgccatggtattacacatagcattgcttttgaccaaggaactcactctacagacagaaatgcggcaatgcattcgtgatcatggcgttcactggtcttaccatgctccccttgatcctgaagcagctggcttgagagaacaatagaatggctatttgaagtcataattacaatgccaaccaggtgacaatactttgcagggctagggaaaagttccccagaaggctgtatatgctctgaatcagcatctagtatatggtactgtttctcccataggtaggattcataggtccaggaatcaatgggtgaaagtagaagggacaccactcacaattacccctagtgagccactagcaacatttttgcttcatattcccatgacattatgttctgctggcttagag

SEQ ID NO: 8149 - DNA, 1291 bp, Homo sapiens
ggaacatggggcggggggggggggggggataagtactggggggggggggccgaatccaggcactgctgggctgcctgctcaaggtgctgctctgggtggcctctgccttgctgtactttggaagcgaacaggccgcccgccttctgggcagcccctgcttacggcgcctctaccatgcctggctggcagcagtggtcatctttgggccgcttctgcagttccatgtcaaccctcggactatcttcgccagccacggcaacttcttcaacatgtgagtccactcaaggctgtgggagccgggtccctgcactctgggatcctagctcccttctccaggcttctgtcctcctgccagtctgaacactaaaaataggctaggaggttgaggaaaaggtcgggggagggggaagggaacagagccctggggtacaggggaagttgggaacaggactaaagaggaaatatggaccctggaatgctgaattgtcttccaaggagatagcaaaggttaaatgactgggggctgtaaagggcacggcaaggagagaacgagtgatgatgtgtagggttggggagagtgcagtgatgggagcacagaccagggtgggagatggagcttggggtctcaatagtctcccttctttgcccacagaaaatttgtgaattcagcctggggctggacatgcactttcttagggggctttgtgttgctggtggtgttcctggctacacggcgcgtggcagtaactgccagacacctgagccgactggtagtaggggcagccgtgtggcggggagccggccgggccttcctgctcatcgaggacctgactggctcctgcttcgagccactgccccagggtctgctgctccacgagctgcctgaccgccgcagctgcctggcagccggccaccagtggcgaggctacaccgtctcctcccacaccttcctgctcaccttttgctgcctgctcatggcagaggaagcagctgtgttcgccaagtacctggcccatgggcttcctgccggcgccccactgcgccttgtcttcctgctgaacgtgctgctgctgggcctctggaacttcttgctgctctgtaccgtcatctatttccaccagtacactcacaaggtggtgggcgccgcagtgggcacctttgcctggtacctcacctatggcagctggtatcatcagccctggtctccagggagcccaggccatgggctcttcccccgtccccactccagccgcaagcataactgaaagaaataaaaaccatcgggcctggc

SEQ ID NO: 8150 - DNA, 801 bp, Homo sapiens
ggcaacatggtgaaatccctgtcttaatcaatcaatcaataaacaaacaaatacacatactacaataaatgtacttatttatcttgttatacttgtgcttttattttagcagttctgaaaatggcttccttgtaagcgaagtctatctatatttaaaattttaatagatattagtaggtaaaaacatttttaaaaacttgattactaataaaaatttaaaatgctacaccaatttatatttctaccaataatttatagtaatgtggtgcatcctatcttaccaggagtggatgctgccagtcattaaatttttgccatcctgggccaaaaatgatatctaattttgtttcctttctatgaaaattggtattcagacatattccaatgtttgtagctatttacaatgcattcttgctgtattggccattcatatcttttttattattaattgttttctttttaaaatcagttcataaggcttttcaaaaattcttacagaggctggggatggtggcttgcacctgtaatcccagtgctttgggaggccaaggtgggagaattgcttgagcacaggaattcgattgtagcctgggcaagatggcaagacccctgtctttacaaaacattaaaaaatcagcatggcatcatggtgtgtgtctttagtcccagctacttcagaggctgaggccacagtatcccttgagtccagtaattcgaagtggcagtgagctatgatcctgccactgcacttcagcctaggtgacaaaatgagaccctgtctctaaaaaaaaaaaaaaaaaa

SEQ ID NO: 8151 - DNA, 801 bp, Homo sapiens
ggcaacatggtgaaatccctgtcttaatcaatcaatcaataaacaaacaaatacacatactacaataaatgtacttatttatcttgttatacttgtgcttttattttagcagttctgaaaatggcttccttgtaagcgaagtctatctatatttaaaattttaatagatattagtaggtaaaaacatttttaaaaacttgattactaataaaaatttaaaatgctacaccaatttatatttctaccaataatttatagtaatgtggtgcatcctatcttaccaggagtggatgctgccagtcattaaatttttgccatcctgggccaaaaatgatatctaattttgtttcctttctatgaaaattggtattcagacatattccaatgtttgtagctatttacaatgcattcttgctgtattggccattcatatcttttttattattaattgttttctttttaaaatcagttcataaggcttttcaaaaattcttacagaggctggggatggtggcttgcacctgtaatcccagtgctttgggaggccaaggtgggagaattgcttgagcacaggaattcgattgtagcctgggcaagatggcaagacccctgtctttacaaaacattaaaaaatcagcctggcatcatggtgtgtgtctttagtcccagctacttcagaggctgaggccacagtatcccttgagtccagtaattcgaagtggcagtgagctatgatcctgccactgcacttcagcctaggtgacaaaatgagaccctgtctctaaaaaaaaaaaaaaaaaa

SEQ ID NO: 8152 - DNA, 429 bp, Homo sapiens
gttctaatcccatttctgaaagaaagagcataaatatttgccgttagaaatcatggaacagtttttagatgtgttttatgttatttgataggttaatactttatttcaggatttctttttgcattatccttggcagtggctaggtactgtcaatgaccagtattttttgttctatctggggatgtgaatccaaaacaaaggatagaattgcttgtgctctgtttttctctcagttaattttttcaaaatataatcccaagtacaaatcatgcttttgagtattataggggatcatatttttttcttataaccttgaataagatgcagtaaaaacagtgaagctgaccacttttcttccctatcatttaggtatgtagcttctaccagatattttgacatcctgtttcataagaatctttttctttaatt

SEQ ID NO: 8153 - DNA, 852 bp, Homo sapiens
tgctttccttccatttttttttcttttattattatactttaagttttagggtacatgtgcacattgtgcaggttagttacatatgtatacatgtgccatgctggtggctgcacccactaactcatcatctagcattaggtatatctcccaatgctatccctccccgctccccccaccccacaacagtccccagagtgtgatgttccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttctttatccagtctataattgatagacatttgggttggttccaagtcttgctatgtgaatagtgccggaataaacatacgtgtgcatgtgtctttatagcagcatgattgatagtcctttgggtatatacccagtgatgggatggctgggtcatatggtatttctagttgtagatgcatgaggtatcgccacactgacttccacaatggttgaactagtttacagtcccaccaacagtgtaaaagtgttcctatttctccacatcctctccagcacctgtagtttcctgactttttaatgatcgccattctaactggtgtgagatggtatctcattgtggttttaatttgcatttctctgatggccagtgatgatgagcattttttcatgtgtttcttggctgcataaatgtcttcttttgagaagtgtctgttcatgacctttgcccactttt

SEQ ID NO: 8154 - DNA, 990 bp, Homo sapiens
tgctttccttccatttttttttcttttattattatactttaagttttagggtacatgtgcacattgtgcaggttagttacatatgtatacatgtgccatgctggtggctgcacccactaactcatcatctagcattaggtatatctcccaatgctatccctccccgctccccccaccccacaacagtccccagagtgtgatgttccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccattctatcattgttggacatctgggttggttccaagtctctgctatggtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttaatttgcatttctctgatggccagtgatgatgagcattttttcatgtgttttttggctgcataaatgtcttcttttgagaagtgtctgttcatgacctttgcccacttttaccccattctttttttttttttttgagatggagtcttgctctgtcgcccaggctggagtgcagtggagcgatctcggctcactgcaacctccgcctcccaggttcaagtgattctcttgcctcagcctgctgagta

SEQ ID NO: 8155 - DNA, 809 bp, Homo sapiens
tagaaataactcatgttttcacagtatgtactacttaaagaaacaatatagaataagaccattagagttctaattatggctccaccatttgttaacataatcactctacataaattacttaagccatttccccctctgcatattgggattaataaataactcacagttgttgctaagcttaaatgagataacaaagtcattagctcaccatcatttgtatatacagtcattagcaaatatttactgagtaaattctgagggatacagtgctttgcacattataaaaaagtcaatacattttatagcattttgatagtcctagacctagaaagtacttgttggggtcacattgatgccaaatgaaaggaaaagagaagggggttctaatcccatttctgaaagaaagagcataaatatttgccgttagaaatcatggaacagtttttagatgtgttttatgttatttgataggttaatactttatttcaggatttctttttgcattatccttggcagtggctaggtactgtcaatgaccagtattttttgttctatctggggatgtgaatccaaaacaaaggatagaattgcttgtgctctgtttttctctcagttaattttttcaaaatataatcccaagtacaaatcatgcttttgagtattataggggatcatatttttttcttataaccttgaataagatgcagtaaaaacagtgaagctgaccacttttcttccctatcatttaggtatgtagcttctaccagatattttgacatcctgtttcataagaatctttttctttaatt

SEQ ID NO: 8156 - DNA, 58742 bp, Homo sapiens
gggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgaggtgagcgcccgccccgccgcccggcgccgagtcgccgggccggtggttcagcctctctgggccgcgctggcctcgtctctgacaccgggcggtgtggagtccttggagcccttacctcttccgaggctatgctgtccgcgggctccctgcagcccctccccagtcgcgctggaggggaggttcttatcatggggtcgtctaaggactgaggggtgccagacctcaggttcttcaaaaccccgactccagatccccggaacacagaccccagatcctcaaaacccagaccctaaattccctggagcccagactccatttctttaaaacttagacctgagatctcctcgaatcagaccccctgaaactcagatttccccaaacccacattccagaacctagagaccacatgtcttatcccccaaactccacagcccagaaccccccgaagttctaatccactgctcctccaaaccccgcggcatgattttaaagagcatcaattcccatcccatagattctgacctagtagatcagtattggcaaccctggggccggaaagctattttttatttctccggctcccctccacttctgaaaatggagagttgccagctgccctgattgccttaatgagtagttaatggaattaccctagagatttgtgctgaaggttttttttttttttttttttaaattaagttgtaaagtcctgttaaatgtttatcagcccggtgggattatgacccagaaaggttcccgtaaagaggaaagggatggatggaggtaggggcagaatgtcatttgtcccggtagatgggaggggaccagagcaaggcctgggcctcatttttgggaggggatttatggtggggtaggacaaggaagaggaaaagagcgggtgcctcggaggtaatttaggagaaaacgaaggaagaggctgggaaatgccaaagagagggattggggaataagaccccaaagatcgtctgaaagcacctttgagctgttccagggctggcagtgaagggtgaagctctgtgttctgcaaagcgggctgctgaggattgggggaggggtagggagtcagttccacaccccaccagctctgcgacctgcccttgctctaggtttcagtttttgtacctataggatggtgttgggagagaaacagtggaacccagcagatacatttctttaacaagcggatccgtgatcttcttcaaggcccccttgtttgctgctttttcagactgaagaggtcagaggtcaggcattgaatgaatctacccactggcagcggcagggctcctaggatttcctgggtacatgtttctgggtgcccatgccacctcctaggtctgcactggggacaggacacgttcagggtggtatggctgtagacggcacagggcatttcagaagctgaaatgcaagaggccgctaaggcctcttgcaacttgtagtttccaggggttctggaaggaaggaaaagacaggcacccccctccaccctcaccctcatactaatagtgaccttgagagcagagaacaggttttgtgacccatttcaaagtgtgttccttaagcccaagggctgcctgtccagatggtgtgggacactcattctttcataagtaattcagattctgaaatcagacatttcatactggccatcttgatgtagattacattgccatcctgtgtcctgattgtactttatgaaagatgtagaaataatcatgatatttcacggttatttcttgattgtgttttttgtgttcctatgcaactgccgccattcttctctagctttctcccatcctgagtgtttttacatcgtgttcattgagtcaacaactatttactgagccccggcacatactgaagccttgtccccagtgtggatatagcagtacagtgaacagaacagacaaaactccatactctcatgagactgacattttgttctctaacagggaccttactgttaaaaaaaaaaaaaattatactggttgctaatactttaacaatcagcaggtttcacattaaaaactgggtgctttatttctctggaaaaccagccaatctttaggctgccacacttggcttgggttttgtagtgatctgaatccttttggatgaatgtcccttgatgttgcctccctaaccggtctagtctggtgaatttccagtccctgccttaaatgcatgcatctgaatctctttgtcacctgtagcaaattcactgagtacctagagtaagctagacactgtctcaggcactggggaatgaagttgtcactgacctcagagaactttacatacaggcttaaccttatttcacacgagtcctttcccaaatgttcaaatgttcgttttatgagttagtcactttgtacatcatcttagctggtgagattcgactgtttcatagcggctcgtgtcatggtttgtttcatggtcatagagcattaacattttggaggtgaggcttttaggtgcatcagacccaactgcttccttttacagacatggaaactgagcctcagagtggttgagctgtgcaggtacatttaggaaattttccttgagcccagtatgttccctacgtattacactgtgttgcctttttcttcagagagagatattaaatagtgatacaaactgctttttccattttacttattttattttgttttattttgaggcagggtctcacactgttgctcaggctggagtatagtggcaccatcatagctcaccaaagcctctgactcctggcctcaagcagtcctcctgcctcggcctcctgagtagctgaggctacaggcacgtgccatcatgcctagctaattttttttctagtagggatgaggtgtggctgtgttgtccaggctggtctcctgggctcaagtgatcctccttctttggcctcccaaagtgctgggattacaggcatgagccaccatgcctggccgcaaactgatttttctttgaatccatattctgtagcaggtgcttaatatgcattgatgtgaatctgtacaaccacatgaaaaggagtggctctatgtctgcacctgaagaaaccgaacacgagcttgcccaaggccacgcaacacgtggaagactcagatggcatttgggcatcttactgggttaacacttcgtgtctggtaatgctcagaatgtaagagttttagagagtccttgaagagaggacagatattaaatgtctttttagtctctttttcttcggagaatgaaagtaatgagaaaattaagtttctagatgaatgttgctccaagtatttgaaattattcagagttagtaaggaagatttctggccctcattgcagacctttagttgagaaatagaggtgggccccaggaatttgcaatttattttactttattttattattatttttgagacggagtcttgctctgtctcccaggctggagtgctgtggcatgatcttggctcactgcaacctccgcctcctgagttcaaacaattttcctgcctcagcctcccaagtacctgggactaccggtgcctgccaccatgcctgggtaactttttttgtatttttagtagggacagggtttcaccttgttggccaggctggtctcaaattcctgaccttaagtgatctgcccacctcaccctcctgaagtgctgggagtactggcatgagccaccgtgcccagccaggaatttgcatgttaataagcaccttactaatggcaaagtttgcaaatttgttttagacccggaaacttacacgagcaacctagaggcagccactaaaataaacagaaaagcattgaaaaataaggcattgtaataggctgtaggtggtttctaatctgaaaaacattgagtcacatgatttgggagagagtttgttgatttccctctgtccccagtaatgccccgtgttaaaagctggcatataataggtcctcagtgaatgtatactgactgagtgcattcaggtgtaacatgtgtagttaattcccaaaggcaatgttatgatttctgttttccttccttcctttccagataaagctgtacaccaagcatgggactttgaaataccagacagactgtgcccctaataatggttactttatgatccctttgtatgataaggtaagaggggactgcttgtcacttatgatgggaagtcactagtgtgcctcaccaggctgcattaaccatgtcctttcctacactagcaaatgctcatctgttttgtaaattattagtggaatatgataatcctagccacatttggagggagacaacttacaaactgccttgacgaatacagtggctctctctgtgtttaggaccatttggcaatgtctagagacgtttttgttgtgacatctgtggctgtgcgctacagtcacccagtgagtagtggccaggcgtggagctaaatgtgctacagtgctgcctacgacagcccagatgtcagtagtgccagggctgagaaactctgatttcatggaacccgttacttgcaagcagcttaaagtattgttaaaaaaattgtacaagtaatacatgaattcatgaactttgtgaaaaagaaagtcaaggtctttagaagtatgtgaaataaatttgtacccttttcgctccaattttacctccctctgtagtgataacctctgataatctgataaaggttttttttgttgtttttttttttcttcttttgagttggagtctcgctctgtcgcccaggctggagtgcagtggtgtgatcttgcctcactccaacctccaccccccaggttcaagccattttccttcctcagcctcctgaatagctgggattacaggcatctgccactacacccagctaatgttttgtatttttaatagtgatggggttttgccatgttggctaggctggtctcgaactcctgacctcaagtgaaccacctgcctcagcctcccaaagtgctgggattacaggtgtgagccgatgtttccggccctcttataaaattttgatgtgcatcctaacagattgctttctatttatagttattcagatatccacgggtacacatgcatatgtatatatggaaatacacacaagcacacatgcacatcgatatgtatccacaaacacctctatacaatcccatcctcccacatataaaccttttatttggaaatacagattcataggaagttgcaaaaatagtcaatacacatagttttgattttgatatattttttaatacaaatgaaatcaaacaataggatttattctgcagtttcattttttcccctgtgttaatgctttcaataccagagggacatttggttttttcctcttgcatgctttcaacattagcatagatagatctactgacttttttttttttttttgagacagagtctcactctgtcagccaggctggagtgcagtggcgcgatctcggctcactgcaacctctgcctcctgggttccagtgattcttctgcctcagcctcccaagtagctgggattacaggcacccaccaccatgcccagctaattttttttgtatttttagtagagatggtgtttcaccatgttggccaggctggttttgaactcctgacctcaggtgatccgcccacctcagcctcccagagtgctgggattacaggcatgagccaccatgctcagcctactgacttctttttaatggctgcatagtgtgtcagagtcaaacccaaactgtaatttatttaactacttggacatatagactttccccaattttaaaataatagtaattttaacataacacaccaggaaatattcttgaacttaactcttcatccagaatgcataggattgatttctagagatggactagctgggtctgtcctgaaatctatttaattaatttttaaatagtatcagtatcagtctcaagaaaccaggaggctggacgtggtagctcatgcctgtaatcctagcactttgggaggttgaggcaggtggatcgcctgagctcaggagtgtgagaccagcctgggcaacatggtgcaaccccgtctctactaaaatacaaaaaaattagccgggtgtcacgtggatgcctgtagtcccagctacttgggaggctgaggcaggagaatcgcttgaacccaggagacggaggttgcagtgagccaagatcgcaccacttcactccagcctgggcaacagagcgaggctccatctcaaaaaaaaaaaactaaaacaaaaacagaaaccagggttgataagtaaaatctagttttatttattgaattaatgagttaacgtattgtttagagacaggatccccttccgctgcccatgctggagtgcaggggcacaattatggttcactgcagcactgacctcctgggctcaagtgatctttctgcctcttcctcctaagtagctaagactgtaggcgcctgccaccacacccagctaattttttaagaacattttttgtacagatggggtcttgctatgttgcttaggctggtcttgaactcctggcctcaagtgaccctcctgccttggcctcccacagtgttgggattataggtgtgaggtactgtgcctggccaaatctagttttagggggtgcctttagttcctgaagatacatgctaacttgtgcaactgtaggcatgtgagggcttaatgggagactcaattaatagaattatagtatgtttagtattaaaagacagtgagtggctgaacctagtgtctttagaactcatgaatgggcttcagcactgtcttctgattgtttagatgaaaacttctggtgttcagcttcagcttgtagcttctgaagagaatcagtgctcagtaccatgtagaagaacaaggcttactcttagaatttcatttccggtgtaaaaaaattttagattaaatgataacactaaactaaatttagccagagtcacaattctcatttcttgaaattacattttctttttttccttttagggggatttcattctgaagattgagcctcccctagggtggagttttggtaagttaactgaatcactagacattctttgtaaaagattagatgatatgccgaatattaatttaggctagcagagtgcataaactattaaaatattaaggatcatttccagtatggaagagggtttgtattcctcccctccttgcccccatcactctggtttagttcggatttaccttaatctacctcaagactttctgtcacctttgaaaaatagacatcttttcttctacctttctggaaactcttcccttgcagtttcactcattacgtggccgtggaacagtatagaaatcaagagtggggacttggttcccatcccaggatggcttcttttttagccccctcagttttttaagtttttatggaattaattgaaacatttaaagattgtgagatttgtcataaaaatccagatttatgtcccatgagatgagaagactgtcagccttataccttaccagttaaataactttgggcaagttacttcccccgtgtcagcctggctcctcactgtcgagcaagggtagttatagtccctgccccactgggtacttggaggattaataaaccaatactgagtgttcagaggggctggcacgtaattagcaagtactcagtattcagaaacagcccttctgcacacatcccaacaaaagctccaaactttcctcatataactgccttcaagcatagctggggagttggggatggggttgagatcagaagagagggtctgttttgatgtagtttacatttttgaagaggagagactcttgatgtttcagtagagcaggtgtgggtgaccccagtccatggcttggggagaggagtagggatcaccgttgttgatatcaggcttgctcgtgcattagacaaggaagaatttagcacctgccatcaccaaggctaaaatgaggctcaggcagctgacagctaatttggctctgtgagagcagctcttttatcagtttatagtcaggggtagggtggggggtgcctggctggtacgttccagaaagctggagaggaatgcagccctgctcatggccaaagcagaagtccagattggtggcctggaggagtgttgtgtttgccaccccccaccctacccccaactggtgctgttgataagctttttaattgaattatactttcagaaaagtgccttggatgaattttcactaagtgaacacacccatgtatccaccatccagataataagatagcacttcaccagcaccccagaagtccccatcctgggtgctcattagccatcccgccccaccctccaggtgaccaccaccctgaccttctacaaattagagatccatttggtctgttttgaactttatacaaatgctatcatgcagggaactttttaatatccggtttctttcactcaacattatgaactttatctgtatcatttgtagctttagttcattctctttgctgttgagaattctgatgcataaatataaaattatttatattttataaaatacttatattttattttatttttttcttttttttgagactgagtctcgctctgttgcccaggctggagtgtgatctcagttcactgcaacttctgcccgggttcaagcaattcttgtgcctcagcctcctcagtagatgagattacaggtgtgcaccaccacacccagctaatttttgtatttttagtagagatggggtttcatcatgttgacccaggctggtctcgaactcctgacctcaagtgatctgcccgctttggcctcccaaagtgttgggattataggcaagagccaccacgcctggcctatatttatattttatattcatattttgtatcagtgatctcttctactgttgatggccatttgagttgcttaccgattttggccactaagagcagtgctcctgtgaacattcttgtatgtatattttgatacatgtgtctgcatttttgctgagtatatcacaggagtaaagtcgctgagccatagagctgatacatgctcagctttaggtgtttgcaaacatccaaagtggatgcaccagtttgtgttctcccagcagtgtacaagggtttccattgctccacatcctaacctacacttgatatcgtcagttttttttaattttagcccttctggtgggggtgtggtattatctcactgtggccttgatttacattccactgatggccaatgaggttgcacactttttcgtatgtttatgtttgtttgccatgggctagctatttttgtaagattcctgttcaagtcttttgcccattttttattggagtctttgtgtgtgtgtgtgtgtgtgtgtgtgcatgtacgcgtgcaagcacgtgtgtaattcatcttaactgaaaatctcatctcatggttttccatttttttctctactcattactccatattcttcctaacctttcaaaaactcaaccttaacccctattatgatgaactcttcagttaaaaaatggagttaattgctgatattgaaaaatcaagagatggtatataaaatccagatttccagtttttcggagaagttggaagctctggcaaagcatggtagtggttggcagacttgagtggcagttgtctcctttcaatttgccacagtccccctgaggatgctccgctcacttcgaacccatgaggcccctgtggccctggagtttgtgttcctggtttaacatggctgagctcatgtccttggtcagagaacagatccagagccagacttttagggttgaattggggctctgttactcagaagctctgtgatcttgggagctcctttaacctttctgtgccttaatttacccctcagtaaattgcagctattactgcctgtctcttaagataattgtgaggattaaaggcactcagctcagtgcctggtcggtgatgagcattcaggaaataaaattatttggtgctcactgaattttcactggaactctgagatataacttagctgaaaggcgttgtaaaattattttatactctaaacacgaattccctctggggcaggaaaccaggaggctagggggataggggtgagagggagacttttcccagaatactttttcgtacctttggatttggaaacacaacgagtgtattaagtgttcaaaagtaaaatgaaacctgaataataaaaatacgttctacttaggttcactgtaccccaaaactaagcttgcctttgtgtcttgtgccccggtttcctcccctgcttcgttcctcagagccgacgaccgtggagctccatgtggatggagtcagtgacatctgcacaaagggtggggacatcaactttgtcttcactgggttctctgtgaatggcaaggtttgtctttggaacttgattatttttcctgttcactctataatgtatactaaatccttttttaaaaaaatgcaggatattttaacctggggactttgatcccacaagggacccatggataagtggcaagtgagcctgtgaactctgtacttcatccgtgtagaacacagcaggtgtatttaggaatgagattgaggttgctggtcatcccctctgctcccagagcataggctgttggtgtttttatttttttattttttattttgagacagggtcttcctctattgcccaggctggagtgcagtggtgcaatcttgactcactgcagcctccacctcccaggttcaagtgattctcctgcctcaccctcccgctccttcaccctcccgagtagctaggattacaagtgtgtgccaccatgcctggctaatttttgtattttcagtagagatgggcttttgctgtgttggccaggctggtctcaaactcctgacctcaggtgatccgcctgcctccacctcccatagtgctgggattacaggtgtacgctgtgcacccagccgctgttagcgtttatgtcagggatggccttttacagggatgccgaattggaaggacacactctctaagccttgtggcatcttgctgtccctgtgggtgaattgaagtcagcttctcccagagagagcgtgcatctgcttctgacacttacgtaggaggattcctattatttaagttctgagatttttttggaccgccacggtggtgtgaatttagagtcctaacgggtgtgtgcccagctcccgtgattcagattctcaggggagagtcatttctcctccacccgccctgtgcctgcggttgagatgtgcttccttccttcctgtccttctcttcatgatggacttctttctcctctacctttgcggtgacggggaggcccttccatcccagctgtatgtgtgggcttcttgttagagatggggatcttgggtagttttttctttatcgatggtttgcaaaataatggtgaacctttttttatttttatttttatttatttatttttttgagacagagtctcgctctgtggcctaagctggagtgcagtagcgcagtctctctcaccacaacctccacctcctgggttcgagcaattctcctgcctcagcctccccagtagctgggattacaggcgtgtgccacctgacccagctaatttttatatttttatttttatgtacatttacttttttttttttttttttttttttaagatggagtctccctctgtcgcccaggctggagtgcagtggcgcgattgcagcttactgcaacctccgcctcctgggttcaagtgattctcctgcctcagcctcaggagtagctgggattacaagcatgtgccatgacgcccagctaatttttgtatttttagtagagacagggtttcaccatgttggccaggctggtctcaaactcctgacctcaagtggtctgcctgcctcagcctcccaaagtgctgggattacaggcgtgaaccaccacacccacccagaccaataatggtgaatctataactgatgatgtcttagattcattgaaatagagtcttattttactgttactgttccctctcctacctcatccccaggaaacatatccatgatttatagcatcttttcaatgggattcttgacccaaagagggttcctgggctccacctgggagttgtaagcaggactgccagtgctttgagaggagggtgctttgctgggtgggccctaactttcttctccatggcaggtcctcagcaaagggcagcccctgggtcctgcgggagttcaggtgtctctgagaaacactgggaccgaagcaaagatccagtccacagttacacagcctggcggaaagtgagtagcgtcctgtctcttagtgttgccttagagccgggctctgacaggggtcatggagctgggtttgggagtttggcattcagggagttctgggttcagatcctgattcagcctcttaagtttgggtgagttcatgcccgtcagagtgctgagttccccacatgtgaaatggaatccatttgacccatcttgcctagcattgatgagatgattaaatatgagttcatactggccaggcatgttggcttgcgcctataatgccagcactttgggaggccagtatgggaggatcacttgagttcaggagttcgagaccagcctggacaacatagggagactcagtctccacaaataatttaaaaaattatatcaagtagagtcccacgggggaagaaaattagctgggtgtggtggcatgcttctgtggttgcagctactcgggaggctgaggcgggaggattgcttgagcctggaaggttgaggctgcggtgagccgtgatcatgtgccactgtgctccagcctcggcagcagagcaagaccctgtctgaaacaaacaaaaaaagagttaatacccataaagcacctgcttcaaggcctggggcttagtgggtcttcatttagcagctcagcctggctctggagcctgccagcccgggcttgaatcccagctcccccatttgctggctggttgacctagggcaagttccttaacccctctgtgcctcagtttcctcttttgtaaatgaagataattgtggaacctatctcctaaggtactggaaagatgaaattaatattattacttcaagctgcctggcatattagctcaaataggttagctcagttatgattagaaaaaatcattatcattattatatcaaaactgctttgtagttggaacagatgcctagctgaccttgctgagtcagatttaaagcatttatttaatggatgtatatagttgagttgtaaatgttaacagatatgccaagattaataccagaatagttcaaactgataattccgaaagcgttcaaatcattactaactccgttaatatacaaactgagtaaattgcaaaatagaagtttataatgagtctgtcagtaagttattcaattttaaagttattattgttgaaactagttttcatttttgaaataacatttacttctgcttgactggtgcctctccaggcctggtgtgtagcaggaatatggagctgtaattttttttctgggctagtaatttggtgttgaccttactagaaaaaaatagtgtcttgagccttctgaatacctttcatctgcactaactgaaacaatgaaacatgtagcactgggctattatgaaaatgaaatagaagctcaatcttaccaatacttgtagtaatgtgatttccaagacctatccagttattgcaggcaagatttgacacaataaaataccacagaagaagaaatcaaatgcgttttctagttcatttcaccggacttagccttctcatttgtcagttgccttacaaatttgaagggataaacatgttagtatactggcagcagcatttccagctttagctcggctcactctggtgttagtctgtctatggctagtagagtaattttcatcagctgctggtttcttatctcagttgctttgtgcaaaaacccagaatgacttatctgtgtttctctaaagccttttttctgggattcaaagcttatcatagtttaccctgccctgtgtcatttgcatcatcttgggtcagcgtccccctcagcctgtgcatctgttctgttctttttcaccccacttctcccttcccatgtgtttccttggacacttctgtccccttctccttgtcagttcatgcctgtcacctctgtcaaacccagtcgaatgttctgtgactggtccctgctgtgctacaaggattggttttatgccagaaatccttgagattaagggagacgtaagcactcctctttccgatcagcacatggagcacccctcttggcacacagtaagtgctcaataagcgctcttttatgcagatttgtacagtgaaggattgaatttcattcatgctcatttaacaagctaatggaagtttgcgataattccaacattgttttcttgtgctgccaacattagtcatagaattagaaatacttgggttgtttggagaaagttaaatggttattttttatgtcttaggtttgcattttttaaagttctgcctggagattatgaaatcctcgcaactcatccaacctgggcgttgaaagaggtgagtgacagctacgtctatagccatgccaataatatgctggtcttgggacaaatgtagggcttttcaatttaggatatgaaaagaatttatggttcctccaggactagatgaagaaccaatggtgctgttgtttagtttggtagttatttataaggtgtaactcctcactgtagcagatgttgcttgtgttagtttcagttttaggtgacagtgttgtcttcctgctgtgaaatagatctgttttattaactatagctattttaaactaaatcaacaacagaaggccctgacgagatttatttgttgttcttttttcagcctgaaacagaaatctgtaaatatactaaacattctagaaactgtggtacgcgtgaccaaggagaatgtatgagaatgtttattgcagctttgtttgtaatagcaaaatattgtaaacaacctaaatgccttttaagagaagaatggattggggttccatcatacaataggctgctgtatgtcagcagtaatgaatgaaccagagctacatatatcaatgtaactacatttaaaaacagagttgaaggaaatatgattttaaatacttgtgataatcatttatggatacagtcttttttttttttttttttttttaaagatggagtctcgctctgttgccaagactggagtgcagtggcatgatcttggcttattgcaacctcggccttctgtgtccaagcgagtctccggcttcagtctcctgagcagctgaattacagggatgtgccaccacgcccagctaatttttgtatttttagtatatatgggattttgccatgttggccaggctggtctcgaactcctagcctcaaatgatccaccagcctcgggctctcaaagtggtgggattacaggtataaaccagtgcactcggccagatacagtctttttttttttttttttttttgcaacagggtcttgctctgttgcccaggctagagtacagtgacatattcatggctcattgcagcctctggttcctggccttaagcgatccttcaccttggcctcccaaggatctggaactgcaggcatgtgccactgcccctagctaaggatacagtcttttttttttgagatgaagtcttgctcttgttgcccaggctggagtgcaatggggcgatctcggctcattgcaacctccgcctcttgggttcaagcgattctcctgcctcagcctcctgagtagctggggttacaggtgcctgccaccatgcccagttaatttttgtatttttagtagggacagggaggatacagtcttatgtagaaaaattataaagacatgtatgggaatagcagacgctgttcaaaatgatactgacttctagagaaagagggaggagggggacttcggggtacgccagcatcttgaattgtatttttttaaatttctttagctggttagaaggtatgtaagtgttctttagcatatctttttttgtttgactgaaatagtttatagtcaaagatcaaaaaaggaactccacctagtaggtgaggttctgtaatagccgtgaaagaccaaattgaaataagacttaagggacatcttgacatgttagcttctgtgttagtattgaagctgtatctcatttttgctaaagaagcattggaatcagtatttcagcttctactctatctgttttattattatttttactctgtaggttttacgcacttataattgatgatagtttcacacctagatgtctcttcttactgtttgtgacttttggttttgggggtttttctcttctgcagcaacatttaaaaatattttattcgaggctgggcgcagttgctcatgctgtaattccagcattttgggaggctgaggtgggtggatcacttgaggtcaggagttcgagaccaacctggccaacatggtgaaaccgcatctctactaaaaatagaaaaaaattagccaggaatggtggcatacacctgtaatcccagctactcgggaggctgaggcaggagaatcgcttgaacctgggaggtggaggtagcagtgagccaagattgcaccactgcacttcagcttgggtgacagagtgagactccatctcaaaaaaaaaaaaaaaaaaatttattcgaaatgaaagagcttacacatttataaatagaagagattttaaggtttacattgtatgttaattgtctgcatagaagaatctgagtttattaatatgagattgggattttcaagtaaagcatgttgttagaagtcaggataatgtttatcttcctggggtgttagtgaccggaagcaagtgtgagggcacttctggcttgctggtgctattctgttgggtaaccagtgcccaatttgtgacaagccctgtgctgcgtgcttagaatctgtacacttttctctgtgtttattgtaccttaacaaaaatgtttaaaaatatacacatattgtgaaaagaacaacttaaggcaaattaaacagagtttaattgagcatagaacaatttgtcaattgggcagctccctgagccagaataggtttacagcgactgtggcactgttgcgtgattggaaagggtttatggacagaaaaagaaagtgacggacagaaagtggaagtgaggtacagaaacagttggattggttacagctggacgtttgtcttatttgcacatggtttgaacagttggctgcctgtgagtagttgaagggtggctgcttgaattgggtgagacttggcaacacgtaagagaaacctttaggccaaacttaaaatatgtaaggaggcagctttaggctaatcttcagttaacactatatatcattaaaaatagaaaaaaaggcaaaatatgctcattaaaaaaattggaacatatagaggaatataaagcagtggaaacaaattttggaagctggaaaagtatacaagtaaaatagcaccatatagacaaaatcattattgtttacattttgccacatttcctttcacttcattttgggcattaaaaaataatgataagccaggcacggtggctcacacctgtaatcccagcactttgggaggctgaggcgggcggatcacctgaggtcaggagttcgagaccagcctggccaacacggtgaaaccctgtctctactaaaaatacaaaaattagccgggcgtggtggcgagcgcttgtaatccccgctacttgggaggctgaggcaggagaatctcttgaacccaggaggcagaggttgcagtgagccgaggttgcaccattgcactcaagcctgtgtgacatactgagactccgtctcaagaaaagaagtgatcatactgaataagcaattttatagattacgtttcccagttaatattttagcttcagcgtgtcctcatgttgttaggcactttgcaagtgtttatttttttacaggttaaaatctttttctgttacaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggtaagcaaagaaaagaacaaaagagatggtgtgaagggtaggagggtgggggattatagaccagaacgtactgttttaaaaaatgcaggtctgagttgatttatcattttaacacttaagaatatcgtctgtctcaggccgggtgtggtagctcatgcctgtaatcccagcactttgggaggccaaggtgggtggatcacttgaggtcaggagttttagaccagcctggccaacattatgaaaccccatctctactaaaaatacaaaaacattagccgggcatgttggcacgtgcctgtagtcccagctgcgtgggaggctgaggcagtagaatcgcttgaacccaggaggtggaggttgcagtgagccaagatcacgccactgcactccagcctgggtgacagagtgagactctcaaaaaaaaaaaaaaaattcaagaatatcatgtgtctctgttgactcacaagacattgcacatctacactgggaggcagtggtatgtgatggaaagtacacaggctttgaaatcagacctgggtttaaacaaatctcagatttaaacaaattcctcttcctagctatgcgaccctgggccggtcacattaccttcctgagcttccgtttccttatttggagaatggtgacccatgataaggaaggacagtcatgtcatctttcccgggaagactgtgccagtttttaactttgcaacttgaatgtcaagatttttgttccttttatctgtattaatgtgtcttagatttcagaaatacatatattgacatgaaacttaaaaaaattttcctataatgtggctaattgatggtattcagaacatgtaaatggaaaaggaagtcttgtcttttttaccccctggcataggatgtcctgggctgcaatgtctcaccagtgcctgggttccagccccaagacgagagtctggtgtatttgtgctacacggtctccagagaagatggctcgttctctttctattccttgccaagtgggggctacactgtggtgagtgaagcagatttccgttctgtttatgtctgggactctcatgacacagtaaaagccaatgctgtttgggtgttaaaggaaaagatggttggcctgcagttctctgaacatgctgttaagcagtaacttacttaagatgagacactcaccccttcgtaatagctacaaaaagggcaaggcttcctcttttcaaatctgcaacagttatgatgaatgtttctcttggtctgtctgaaccccttgtcatttgtgggctgctagatcgattattaatattgctgattgatcatgttagtggttcttagtgattaagagactcttccttccagattccgttctatcgaggggagaggattacctttgatgtggcgccttccagacttgacttcacagtggagcatgacagcttgaaaatcgaggtaaggcttttctgtcttctggagggacaggtgtttgagttcccatccctaggcacaggtattgcaaacatgttttaaaaaaaaatcaattattttatctggaagggctgttggaaaaaatgccatctggtattatattcttacccatgatgtccttatcgtagagagctggattcctagttaaatctactcattcaatgaaatatatttattgattgccagtgacatgcatttcaggcaccattccaggactggggatatagcagtgaccaaaagaggcaaaaattcttgtccctgtggacctcattttttttttttttttttttttttaagacagggtctcactgtgtggctcaagctggagtgcagtggtacgatctcatctcactgcagccattgcctccagggttcaagtgatcctcccacctcagcctgttgagtagctgggaccacaggcacgtgccaccatgcccagctaatttttgtatttttgttagagatggggtttcaccatgttgcccaggctgttctctaactcctgggttcaagtgatctgcctgcctcggcttcccaaagtgttgggattacaggtgtgagccatcgcacctggctagacctcatgttctaatgacaggaagggtcaatacatgtatagatgtataagttagaaagtacagtagaaggtgataagtgttctctagaaaaataaaggaagaaaggaggtagtacagtatcagggtggagacaggggttgcagttgtacatagggtgtttttgggaagtcctccctgtgaaggtgacatttgagcaacaacctgaagggaaagaacaagagaaccatacttcactcctgcaggaagagtgtgtaagactgagggaacggcacgtgcaaaggtcctgaggcaggagtgtgctgaagagtttggggcatcccaaggaggccagggtggctggagtggagggaatgagcaaggaaggaggaggcggaaagagggtcagggaggtgacagggcagattgtgcagggcttggtgggccactttgcctataactctgggtgagaattggtgccactggaaggttcctagcagaggagtggcgtgatccttctggcagctgcattgaggagagtttgcagggtgtcagggtggaagtgggagaccagttgggatgccatggccgtaaaccaggtgagaactggcagagcttggaccgtgatggtaggaatgggcagtgtgatacatggcttgataaactgcctagaccctcacataaatggtaaatgtatttttcatctcacttacgtctcctttaattacagaagtagaaaatggttactgtagaaaattggctagctagaacaaatcccaaaagaaaataacagcctctcctaagtggaccacccaatgttagagttatcgaagcaattatattttaatcattttcttttaataattacatttgaaagtactgtgttaaaatcgcttaaactggcagaagcggacttttaggtcatatgcacagtggggtgcagactctgcattttaagattcagtggagtgtttgaccgttctgctgtacactggaggggaaagagaagggtaagaagatgaagcctttactttgcttctcgtagcttgcagagaaggatgggggcaggtgagcagagacagctattcccagattacagccaaatacatattttgaaaatgatgaatggaatttcagggaatggggccctgtaagttccctgaggtcaggtactgtgtcttattctttactgttttcctaacatgtgatttagtgcctggcacatagtaggtgcccagcaaaaatatttgttgcgtacatatgtgaattaataagtaggtaatgcatggaatgaaacatgtctttttggaaagatcaagaaggactacctgtcatgtgagaccatcactaagaaaccatttgctgaaaaaaaaaataaaaaaataaaaaagaagggctccctgcataaaaaggaagtcatttaattatttaaagcttcatctcaaatgctgttgcacacgtgcgtgcacacattcattcattcaggagtcagttattgagtgcctgctgtgtaccaggtgactaagacagaaaaagtccctgtctccatgaggtaacatgctagtgggagggagacaactaagaaatcgaacgaggacatttcagatactggtaagtttgatgaagatattaaaataggttagcagtggtgaccttggggatacacagatcagggctggaactcagtaactgcagagaaagcacagctgtgctgctcacaggcgagtggggcacagacacagacacagacacatggagcacgggaccacgtgtgagccagtgatggtggtggaggagggtggtctaggtggatttctttttttttctttgagacagagtcttgctgcttcacacaggctggcactatcttggctcactgcaacctctgcatcccgagttgaagtgattctcctgcctcagcctcccgagtagctgggattacaggcgcccgccaccacacctggctaatttttgtatttttagtggagacagggcttcaccatgttggccaggctggtcttggactgctgacctcaagtgatctgcctgcctcggcctcccaaagtgctgggattacaggcgtgaaccactgcgcctggcctaggtggatttcataaggacctgtgttcaggtcgtggtggaaagacaggaggggacacgtgagaccttgcagaggtggaatccacaggactgatcgatgctggaggagcggggcgggtcatccaaagtgatgccggggtgtgcatgggagactggaggaagacgtggttcaccaaaatgggggcatctggaggggaggagatggcacaggggtaagggtggggggcttctagaagcttgagtcagtgaccttttaacgagggaagtaagtctctagacttttcttttctgttgtttgacactcagcagtgtgttgggaacacaacagagaagacagatgtgggtaaagtgagagggagcccggctggcacacaggaccggggcactgagtgttgggaggtgggcggcaggagcagacatggtaggtggtggccggcgcagcagaaggaggctttgtggctctggcacaggagcaccttcgagcaccttcttgttctttgttttctagcccgtgttccacgtcatgggattctccgtcaccgggagggtcttgaacggacccgaaggagatggtgttccagaagcagtagtcaccctgaataaccaaatcaaaggtgggctgacacagcagccccaggctgatggccagcgctctttttggatcacagagagaaatggagaggaactgatgactatatgagaacatggcagcttttggtccaagtattctggtgtacatgtaaggatacactgttgtttttggcttatcttctgtttgtgtgtttttgttttacagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggtaagcttatcgtgtggatttggaagcaccagtaaatatgctggcagccagtgtagaaccaaatgacctgtgatctgtgtgtctttgccgagcttaagaacttaagaaagattagtactttttttttttttttgagagacagagtcttgccctgttgcccaggctgtagtgcagtggtgccatctcgactcactgcaacctctgcctcccaggttcaagtgattctcctgcctcagcttcccaagtagctgggactacaggcgtgccccaccacacccagctaatttttgtattttttagtagagacagggtttcactatatgttgtccaggctagtctcaaaactcctaacctcaggctgtctgcctgctttggcctcccaaagtgctgggattataggtgtgagacactgcacccggccaagaaagattagttctaaatcttacaaactgaaggtactgacatgtcggatgcttaatgaaaagtcccttgcttcaaattaaaatgggcttgtgaaattaaaaaatctttcatgtctgactttcacgatctttcacaggacccctctttgcttaatctttgaggatttttggaagatggtattgttggttgagaaagcttattggaagatgcttcaggtcattggtgtagttcttcctgcttgtagttactcattatactataagtacaggcagggacatcttgtggttgaattcatgtggttttaccatcatctgaagcaagattgtgtagtgccaagaacttgggctttggagtcagatcccagatccacctgtatgtaacctgcagaacagctttagacataacaggtgctcacaaaacagtagcttagaaggagactgcagggtctgcttgggagaagcgcggcatgagcaaagtcaggcagtctcacagcagcatgaggtggctgcgggtgtaaagctgggtgctactggagcagaatatactggcaggtgaaggtgatgatgaggccaaccccatagcacctcctcacaccccaccagggcgtaggggctttctcccactggggccaacgggccatgagtggttttgagcattaatataacaagctttgatcattgttttcaatagggcattctgaaaacaatggcatggagtagagtggctttgaaggggacaggacttgggcacaggaggtctgaaagcagagacgacaagggcttgccttgtagggaagtcagggacagactggtgagatatttagggtgcccagcttgagaggtgtgatggctggggacagaaagagaagccagttaggtgatgaggtttcagatttggccacattggtctgtaggaccactaggtggagctcttcaataggtacttggatggatggtaaatcctgaagatttggccgcaggtggcagccaggacctcaaatatgtatgtgcaagtagaattagaagaacagtaggccaaaaacagagtgccaggtggcccagggggggacctagggagcctgaggtcataggagctaagaaagtaagtttggggtaggaggtagggcccaacaggtaggtgcagggagctgggccctggtgaacacagtcccctggcttgatcactgaggaggccacagtgactcttttctgtagacagatggaggtcaaggtcaaggagtccagtggtgaatggaagacagggaagcaaattaccctcagaaagtaattcttggatttaagtctttcccaccttccataaacactttgtgcaattactctagatgaggcactgaaaaatgcttcgtacctaataattaatcaaactagtgttccagagatggggctttcaccctaccagggagacagactgaagacaaatacatctgtggccaggcttaatgcctcacacctgtaatccatcccagcactttgggaggcagaggtgggcggatcgcttgagcccaggagtttgagaccagcctgggcaacttggcaaaacaccatctctaccaaaaatgcaaaaattagctagtttcataacctggtctaaaaataaataaagagataaaaattaaaaaataacaagatttttaaaaaagacaaaaaagacaaatacatttatgctgctaaattatggcaagtgttgtgcagggaagagatcagggtgctgcaagaagagctaatttagagtgggagctctgcaaggctctctgggttgcagagaccttagtaaagactaaaagttagctaaagaaagatcttccctagtagagaagcagcatgctcagaggcctgcataggataggaaggacctgaaaggcagtctgcgcagctggaggaggtgggtgaggtcagggagctctggggccttgtagccttgctttgggattgggctttgctccctaatgcagtggaaacccgttaggagttgtctgttggttggccgggcacggtggctcacgcctatgatctcagcactttgggaggctgaggtgggcggatcatgaggtcaggagttcaagcgcagcctggccagcatggtgaaacccggtctgtactaaagatacaaaaggttggcggggcatggtgatgcgcgcctataatcccagcaactcaggaggctgaggcaggagaatcgcttgaacccgagaggcaggggttgcagtgagctgagattgtaccattgcactccagcctgggcgacagggtgagattccgtctcaaaaaaaaaaaaaagagttatcagttggcaagggagtgatagggatcatggtactttaaaaagtttgtttttcttcctggctgctgtgtggagaatggattggaggaaagccatggtgtgaatggaggggccagatatgaggcagtcgtggttgtctggaggagatatggtagtggctgggcccaggcggctggcaggcgagggagcgaggagtagatggatttggtaggtcacatggagaacacacccacaggcctgtgctgttgaggttacaggtttcttatttgagccactgggtagatggaggcggtgctgttcacggagatggaggaaatatatttattttctcctttaaagtagagtatttgggtcaaagaaagaaaaatagcatttgttgaacatttttggaaaaatctcttttttttaattggccgatgtagtacacttgcctttttagcacactgatacttcttactatttcttttcctttttattttttgttgagccagggtcttactccgttgcccaggctggagtacggtggcgccatctcggctcactgcagcctccgcctctcgggttcaagtgattctcctgccccagcctcctgagtagctgggattacaggctaatttttatattttttagtagagatgtggttttgccgtgttggctaggctggtctcgaactcctgacctcaagtgacccacccgcctcggcttcccaaagtgctgggattacaggctgagccatggtgcctagtcttcctttaaagtaaaataaaaaaattactcaatttattgtaaaaacaaactctttggcttctgtccaaatgactgtgaaaatagatttctctcaatatccaccaatattacctgtttctgtccatatatgtatttaaaccctgttgaaagaatttattgatacaaatcaatttttaagggcttcagtataacggaacctttttctaccacccttttggtttatttttccaaactaagccagtatagatttgaggtttagggaaaataggcacttctttttaataagaatgtgggctaaaacagatcttatggttcaaatatttacaacttaaggaggcaaagagatttgataggaaatagacaaggtgatgtgtcctctgacaggtacacaaatcaagagaatatgacaggtccttgggaatgattgtgtcagtgttcgcttcccatccttttattctgaaagttcacagtaggggaatgtgagaaccaaaatgcatatgctaggtcagggactgggacactttctctgtggagagccagagaataactattttaggctgcgtgagccatacggtctctaggacaacagctgagatagacatttgtaaatgaatgggcagagcgcaacacaactacatttttggacaccacagtttgcatttcatgtaatttttacatgtgaaatattatctttcttttgatttttttttttaactttaaccacttaagagtgtaaaattctttttctcggcttgcagttcatacacaaacgggaggggggtccttgggtggtagtttgctgacccatgctggagatagtgagctcatatggctgggcagtcccttcactctgaagaaatggctgtgtttttcataattcctagatttcacatacacaatcttccaccatttccttgtgttttccactgtttttttatttgaggcggagtggtggttccaacatttaatgtacccctaattgtcagaatccaacattcttgattatctttatgtcagaagtaactaatttttatctaaaatgattcttgaagattctttaaaatgaacagttgaaaagacaactgtgacccccagctaggatgtactattacactttaatacaccagctgcttcagaaatgaagaccagcactccaaggatgatggtcgttgtaggggggcctctcgtgtgttattcgagggatgccttgcaacaccttactccttatttagaatctcaaatctgaatcattaccttaatagggcttttcagttataagttacattgtggctcctacctcccaaggagttcaattttagctttgcattttttaacttaattaccttttctgttccaatctcccagtttgctttcatccatgtattatatataatcacaagcaaggaagacgtctttgataatcctgacttatttgatggcctggtaatgccacagtttcttaggcagcttagagctcttgcttttaagggctagcccacattctcagtccaaggccgctctgctgtcaacgatccaattacctgaaacgtttttattatctgcagattttcttaaaattgcctctgcagtgggggattgccagatgtcacccggaacacacaaacagccccactacgggcccctgttctgtagaaagatgcccagtcttgcttctgaaggttgctttttaaaaccagaatgaaggttgctttttaaaaccagaatcatctggattgcattctgtctcttcattaagattagactattctcaggaacaagggctgggagagggctgcatcttttttggtcgataagagcctttcctgttataattgagtcctcgtgctggaatgaatggtcttctctttgcaggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgcgatgcattgttttaaatttaaaatgttttgagaaaaagcagtgatttttagaagggttattaggtcgaatggggttagagaaggagcattccagtttccaacttcttgtttttaagtctttacaatcctgcaccagtagaggagagtcagataggcatccagctaaaaaataatgccatctgcctctcttttttccagtcttgatggttattagtatcaggctgccagtcactcctctaccttcaggcttctggctgctgtagaatgtcgatgagtccaagaggacaccaaaaatgaactctactaatggccgctcaaaaatggccatagtgcgtggcttctgggaccccaggccaaaatggagcttcccatttcctgctttgccttgacttcaagatggctaggcagggaccacgcgacttatccattcaagcaggccgagaacggggagacggtctggcctgtggtctcatcaccatggtgaaggcccaagccacagctggcccaagcaagcaagagacaggacagagcagaggtcagcccaccatgcctttcagtgcagtggccctgcccttggggagagactgtttccgtgggctgtcacccatcaaatcagcagctgcccttcctccctgtggaagagcaaataacacaaagggagagggccgagaaggttccctgttagactctgctgtcctctagggcaaagtggggtccctccctctgtgggaaacagggtaggagattgcgttctccctgcttccacagaacagcgtggtgtgtgggttgacagctgactttattagatggtagctggcttcttgcgaagatgtccacattgacaagtctttggaagccctttcggaagcatgatggacttctccaaggaagggcagtgtcgtctttactagggatgaaagagttgaccgctgctaccttcacctgttcctcttcttagcccatgaaaggcacgcagaacaataggaggaagaaaatgacttaattccaccaaagtgtcatccacatagtgttgacaggttcagagcttatgctacaagtgatccgaagccgggaaaagtgactgggatgtagtatggtttctagtatgtaagtgaggcgtgtccgcgtcgcgggcctgtggggaattaggccagatagacttttgttcatacacatcggtctgttgaggctaatttttcatctgggtagaaccgtgcttacttcacacaagttattcgtggatttgttgtgattgtaaaatcagcctggaaacgaacctttggccttcaaaatctctttagccttggtcccagatgaatgttctagcgccctgtaggtcagggggaagatctccccgaatgcagcctctaacgttccatccacgtttccgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttgggtaagatatcactggaaagtaagaacacatagtttcaaagaagtcagccggtaggagtgggatttgggaaactttttgttttgcctttgttgtttgctactgatcacctgcgtgcgagggaggcttcttggagtcaggtgggtacatcttaacttgaaagaagcgctccgtctgcctccggccactgcctcttaggagctcagcagtagcaagaagctattacatagggttaggattcgaacctgtgctgaagccttataaggggtcacatggagccctcccttcttttccctgcagacacctgtggtgacttgctggtgactctacagtccctgagccgccagggtgagaagcggagcctccagctctccggcaaggtcaacgccatgactttcacctttgacaacgtgctccctggaaaatacaaaagtaagaattggaatgcaacatcctgtggccctcacacacttcttgtctttgtaaactttctaaaactcaggtctcaaattgtatcacgaccatgtacctttccttgttttaagtcgtctttgcctcgtgaccttgactgcattatttagcgttggacaagcatggaggagtccaggccctgagctgaccaccaccttgtctgcacagcccactggcggcttctgttaagggagggtgccccgacgtatggcattttatttctaaagcccagagaaaggagtgtgaaatagttccactgatgtgttctactaacttagcagtactggtgctgagtactggccatggcaaggtacttgacctccctgaaactcagttttcccatctgtaaaatagacataatagaacctttctgcagaatataagactaaaagaagtaaagtttataaagcccgttgtgcagagagccagctaagtagctggtgcccacaaatgttacttcccttttccttgcccttcttaagaagccacttcttgcctgtatttctgctttttcagaaatcagcttggggctgctggcagtggatagctcataaaacagactgctttttctggaattatattaatattttctgttatggcagggcttggcagactacaaaaactgccttttataagcgtagtttccttagaatacagccttgcccatttgtttatggattctctatggctgctcgtgtgtaacagtggccaagtcgagtggttgaggctgacaaagcatgtggcctgcaaaactgaaaagagttacagaaaaagtttgtggatccctgaataccttacttgcagcctgatcttacaggccccattagatttctttcttgatgtaatggaaattggttccagtttttctttctttttttttgaaatttagcctcgctctgtcacccaggccagagtgtggtggcgcgaccttggctcactgcaacctctccgccttctgggtgcaggagattctcttgcctcagcttcccgagtagctgggattacaggcatgcaccaccatgcctggataacttttgtatttttagtagagatggggttttgctatgttggtcagactggtcttgaactcctggcttcaagccatccaactgccgtcagcctcccagagtgctgggattataggcatgagccaccacgctcgactccaggttttctttagcagtaatttattccaaatactgctagttataaatatatgtatgtgtatatttctatctttatgtctacatacacacctgctttttaaaattagttaattcatgatcattgtttctggtggcgtgcagggaggtggtgtgctccacgcccatgtatccgtttttggtgtttgcttttgcagtaagcatcatgcatgaggattggtgctggaagaacaagagcctggaggtggaagtgctggaggatgacgtgtctgcagttgagttcaggcagacgggctacatgctgagatgttccctgtctcacgccatcactctggtatgtacggcttatggagtctcttatttggaaaagcgcttgccttgtggatgtcaagaaagactaacatcccaggaatattgtaaacgtaggcaagtcagatttccttttctgcctctgcactcacccacctgttacgcaacgcataatcaggaagcatttatactctctcagtggaaggacccctgtatttaggaggtttccttgtcctggccctacactaaatctgactggtgattcggggtgacctttggtacagtgtagagcacactggctttatattattagtaataatagctttgggtaaattcatttactgcttctcagcctcagttttcaccgaaaattgagatcttaatacctacttctcagggttatggcagggcttaagtgaaccctcttaggtatcaaagtgtccttggtgtacaccgctctgtactgccaagtgagtttctctgatatatatatatatatatatatatatatatatatatatatatatatttttttttttttttttttttttttttttttgagatggagtcttgctctgttgcccaggctggagtgcagtggtgcaatctcggctcactgaaacctccgcctcccgagttcaagcgattctcctgcttcagccccccgagtagctgggactagaggtgcgtgccgccatgcccagctaatttttttcttttttttttgtatttttgttagagacagagttccaccatgttggccagactggtcttaaaactcctgacctcaggggatccacccgcgttggcctcgcagagtgctaggattacaggcgtgagccattgtgccccaccttctctggtgtatttgttccagtgcaggggaagaagctgtaaacaggatcttagcttcttgttgactgtggtctctgtggcctgaaaggcagtgtgaaatgggtttcaggagcacctctgtagatcccttcgtgaattttctataatgttttgatgtcgagcggcggcagatgtcatcgtcaggtcttagtttctctgtagagaaactagaagaattggaactggtgtttcatgtgccaacttactcccctaactgcttaattacaaaaactcgacaggtcgatttgttataggagatcgattaatatccggttcataataagtgatagatatttaggaaacctttcccttccagcagtggagtggatttccagctctcttgtaataagatccttttttttttttttttttgacacttccttaaccccttctttatctcctcccactgtcccctcactcgccgggccccagccacagtggtcctctgcagtcccacaccaagctcactccctcctcggggcctttgcacatactctcccctctgcctggagtgctgtgacttctccagaaacacgtgttgttggtttttcctcctcattcaggtgcagccctattgttcaggagagatgtgccctgggaccagcgagctaaagacccctcggtggggattgttcttctcttgctttcctgtttattttcacagcttcgttactgaccagttgagatcactaatttatttgttgttgcgttgattttgtcttcctgtattagaacataagccctgtgagagcaggagccatggtcatgactcccaaggcccagccttgtgtctgtcacatagcaggtgctcaataaatattagttgattgaatgaaaaatagcacacttttgttggaagttttgggaggtttttaattttactgtggcacccaactgctccaatgattaatgggcaaaacagatgactggtttggaaagagaaatattattaatcatcttggtgtctccatctctcttagtaagtcattgtattggctttgctcccttaggaattttatcaggatggaaatgggcgtgagaatgtggggatttataacctctccaaaggagtcaaccgattctgcctgtccaagcctggtaagtttggaaggattgatgtgccatgaattagaaaaatggaaaggcaccagaggatggttttgaaggcatttttttctaccttggttctgtttgcatcaagctttcaatttctgtgtgttcaacctgctcttgtttttctgtctgtcttgggtttgagttgggtagacaccactgggccctttcacctccaaaaatataccattggccaatggcctctctttatagtgctgttttaaaatttgaatcatttcccactttgcttaaaatctttcagtggcttctcactctttctcattttttttttctctttctttttttgagatggagtcttgctctgtcacccaggctggagtgtagtggctcgatcttggctcactgcagcctccgcctcctgggttcaggcgattcccctgcctcagcctctcgagtagctgggattacaggtgcccaccaccacatccggctaatttttgtatttttagtagggatgggtttcaccacattgtccaggctggtctcaaactcctgacctaaagtgatccgcccgcctcagcctcccaaagtgctgggattacaggtgtgagctgctgcacccaaccctctctctcttttataatggctttttttggaggcagaatttgcatatcataaaactcacctatttaagatgtacaataaaatgatttgtagtaaatttatcaagttgcacaaccatggccagaatccagttttagatttgttcatcacccacaatgtaagatcctctgtgcccgttgacagttaatccctgtttctagccatggccagccactgatctattttctgtccccatggattggctttttttggacgtttatcatacgatgctggtattttgtttggcttcttttatttaacatgtttttgaagtttatctgtgtcatggcacatatcagtagtttgttctgttacattgctgtgtagtattctggtgtgtggttatatcatattttgtgtatccatttatcagttggtggatatttgagtggtttccagtttgacgctgttatgactaatgttacggacattcttatacaagtctttgtgtccgtatgttttcgtttttcttgtttcgatacctaggaatggaattgctgcattgtgtgataagtttatgtttaaccttttaagaaactgtcaaattgttttccacagaggctgtgtcatttgatattcccaccagcaatgcacgagggttccggtttcttcacctccttcgccaacatttgttattgtctgttttattatagtcatcttggtagatgtgaagtcgtgtctcattgtggttttgttttgcattttcctaatgaataattcagtggctcctccgtttggttcccaagataaaatacaaactccttaacctgatcttagctcctgtgtaacccagccctgtctgccactgtctctactccagccactctgtccttctgggtgtcagttcagctgcctttggctacatgtaacaaaatccatacagcagtgccattggcaagtggtagtttatttggctcaataaagaagtgtggcagtgcgtggctgccagcatgggttcagcagctggtagatgttaggggtggtgtctttgtgattctttaggcctttcccttctattttttgccttgtattttcaagatggctgtggttagaaaacttatgtttaaaggaggaagtcaaggagagggcaggcaaacatttccttgcgccccctcctccagtaagctacttgtctgtattattggccagaaccgtgccacatggttacttctagctgcaagggaggctgggacagttggatgtgctacccgaggctgagcacgttgccaccctcaacataaccagggtttgttctcaaggcaggaaggatgcctgttgaggaaacaatgagccagcctgtgaggcagatgctgttctctgtggacatctcctcctgcccctcctagctggggccttcttacccatcagttcagtattgcttcctggggaaggatggcctccagggccacttaggcctgcctcctacactcttgctctcagcactcacttctatccccttcttgcatgtgccacaattgatatgtttgtggctgtcaaatgctccccctctctgtggatggtaaactccatgaagacagggaccactgctctgtcattccccactgtgtaccagtacctagcataatacctggccaggaagagatgctctgtcgatatttgttgaatgaaagaccaaacaaaacaaacagagaaacctgatttttttttttttttttttttgatggtaactactctggggcttgttgagtgcaatgaaaacagcagggtggttttagctaatttcaggtttttgtaggaagtgtggccaaaatactggttaatgatgatttgggggaaatacattgttattccttgtatcttcctgaaattgactgtgttcctctggcaagtgatgaaatgtacccctactcggagtgtcctcccacacagactcacacttttctggggcttcccttactccttacctcctttttaggaatatttataggaagaaattgaggctgtggttatctcttggatccttaatagaatcttttaagtaggaaattatcctcagtccaatttgcagtagaaacgtactttctgttccttctcgtgcatgggtccgttcacctggtctgtgcagatttaactactgggagttgttaccttatggaaaatgaaaatcatgcgcctgtgatcgggccattgcatggatcgggtcattggtaagacgccttcataggcagtgaaaacgatgcctgcccagtatttctgatcccattattgcagatctgcgatacatttgagttttcacatgcaaagagctgccactcgatttcagatgtcggaattgctcagtgtaatagatgccattctctgaaaattacttttgatttcctgtctgtaggtgtgtacaaagtgacccctcgctcctgccaccggtttgagcaagcgttctacacctatgacacgtaagcctgggaattgaatgctttgtggtgtttgtatacattccgtggaggattcttcatttacttcagagaacaaaaggagtttttctgttttttttctgaaagaggcaaggttaggccttcaacagcatttctagataaggattttaagacacttggattagttactgaggaaccggagacaggatccctttcccaagaattctgtaaccccaggatagagggctgtgtttttgaagtgccttaaatagaagctttgtcaaatctcccagccctcaccgatgggcatctgtcaagttcaagtctgccatttttgtatttttacagatgtgtgtgggtttcactgggaattggaagcataaagttgtggagtggagaattagtttactctttaaaatacttctctggatctccagagttattttaccccagactaaaagcaattttctgtagtatatttagggtgaagaaggatgcccaaaaagggtattgctgatgatcttctgagaatgagtaggttctagcgtttcctctgctttgatttgtaggtcttcacctagtatcttgacattgacagccattcgccaccatgtccttggaactatcaccaccgacaaaatgatggatgtcactgtgactatcaagtaagatgagcgttctgcagtgggccgagagtggcgggagagggtgtggatgaggcctggggagtctctaataggctctctggaaattagttttgatttcttatctctagatgtatatacaaatggccttccctctcttataggacattgccgtcaattcccagcagccttgatcctttccttttctgattcagaaattacctgtgggtgaggaagagcgttgcgacagcttgtttcagtgtcttcaatttctgtttgaactctttgtacttctcatctttgctaaggaaaaaaaaaatctctggggtttgtgcattgtatttcaagtgttttagcaaattcaaattgcctatttttctttagacttttgcttgaaggcttgggaaatagagatggcacctggtataagagaagggtcgtgagagaggaagtatttgaaaggcaagtccctcaccgaaggtcacgttcatgtgaatgtcacctttcagggaatttttgcagtgtggtgaggtacctgtgacgccccaattttcttgagaaatgaaagagttttggcaacatgaccgtctctgtcaagtagaatgggcatcgcagtccctgtctccctcctgcccctggttgaagtcacctttccagctatgtttccatctttctgtccaccatctgtttatccatccgtcatccctgcagagtacatgatgactgaaaaactgagagtcttcagtgtttaggcactgggcttatgaggccacagcccctacacttatgggattgacagtctcatggggggaacagtggtcagatactcacatgcagaaccgtaaaatgacaactgttctgagtgctttgagcttgaccttgggggcatgcaggacaggtaggctgcggggggccaggccatgttaaggtccatagtctttgtcccatgatgcaattgacatgttttacatagaggaatgacatttttcttcctgaaggtccccctattggccgagtggagaacagacagaagaggcctgagagtgggaggtggtggaggcagggggaggcaatgggggccccagactagtggctgcggagatggagagcgacggactggtcggagagtcgttgagggactgagttgatgagacatggcactaaagtgaccactgggttagggcgggagaaatgtcagggctggccctggtttctggtgatggggagccaggtttttagctgggggtggatttgccgaaggtctgttgctgtcttttactatcatttactgtctccctgcttggaaagtatgaattactgataggactagcaatctaccttcttaccagtagtaactgcatattacctcctttcagcttgattacattcatttttgtaacttcacaagggtgtttgtgttgcttgcttgtgccggaggttgtatggaatgcatcttccagctagacagagccactcggattccccctgggaatcgtgtactcagcagacccaaaacccgactgctgacagttgccctccatgagcccctctgtggtcttttctgattcagatatggcagctcccgctttctccttgtttcttgattcttatttcccttgaaccctaggcccagccaattccccaacaaagccttggctttacaatcaaaatacacccgtcatctagtccctttttaccacttggccctcagccttggtctgacccccctctggggtcactgcagcagcttcccagctggccttcccttcttaccacgtggccctcagccctggtctgaccccctccgggatcactgcagcagcttcccagctgggctttgcttcttaccacgtggccctcagccctagtctgaccccctctgggatcattgcagcagcttcccagctggccttcccttctcaccacgtggccctcagccctggtctgacccccctctgggatcactgcagcagcttctcagctggccttcctgtttccgccattgctttgtgtattttccatgaaggagcaaacgatttcttttatcataccattcctcgactgaaaactccagtggctccaggtcggcaccaagcctgtgaagcctcagtctgacatctgctgccccttggacctctctgttggatatgactcttccgtgggcccctgtgccccaggctggactggtgttgccattgcttgaacatctgagtgagctttctctccaaggactttgcacttggcatcgctttgcccaagctactgtttacccagagagctgcgtggcgcattctctcccttccttcagacctttgctcaatgtcaccttatcagaaaggccttgactgtccctttaatgtaaaacagtgctccgggctctccgtcttcccacactgctttatttttctttattgcacttttcctctggtattatttttctctttattttcagccccttcccactgaaacgtggattccacaggggtaggaagtgtggtctgttttgttgatgctgtatccttggtgcctagttctctatcagagcagttctcagcgaaggtagaatggagaacagaggatggtggtgtggagaaaactccgtgtcctacatggaagctacaagcttatatccagtcgccataaaatcaaccgtatttcattccagcccagatctaccagatactgccaccatcactgcgaagctcagttgttattttttgtgaaactactagtttatttaaaacagaagactccgccactgtggtgtcatgataagatgtccagtttgtaactcgcaagtccatactcgtagaaaggtcaaattcccactgaccacaaggatacgcaaccacgtcctaggggccgccatttctttcttctaggtcttccatcgacagtgaacccgccttggtcttaggccctctgaagtctgtgcaggagctgcggagggagcagcagctggctgagatcgaggcccgcaggcaggagagggagaaaaacggcaaagaggaaggcgaagaaagaatgaccaagcctcccgtgcaggagatggtagatgagttacaaggccccttctcgtatgatttctcttactgggcgcggtaagctctcttgtgcgtttccctacagtgtcctctgttttgtggggacaggacccgccaaactgaagtatattaattattttaggtctggagagaaaatcactgttacaccgtcatctaaagagctgctcttttatcccccttcaatggaagccgttgtcagtggaggtaaatgtcaactcagcgagtgaatgtcacacacacctttgcagttgttcccttgcctgcatttacaagtagatttgtgatgttatagtgaagccatctttgtaagccaccttacatcctctctggcacacagatgttactgttggttggatggatggatggatggatggatggatggttgggttgggtggatggatggatggatggatggatggatggatggatgaatgatttagataaataaaagtaacttttgctgttagaattgagttgatctttttggaaaaggacttggttttctttgacattatcaggtcgacaccagaaggtagatgaagcacaaagctgccagtgatgatctttaatgatctttctgttgtttggcagagcatgatgggagggtctttttttggggaatggatgactgaagtgatcacttgtggagtatttgtcttttgccacttattatttttttcccagcactctggcttcgttaagttgtgggtgttatgtggttcgtgtttggaagcagagggtgttgaagagcgtgacttctagcaggcaggctgtttggggcagtctttctcagtgggtcctccagaggctgagcagcacggcctcctgtctgctgtaaagtgttccctcctgatctgtggcctcctgagaacctaggaagagtagtagtaaaaacccagccttcagcgttttttgattctcttgctaaagtccttcacactgagaaaggcctttcagggatggaaagaggcttgggctgtatccgattattgagctccccggggtgttaaataaccgcatttggaactagcttctaagatctgttttagccacttttgtcatgggaaacccccaaccaagaagctcctgtctctgctaccaagccccatccttgtgtttatttcttcccctcttagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacaggtgagcccgggatagagacacatttgcctgggatcagcgtgggagtcctctgaagaaactggggcccacatttccttgggcttggtaaggcttcctgcagggtgtgaacaaagccgttgctagcattctgctctctcctcttcagtgttggccccctgcacagtgacctggagtacacggtgacctcacagaaggagggctatgttctgactgcggtggaaggaaccatcggagacttcaaggcctatgccctggcaggcgtaagctttgaggtaactaacactgtattttcaaaaggcagttatactgaggtataattaacatataataaactgcacaaaaagggtacagtgtggtagtcttgacctaggaatacacccatgaaaacacctccacaattaaaatagcacatctgtggccctcaaggtttcctcctgccccttggtaatccctccctgccacccttccgctgagctgatgatctgcttttcatcaccattggttagtttgcattttcgagtttttataggttggtgcaaaagtgattgtggtttttgccattgagaataatggcagaaaccgcaatcacttttgcaccaacctgtatataaatggaatcaaacgggatatactgttgttttttttttttttttggtctgacttctttcacgtagcataatttggagagctgttgactttagcatgtttgtgtaccttctgggaagtagttaaagctgtcatccataactgttccattttgaaggacacagaatgttcttactgaggcgtttgctgcctagctcccttccaccggtcctttctgggaagaagcgtgctgcgattgtacagagtgggtctggagattgttgagaatgaatatttataaactataggccaaaggaaaagagtgacagattacatcgcataaaaatttaaaattctatattgctgaatacatttggaaccaaactgaaagatattcaaactcggaagaaatgtttgtatcataaataatatccccattttacaaggagctcctaaaattggtaagaaaaagacaacccgctagaaaaaaaatgaacaaagattatgaaaaggaaattcatgcaagtaacacagtgactaataaacacagaaacacaaagcctctgtagttactgaggaaatgtgctaaggaagttacagtcgaaacactgttttgcagggattagatttgctgtaattaagacaatctttattttttggtaagtgtgggttttcccaagcataaataatttatgggactgtaagtggttacagccactttggaatgcaattagatagtatctttctgaatttaaagtgcatgtatccaacaattctacttctaggaatggattgttcaggaaataaaaataaaactaagtgcctagagatacatatttggggatattccaattgtctcttgtgtaccacaagagtaggtgctgtggtttgtcaaaccctgccttagaatgctatgcagtagttaagaaacaggcagatttctattggctggcagaagagaaccaggataaattgttgaggaagagagcaagttgcagaactgtacatataacatgccatttttatttcacctcctccacccactcaatgaacttgccagtctgtgaacaataatatgtaatgtttataaaatttgtgtgggcatagaaagagttctgggtggggcacggtggctcatgcctctaatcccagcactttgggaggcccaggcatgtggattgcttgagcccagtagtttgagatcagcctgggcaacgtggcaagacccgtctctataaaaaatacagaaatgtagttgggcatggtggtgtgcgcctatagtcccatctcctcaggaggttaaagctgaaggattgcttgagcttgggaggcgaaggttgtagtgagcccaggttgtgccactgcactccagcctgggtgacagagcaagaccctgtctcaaaaaaaaaaaaaaaaaaaaaaagttctagaaggctacacaccaaacttacaaaacttacaacagtagttacctgtggggaggaagattaggtcccctgtcctcctttgagtaacaataaaagaaaaaaaccttgaaaaaatgacctcttgacttgtggaactgttattttcatagttagtaggagtttaaccttgctctggtctcaccttctcatccccagataaaagctgaggatgaccagcccctcccgggagtcctcttatccctgagcggtggcctgtttcgttccaacctcttgacccaggacaacggaattctgacattctcaaacctggtgacgtgttctgcaatttaccacctgcctgtcttccctgagagagagccaggatgcagcatgcgagacttacgtgttgcttgacaacgtgagaagagaaggccaatgtggagtggtttcagtttcttgggggcccacggtcattagagtattgctcttactcgaacttaatgctgctgattcatgttcccttccacacgcacttcttgttttctgatcacccgcttgtcactaagacagtgtaattaatttccctggccacaacggctgctctcttaggcgtcttcttgttttgccacggaatcatgcttatgatgctgagtcttgtttggtggttagcttgcgtttcttctgaaaagacattccacttggtgggaagagagcagcagtttttctttcaagatgcagtcggaggccctgactggtggggattcaggaagtgtgtgttagttggtcatcttgtcagtcatggtgacaaagtggctgtggtggggctactggagaccgggcagcaggggcatctgaagacaccactttgcagtgatgcagactgctccttacttgctgtgtcctatcaggcaagttactttgcctctctgagcctcagtttctttattcattaaattcaaatatgagccaggtatggtggcccacgcctgtaatcccaccgctttgggagggtgaggcagtaggatcgcttgagcttgggagtttgagaccagcaacataggaagaccccatctctacaaaaaataaaaaaattagctgggcatggtggtgcatgcctgtggtcccaggtactcaggaggccgaggtgggagatttgcttgagcccagaaggttgagactacggtgtgctgtgatcgtgcactccatcctgggggacagagtcaggccctgtctcagaaaaaaaaaaaaaaaagaaaagaaaaattaaatatgacttctacctctctgagtcattgcaggcaggtgataccatcagctgccgttgttagagttgtgattgccattacctgactgtgagtggtgattatagagagagggttactatttctggctgccagggaagccatggcgctcccctggtgtaattctggtccatcgtgacattcgcccctcacttttaagccatgcctagatgtggctgctgaggctcagtgtgattatcttggcagagccctggccagtattacttcaaacccatgatgaaggagttccggtttgagccatcctcacagatgatcgaggtgcaggaaggccagaacctgaagatcaccatcacggggtaccgaaccgcttacaggtaagtgccctggccaccccactctcttccagggctgggctggtgaatcacattcaggcctctgttgcctggaaacgcatcccaggcttcacactgattttacttgggagggaagggagatgagatatgagggcaaaggagttttgactgctgcccttctctcctaggagctcaacctggtggttcagtctcaaatttcctattttggaattggcttgagagagccttttgagttgctaaaagcttttatttattttttattttttgagacggagtttcattcttcttgcccaggctggagtacaatggcgcagccttggctcactgcaacctctgcctcccgggttccagcaattctcttgtcctggcctcccaagtagctgggactgccaccatgcatggctaatttttctatttttagtagagacaagatttcactttgttggccaggttggtctcggactcctgatctcagatgatctgcctgcctcggtctcccaaagtgttgggattacaggcgtgagccactgcgcctggccacttttattttttaaaagagtttcaaacctgaattaaattattaaaaggagaaaatgtgctcagttgaataaaacttcaaaatgctgaaaagagtatagtgtaaaatttcccctctgtctcgtctcctagccacccaagttcctcttctgggagacaaccagtacttccagtttttctgaatgctcccagctgtagatagatagatacacatgagtgtctggcaaggcacagtggctcacacctataatcccagcacttttggaggctgaagtgggaagttctcttgagtctggaagttcaagaccagcctaggcaacatagcaagaccccgtctctacaaaaaaataaaaatacaaaataaaaaagatacacatctatagatagagagatgcatacatatatacatgtatacacacagatacacacatatgtgtattttttgtagacttatacagaatcactttagaggaagagtaattggaaagattgggtttagaaaaatggaccattttctactgaatatatggagtgaaagaggaagtgagttatttccatgttattgaaagctccattatttcaaataaagcctagaaagaataaaataaagctttagccttcttaaattacaattttccagagcatccctcaaaatgtatgagaaaagaaattgatggcagcttatccctccggcaggaaggtgtggtttgaaagtgggccggccacaccgagttgcctgggtcattgaggcacagttctcccctgaactattttgccccataattgttggtaaacgggaaacacttgggtccttcagataaccatgagaatatctcattcgtgcctgttcttgccatactagttgctatggcacagtgtcttccttaaacggagagcccgaacaaggggttgccatggaagcggtgggccagaacgactgcagcatttacggagaagacaccgtgacagacgaagagggcaagttcagattacgtggattgctggtgagacttggaatgtgttttctttggggacttttttttcatcctgtgtccagaagtatcttgtggtggccccaagactgctaggagtgggttgggcgagagggctgggggtggggctctggagccctcccagttcttacctttaattggtagagtttgccttttttctagccaacaggtcagatcaaggatctgtggcacaatggagttggaaaaccatgggtttggtagggcttttccctagcagtatgtggccatggcttacgccagggctcaagccaaacgcctatggagccagaagagcagtatgaacgggggagaggaggctgtgcgaaatgatagggagtggtgagggctgtggagtgggcacggcctgtggaaagggacagcctgtcacttggttccagcttattgtagccatgggagaagacagagtcagggttgccagatccttgaaattttaaaaagagaagtcagaaattcccacttcccagaaataatacccaacacaagcatttgggaatgcttatggtggacattccagatatccatcaatgtgtatatacgggtagaggggaggggtggatggagaggaaaaacatcttagaagagtaagagcacatagtatgcttggaattttgaaataagaaaccaaatttgatttattttggggtaggagaaaatgaaactgagttgggatggaaggagtcgcaaaatttcagatgtttcaacactaggggtgttcttaaaggaactctggactcttaaggttaacaggccacagattaggaaatgaggggagagaaatgctcctgtcttaatgatctcgtgcagccaaaccaggcttggaccaggcacgatacgacaagccccctttctagagaactgactcctgagtttttttgcagccgggatgtgtgtaccacgttcagctcaaggcagaaggcaacgaccacattgagcgggcgctcccccaccatagggtgattgaggtaaggcattcagtgctgccgctgcacctgggtgtgggtgcctccctaatcagaagtcctcccgtctcctctggctgtctgcctttcatctgtggcggggggaactttcatcctaattaagggtcctcttagaatagtgtcatcttcacaagcagaatcttatgtgggtttttagtgaacagcgttgctgtcatgcatccagaaaggaaattggaactgttgtatcctccccgcgacttgccctgtaagctctgatcattattctgcaagttaaggaacttaaggcctaagcagcatttcaaatcaagggacaataatagaacatgggcttaatgggtggcagggccacgcagttatcttaggttcagatgacctttttcctgctcccattttgtgggcagagtcttttgatactcaagatcatgacctagctaaattaatccctaaagaggacatccttcgagtcacagaatgtggcctgggaatcatttgaagtaaggcttttctcttactgagtaactctcattgggaagactagagggcttaggtagggcaagaggggctgcctcttagtggctttatttaggtggcttcattatgcatgaagattgtgagggaggatagaacttttgacctaggaagtggattttcttttttttttctttttttttttttttgagacggagtctcaccctgtcacgcaggatggagtgcagtgccgtgatctcggctcactgcaacctcctccttgtgggttcaagtgattttcccacctcagcctgtagctgggactacaggcacacaccatcacacccgactaatttttgtatttttagtagagacggggtttcaccatgttggccagattggtcttgaactcctgacctcaggtgatctgctcgcttcggcctcccaaagtgctgggattacaggcatgagccaccgcaccgggccggaagtggatttccttgacgtctttacggtgttggcattttaaatggctgggatgactgcatctcacaccaaaatgctttgcatgttctcggtgtagtaacttaggccaggatcactagcataatgtggactgtggccgggcaggtatgaaagggaagggggccggccctctgggatctcgcaaactccatgtacagacctcacgcagagggggtgctgtgactctgcccctgctctaacaggcaagagcatccttctcctctttttttttaagagaagctggaaaatctggcttcatatatgaaatttcttaatttttaacatgttggcaagtaattcaaacgtagaaaaaaaatactgtgctttcgaaatgaaatgtgtctatgggccagggatatgcccctgctctaacaggcaagagcatccttctcctttttttttaagagaagctggaaaatctggcttcatatatgaaatttcctaatttttaacatgttggcaagtaattcaaacgtagaaaaaaaatactgtgcttttgaaatgaaatgtgtctatgggccagggatagccatcttctgtcagtttgtgaccttggacgtagggtactcaatgacaaacttcgcttccttaatgtaagaagcaaagtttgccatgaagcagctctcaggccatcggacagctggcatagaagttcctccaccagctttctcatcactggcattccctctttctctctctaggttgggaataatgacatcgatgatgtaaacatcatagttttccggcagattaatcaatttgatttaagtggaaatgtgatcacttcctctgaataccttcctacgttatgggtaagtccagacttttaagctccaagtattgtgttccctttggctttgagacaagtacgaatgggatgtttttggttttgtgcctgtctcgtgccttaggtgtgacaggtggaggtgctccagagtgccgcctgctgagggttgaggttgagatttaagaaccttggaccacaacacgtatttgggagagtgattgccagttgtgggagagaatgtggtccagtttcagataactgtctgccatcagttaatcttccaaagaattatagtagaagcctgatcaatgatcaatacaatatggaatctaacgtggaaagccaattctaaagaaagcgccttgtaacttaaaattttctctggagtggaggtcgtattaaacgttcttgcattggtttaaagaaatgcctgaggctagataatttataacaaaagaggtttcattggctcctcgttctgtaggttgtacaggaagcatagtggcgtctgcttctggggaggcctcaggaggcttccaatcatggcagaaggtgaagtgggagcaggcatgtcatgtgggagaagctggagcaaaagagagagttggggcatggtgccacacacttttaaatgatcagatctcacaagactcataacgaagacagcaccaagccatgagggatccaccccaaagatccgatcatctcccaccaggccctacctccggcacgggggattacaattcaacatgagatttgggcagggacaaatatccaaacagtatcagaggtggtggacggtgggctggagagcaggtggtctgggctttctcttgtctccagtagtgactcaccttgctgcctgggtcagtcacttcatttccacatgcctcaacttcgtcctctgcaaaacctagattttggactcagagacctcttataatcttgttcagctctaacaaaatctccatgttaccattaatgaagaaatgtttataaaataccctgcagaccctctgcggatgttagtgatttgctctgggggtacattgttaagatgcacttgtaattttataagcagttaagtatttggcatgggtgagaaagtgtgtgtgcgctttagtccactctgtccagggcttgcaggcgtgtgcttgtagggaccaggcaggtaatgtcagagagtgcagagggttgggtagggtggggggcaaactggggaactcctgccccatccatgaggggcacaagggaggggaagaggcagagaggaggggagggcgccactctcttgctcctgagtgttgctgtgctagaattgaggctcagggttggtgtcacttcccagttttccggagaagctggaaattagaattatttgaaatcacctgatttttaaatatagtcggtgaattcagatttacttaagatgttatagaagaaaaaagaacacataagggatcttcaatgcgacccataaccttcagtctgtgactttcattttaggaaaattccccttgtgtgttatgtagaaaggtgccagtgtgggcccagggaggtggtcctggcattctcttgcggcaggtgcactgtggcatcctcacagcctttgccatcagccagggctgcaccttaaccctgctcatgccccatcccgtgtgggagtgagaacaggcaagaaccccagaaataaagccagaaacaaagtactccagtgcctcctgaagcagcgtggagagccacgtacatgatggaatgcgttttgagtttaacagattggtggagttaaggtgacatcatatgatgaggcagtgcaaggcgggaaggaccctcaggagtcgtcagggggttgagtcccaggctctaccatgtgtaagttgtgtgaccttaggtgactttggctctctgggtctccatagggataataacaatacctgttttgtagtcaggattggcgataatgtagataaaatatctggcgcctgcctggcatattacagatgttcaacacgtgttagaagctatttttaatattactattatattaacttatattactattttgagcaagaacatgggtagtcagaatctgatttgaatcttaatttctgtgcatgatacataactggatggagtctcagatgacagagggatgtgtgatgtctatggagggagctttctttttcaaatatccatgtttccaaagacacccacccagagagcggctgtcctgaggatgtctgctatgaaatattgattgtgtttcagtttcaaagcatgtctgactttgtttctccctccaggtcaagctttacaaaagcgaaaacctcgacaatccaatccagacagtttcccttggccagtccctgttcttccatttccccccactgctcagagatggcgaggtaatgcctgtggccggattctaccttctgcctttgttttaataattctgctgtttagtttaaggaagcacagttctctccttttctccctaaataccactctgcagaaatgcgctctctgaatcaaaagaggttgggttctgtagggattattttttcttcattgtttttctgtttacaaaaagaatacatattcatggcaggagattttgggaaaaagaagacataagcccatcatccagaaatagccactgctaacacggtgattggtatcctttgggtcttttttcaggcacgtgtgcgcatgcatgtataaatataaatagacatttattttaataattcaaaactgacactgttttgtacattgttttgtaatccatgcttttcaatgaagaatttatcacaaatctgttcctcatcatcaaatctttctttttttttttttttttgagacggagtctcgccttgtcgcccaggctggagtgcagtggcgcaatctgggctcactgcaagctccgcctcctgggttcacaccattctcctgcctcagcctccgaagtagctgggactacaggcgtgcgccaccacacccggctaattttttttttttgtatttttagtagagacggggtttcaccatgttagccaggatggtcttgatctcctgacctcgtgatccacctgcctcggcctcccaaagtgctgagattacaggcgtgagcccccgtgcctggccaaatctttcatactatgatttttatggacagtagtccataaactaggaaacgccatgatttatttaaccaaggcctactgttgggcatgatcgactcttgcactttgaacatatcaccccatgctttcctgctaagaagtccacttttaaaaatgccttgtaatttttaaaaattcctctattttaacattccgctattgagtttagggaaatacagtttcctcatgatgggggatcccttgaatgagatgagttgcttttctcttgctgctttgaacgttctctctgtctttgataatctgattataacgtgtgtcgtgtagaacacttgcagctccaccttttcagtgtcctttgggttccatgaatctggatgtctccctccttggaactgggaagttttcagccattattctggccgtcatttactgattataaagtgcttattatcaattctatttggacagagctaacttgtagttggtgtggggagtgcaaactttgcaaagaatttggttcttttctggtggtcttagcctgaggatgtcaagtgtgagcctagagggtgacgtttcctctcctggctccttaccacctgccgtgaagatgatctactctggcctttctctgtggaaaatggctgcgaaataatgaaacaggctgtcacggaattttctcctcctctttctccaggggtgttgaaatagtcacttcctacagcgatggggaaacatcttgggctttggggtcacacttcccctgagttcagagccttcatagatgtgtggcagccttcttagctgagtgaccttgggcaagttactcttagtctcttcgtgtttgactttcctcgtctataagacggggtgatgatcccgaccttgccagtggtagaaagcaaagcagccgcgggcctcatgcaatgtgcatggtgcctggcagctggtcggtgctcagcacacagagctgtgacgggcctcatgcaatgtgcatggtgcctggcagctggtcggtgctcagcacacagagctgtggctgcccctggtgccgttccagggatgctgtatttttaggatttgccagcttacgagcctctcaagcatcgtcccttagaagtcagccccgttgtggatcctcagttgtatcacgtacctcccttatcagaattggctcataataattttttgtgtttcataaagtcagatcctcagaggaccgtaattgtcaaggttgggtactcataaaaaggctgcaggctctgacagccttatcagaagccacagtctcagagacactggggacacatgcccgccactgatggaatagcccgctgaggttgatactttgaaggcagcaaccttggtttggatgtgtagtcttggggatttctttaaaaacataaagttctttacatcacagccatacgttaggttttagttttcatttgctttgccagagctgtccttataaaaataacttcttcccatgtgtgcacagaactatgttgtgcttctggactccacactccccagatcccagtatgactacatcttgcctcaagtttctttcaccgcagtgggctaccataaacacttcaccttgatttttaatcccacggtaagtaaaagagggagttaaaaaaaaatccatgggctgggtttggtggctcacgcctgtaatcccagcactttgggaggccaaggctggtggatctcttgagcccgggagtttcagaccagcctaggcaatacggtaaaaccccaactctacaaaaaatacaaaaattaaccgggcgtggtggaacgcacctatagtcccggctactcgggaggctgaggtgggaggatcacttgagcctgggaggttgaggcctcgatgagccatgatcatgcccctgcactccagcttgggtaacagagtgagaccctttctccagaagaaaaacaaaacaaaacaaaacaaaacaaaacaaaacaatccatggggtggcgaaagaaggcatgtccatacaacctgtgctccaggtcgcaggttgcagggcagatatttaaagggctcctggcattgggtcactttctcattctgccttctggattctgggcttccccagattgtttttagcttttctgagcactgatgcctgcgattccctttgaggaggaaactggtaataagagcagtgtaattgtttagatcggtggctcaggaatgattttgggggaggagggacaccactatcgctggtgtggcgtgtgcttctccatgagggagcacatggtacatggccacgcaaacccctagaaccaactgctactttacaggaaatagggaggacccaggagcacgcaaatgactccacagggatgcaggacaaccacctggagcctgatttgtttgacaaataaattgcaaggaaaaaaaaaccaacaacagatggacagaatacctgtgggttaaaagaaacttaacttatcgcttaattcattgcaatatgtggcccttactatttgcaatatgtgtatctgttgcatacggtctgtcctgtatccgataggctggaacagtggaacaaacaaaacatacacgtatcttttaccttcttgataaaattgtttagtgattcctaaagctcagatgcagtattgtcacctgatgattaaacagacacatcagcaatagcaaaaacagagtccagggctcagcctcaggactgctgattctgaacttgacggggtgaaagtgtagcacaggagtctgcattaaaaacaaaaatctggcctcatagctactgtgttggttcttgcttctaggccttttcagtgggcagaataagaactttattgttttcaaaaaatgtaactgtaagtggaacaatatcttccgatcctcctttttccttttttgataacgacacagcattcctctgtgtggatataccgtgtgtcttaggccatttgggctgctattttgtatcttagactgggtaacttataaacaacaaacatttatttcttacagtactagaggctgggaagtccaagatcaaggcattggcagatttggggtctggcgaggacttgctgtctgcttcatagatggtgccacctagctgtgtccccacaaggcggaaaggggcaaacaagttccctcaggccactcttacggggcattaatccctgacttaatcacctcctaaaaagggtgtcctcttgacactatcacattatggattagggttcaacctatgaattatgtaggcacagacacattcagatcctggcactacatgtaggatattcagttagcccctggttgaggggcgtttgtgttgttactggttttctgctattacacataaccctttaatgaattgccttacgcatgcatgtttttgagtgttcgtcagtctctctttggaatagactcccagaagtggaattgctgagtcaaagggtaaatgcatatggaattttgattgatacggccacttcccatccatgggggttttactgttttatattcccgccagcagtgaatgagtacccttttttccccaacagagtattttgtcaaatttttcaatttttgcaggcttatagatgagaagtgatattatctcagtgtacttctaattgcatttctctcttttcatgtggttaagagccatttgtatttgctgtgaactatttaacctatttttctatagaatttttggtctttttcaaccattttcagctctttgtatactaggaatattaaccctttgtaatgtttgttgtacatatttttcccaatttgtcatttatcttttcacttggtttctgcaaagatttactttatttctgtgttaaatgtgttgattttttcttattgcttctggattttagagtcataggaaggttttcttcattcccagcttttacaggaatttatcgtgtttttttcaggcagacttttatagtttctgtttttacatttaaatctctctatccatttggagtttttcctggtatagatgtgaagtatggctccagattgtctttttccacatgctatccagttaccatttcatgcttttcaaacgccatcctgcatggaaggtggacaggaattacctttcatttagagatgagaagatgggaacctagaaggagatgtgagcagcccaaggtcaccagctcacgtggagcagtgctagggcttgagcagagctctgctgctgattctgggcttctgtgaagagtgattcatgctcagtgagcctgtaaatatgatcttacctgaacaagagagtttttctcatgacccacgaggaaacacttccttgttactcacagtagagacctggttagaaagtgctggagagggctaggtgtggtggctcacgcctgtaatcccagcattttaggaggctgaggtgggcagatcatttgaggtcaggagttcgagaccagcctgggcaatgtggtgaaagtgaaaacccatctctgctaacaatacaaacattagccaggcgtggtagcacgcacctgtaatcccagctactcgagaggctgtggcaggagaattgtgaacctgggatgcagagtttgtagtgagctaagatagccccagtgcactccagcctgggcgacagagcaagactgtctcaaaaaaaaaaaaaaaaaagaaagtgccagaaagataagcatatacaagaaccacttacctttgcttggggctgcattgtggcccagttgctgggagaggcttctgtgaaggccgttgatagctgcaggcagtgacattctcaggggcccctagcagacaactcatccgggctcagggacacacctgggagccagtggcaggaatgtggagacactgcttggtggtggccgagcagcccagcctcgtagctgctgcctgtcacttctgagaatgtaagaaactgtgccctggtgtgtgatgttccccttcctgtatacctatgtaaccaacctgcacattgtgcacatatatcctaaaacttaaagtataattaaaaaaaaaaaaaaaa

SEQ ID NO: 8157 - DNA, 2646 bp, Homo sapiens
gtttgacaaataaattgcaaggaaaaaaaaaccaacaacagatggacagaatacctgtgggttaaaagaaacttaacttatcgcttaattcattgcaatatgtggcccttactatttgcaatatgtgtatctgttgcatacggtctgtcctgtatccgataggctggaacagtggaacaaacaaaacatacacgtatcttttaccttcttgataaaattgtttagtgattcctaaagctcagatgcagtattgtcacctgatgattaaacagacacatcagcaatagcaaaaacagagtccagggctcagcctcaggactgctgattctgaacttgacggggtgaaagtgtagcacaggagtctgcattaaaaacaaaaatctggcctcatagctactgtgttggttgttgcttctaggccttttcagtgggcagaataagaactttattgttttcaaaagatgtaactgtaagtggaacaatatcctccgatcctcctttttccttttttgataacgacacagcattcctctgtgtggatataccgtgtgtcttaggccatttgggctgctattttgtatcttagactgggtaacttataaacaacaaacatttatttcttacagtactagaggctgggaagtccaagatcaaggcattggcagatttggggtctggcgaggacttgctgtctgcttcatagatggtgccacctagctgtgtccccacaaggcggaaaggggcaaacaagttccctcaggccactcttacggggcattaatccctgacttaatcacctcctaaaaagggtgtcctcttgacactatcacattatggattagggttcaacctatgaattacgtaggcacagacacattcagatcctggcactacatgtaggatattcagttagcccctggttgagggggcgtttgtgttgttactggttttctgctattacacataccctttaatgaattgccttacgcatgcatgtttttgagtgttcgtcagtctctctttggaatagactcccagaagtggaattgctgagtcaaagggtaaatgcatacggaattttgattgatacggccacttcccatccatgggggttttactgttttatattcccgccagcagtgaatgagtacccttttttccccaacagagtattttgtcaaatttttcaatttttgcaggcttatagatgagaagtgatattatctcactgtacttctaattgcatttctctcttttcatgtggttaagagccatttgtattttctgtgaactatttaacctatttttctatagaatttttggtctttttcaaccattttcagctctttgtatactaggaatattaaccctttgtaatgtttgttgtacatatttttcccaatttgtcatttatcttttcacttggtttctgcaaagatttactttatttctgtgttaaatgtgttgattttttcttattgcttctggattttagagtcataggaaggttttcttcattcccagcttttacaggaatttatcgtgtttttttcaggcagacttttatagtttctgtttttacatttaaatctctctatccatttggagtttttcctggtatagatgtgaagtatggctccagattgtctttttccacatgctatccagttaccatttcatgcttttcaaacgccatcctgcatggaaggtggacaggaattacctttcatttagagatgagaagatgggaacctagaaggagatgtgagcagcccaaggtcaccagctcacgtggagcagtgctagggcttgagcagagctctgctgctgattctgggcttctgtgaagagtgattcatgctcagtgagcctgtaaatatgatcttacctgaacaagagagtttttctcatgacccacgaggaaacacttccttgttactcacagtagagacctggttagaaagtgctggagagggctaggtgtggtggctcacgcctgtaatcccagcattttaggaggctgaggtgggcagatcatttgaggtcaggagttcgagaccagcctgggcaatgtggtgaaagtgaaaccccatctctgctaacaatacaaacattagccaggcgtggtagcacgcacctgtaatcccagctactcgagaggctgtggcaggagaattgtgaacctgggatgcagagtttgtagtgagctaagatagccccagtgcactccagcctgggcgacagagcaagactgtctcaaaaaaaaaaaaaaaaagaaagtgccagaaagataagcatatacaagaaccacttacctttgcttggggctgcattgtggcccagttgctgggagaggcttctgtgaaggccgttgatagctgcaggcagtgacattctcaggggcccctagcagacaactcatccgggctcagggacacacctgggagccagtggcaggaatgtggagacactgcttggtggtggccgagcagcccagcctcgtagctgctgcctgtcacttctgagaatgtaagaaactgtgccctggtgtgtgatgttccccttcctgtatacctatgtaactaacctgcacattgtgcacatatatcctaaaacttaaagtataattaaaaaaaaaaaaaaaag

SEQ ID NO: 8158 - DNA, 287 bp, Homo sapiens
tttatttttttgagacagagtcttgctctgtcgcccaggctggagtgcagtggtgcgatctcggctaaccgcaagctccgcctcccaggttcacgccattctcctgcctcagcctcccgagtagctggtactacaggcgcccgccaccacgcccggctaagtgtttatatttttagtagagacggggtttcactgtgttagccaggatggtctcgatctcgtggcctcatgatctgccagccttggcctcccaaagtgctgggattacaggcgtgagccactgtgcc

SEQ ID NO: 8159 - DNA, 331 bp, Homo sapiens
tggctaattttgtatttttatagagacggggtttcaccatgctggccaggctgttctcaaactcctgacctcaggtgatctgcccacctcagcctcccaaagtgctgggattacaggcgtgagccactgcacctggcctgaattaaacttttaagtaagtgtttacttcagtggaaaaatgggttgggttctaagagatgtccaaagatacaggagtaggcagttgttgatggaaatctgttcctgcccttattctttcatttatgaaagggcatcccaggtacagcggcgcccacagtcactctctagcccagcagttcttggatgggtt

SEQ ID NO: 8160 - DNA, 331 bp, Homo sapiens
tggctaattttgtatttttatagagacggggtttcaccatgctggccaggctgttctcaaactcctgacctcaggtgatctgcccacctcagcctcccaaagtgctgggattacaggcgtgagccactgcacctggcctgaattaaacttttaagtaagtgtttacttcagtggaaaaatgggttgggttctaagagatgtccagagatacaggagtaggcagttgttgatggaaatctgttcctgcccttattctttcatttatgaaagggcatcccaggtacagcggcccccacagtcactctctagcccagcagttctcggatgggtt

SEQ ID NO: 8161 - DNA, 9525 bp, Homo sapiens
gttcccatggtgcacggtgctacgccagccactgtgtccgcagcaacaacatctgccacaagtgttcccttcgctgcaacagccacagccaaccaggtttgctaatttacagctttgtttcttaaaaaacaactctaatagggctcaatccaacagcccttacgcacgtggatttcccattgaggtcagtgggaatcgtgtgtacgtgagggctgtagagggtgctttaataagcatggggtttcaaagatacctcttgttggcctacacattctctctatgatgagcagcagaatgcttttatgccatttataagtgctccaaagtcgtcgcagctccatttctgaagctactaaaatgatatttacacaagcaattctcaattggtttcaacaatcgtgcaggtattttgaccaatcataaatagaggccatttttaaggtttttatttaaaatattgtggtatatacagtttcttagttcttgcctaaatgattaatagaaagtaaaatacttaaatgtattacgtatgccacaaatgaccactcttgtaaataagtttgttataaattcattataatctgaatcatttaatgagcagattcaaaataaattgtttgcatgtagcatttctaagcttttattctcaatgctttcagtgaaagaaaaatcctaagcgctcttatttttataattaccctgcataaatgttggagatttatgaaggaaaagaaaagaaattaagtatggcaaattgacagtcattctgtattccatgcaaatttattgcaggatacttttaagtgaaagggatttgtttcataaatttaaattttatgatatacaataataactatttaaaaataaatgatgatttaaaatatttaaaatttaaaaattgacatttattcacccagcattttctgattctacttaaaaatattttctagaaaatactggttgatttcaagtttcatttatgtagatttgggcttcaatagagttgatagtgtatgaaaaacatagagccaagccacatttcagataatccacagaggaagattaaaggtagccaaatgaatctcaaaagaatgagtgtcagatgaaaatgaacatgttcccccttgggaagggaagaccaattaagacatagatttgttgttattactgtgaggagtagccacccttgttctataatacatcacgtactgttgatgaagaacattcagctattagtacagccattaaaaactttcaaaatcagaacacaaaaatgaatttaacgtttcagtcaagctttaaacatttcttggcaaagaatcattaatttttcagaagcttgtcaaaatagccctgggtttacatgaacacgtcagactcatttacaagaatgctagattgtgcatatgtggcatgttaataagtaacctttggtagaactattatgatggattcaatacaatccatctatggtgcaaatcaatgataaagaactctcatgcgtctaccatgtatgactgtagaattgctggtgtaagcagaactatagcagagcaaatttcaacatgcccttggccacctgggttgtaggggacactttactttttgcattgtgctgtgaccatttcatgcataatcttggatcttcatactatttgacaaccaaaagaaagaaaagggaatggatatatatatacacacatatattatatctacatatacatacatatgtatatgcctacagtacattagcaatgctggaaatagctgatgccacaaaatgcagcctgcatgcatgcagaagtttatagctggcccttcatctgcatcgattggtgttgaaggtccttggtatgtttcgacagccccatccttgatgcttctacactgttgggtgcaacatcctgtcctgcagcagcaggaaaaatggtatgagaagcttcattatgcttggagcacattttcgtgccatttgccaatgctgtaaaattgtgtaaaaatgtcagctgagaactggaaataaaacagggacatattaatatacacgccagactgtggattgtagtatgttgaattagcctaagatgtctaaattgaaagaacagcaacaaaatgcctttgtgtatctgatttcattattctcccaacaacattgctgaaatgggattagtatcattttatagaagagacttaagcatagagtaatgagttgctttgctcagggtcacacagccagtaaatggatctctggggctagcacccgtgtcatcagtcctctgacagtctcaatccattgtgctgcctctctcaggttagcaggcattaatttcaggttgaagaatcaagctacaaatccgaagttcttaactttgggaactattgaaataagtcaactctatattggtttcttattgtattttctctcaagttctctaattctcttgcccatttaaaatacaataaaaggtgtcatcaggattcagaaatatgttctgaagtaaacttaggctcttacctagttcttttgaattactgctttataattcttacctggtatttttaatttggaaaaaaaaagttagacaccctaatttgaacgaaaatgttagaaatttggtgcacaaaaataggcaagacatttccttatctgatttctggatgattactaagtaactgaaaccacgggggtgcgtgtgtgtgtgtgtgtgtaggccaacaaaaagggcttctttcaattactgctctgcatgaatttttgatagttttacttatttcctaaaagctggtaacatttatagaatagtatttaacatgaagattttaaagttagttgctactttggcatttaagtttacattaacttactgttatgttgaccagataaggactatcacctcacagctgaatttcacttttctttaaaaatttaatattaaaatgttttcatctcttaattgttggcttgcttgcatggatcattcattaaataattttttatttgctagatacccataatatctgccgaacatctgactagccacaagtatgttacccagatgtagaattttcatcactaaacagtaagttcattatgtaatatatagttgcatatttgtggtggttttttttaagatagcaattgtatagtgcacttaaaattttgcgaaatctctgagaaaatatatacagatcacatttttatcttaaatgggtgtgaggaattttatcagacatctttataacaaatatgttaatatcacttaaatatacaaagtactaagagaaaataaattttttaaatttctgattagagataaacacagcataaagaaaatgtatgaccaaaaagtaattagaaggtgtagatcaagggttggcaaactttcttatagggtcagacagtaagtatttttgctgtgtgggccgtatcgtttctgttgcagctactctcctctgccattgtatcatgaaagcagccagagaccacatgtaaacaaatgggtgtagctgtgttccagtaaaactttatttacaaaaacaggcagtacatcacatctggcccacaggcagtagtttggctgacctctggtgtagattatcacttttttttttttttttcattctttggctaaaccttaaatgggaccatgtacttacttcatcccatgcaccaccatacacaggggcattagaatgtaatgagtttggctaagcgtggtggctcacacttgtaatccaagcactttgggaggccaaggtgggtggattgcttgagcccaggaatttaagactagcctaggcaacatggtcaaaccctgtcctacaaaaaatacaaaaaaatcagctgggtatggtagcacactctgtagttccagctactagggaggctaaagtgggaggatcacttgagcccaggaggttgaggctgcaatgagctgtgattgcgccactgcactccagcctgggcaacagagcaagacctgtctcaaaaaaaaaaaaatgtagtgagtctgactttaaataaatatatacacataatcaaatatatgtgtacacacaaatctacatattcaaatgaatcttagttactttaaagtagttacctcagaggatcatataattctgaaaatgttgccattgccacattttaaaaatggtttgaaagtcttgtattttgtctttaaaaacactgtggtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttaaagtataaaaaaaaaaacaaaaaaaaaaaccactgtcttaaatacttaaaaaggtgtccatttttcatccataggaatatgttttgtccagtatgcatgcattcaagttataacatgtgctcagatgcttgttatttatttttatatttagaaagagacattacatttaaaactgaaattggttaagatgggtgaccattctttgttgcttcctttatttatttattaacatatttacaaatgagtttttggtgctactttgtgttagttaccatggcaaggagataaaggtaaatagataataagataaagatgtaaggaatttcaggataatatagtaaaataagagaggtttgaagaaatttctcttagagcaaagatgaaggagcagctgttcccaacaggatccgtaaacaaatgaatgtggacaatgaaggtgttgttctaaagagaatggaggtgtaaaggccttgtaaaagaaggacagtgtgccaagtcaggaaacgatgatggctgagaaccaactcagaaacccttgtgatgttaatctgtagcaaagctggacaaagtcaaagcccatgcaggagaacaggcagaattcaatagccatttaagaaagaaatgagaggctcaactggagaagtactgccaaagatatgctgcaatcgtgaattattaaaattgatttttgtctatttcataagttttctcaaagcagttctgataaaaaggttcagattctgaacaatagccacatttgtagaagaagaggcattactttgcagtgttgtaggtttagaagaagaggtttttttgacatgccagaaaaatctgtttcaagctcttatagtcaattaggtgtgtttggtatgtatatatttaactaaattctgtttcttagcaataatccaggttgaaaaaaatttctaaaaataattagcaaaccagtagttttgtctgtattgaagctaagcttttaatgttctgttcatttaacaaatgattgctcatcttcatgaggagttgcaacatttaaactggtttttgagtcactagattatgatttctttcattttcaaggttgtattgtgaagcatacttttaatatatgtaaatattcgctgctgagaacaaatttcatgtaaaaactggaactgttaatccacaagtacattgtaatgtctattacagcttaattcatgagtaataattctgtaattcaaaaagaatgatttttattttcttagttttaggtgaaaaaagttcaacaaactgaattacccaaagccatcacttaaagtatcattctttttttttcaaacatgcattatgctaatcaagcacccaaaaagaataaatcttgtttaatagaacatattacatgaattttaattttgtagaccagacctttactcttgaaaccttattaaacttcagaaaagaagtttaaattttgccctacaacaattgtgctaaaaaagagctctgtatattaggccccctgattctgcaaatgtattttatacttttagtttaggattggtaaattttggagcacattctacagttttattaaattgtacgtgttatttcattcgtgtagagatgatagacaaattttgatctgtctactcttgtaaaatggtttttgtttttatatgaagatataatgtaaatatactggttaatcaaaaagaaaattttcatattaaatgtatattagaaactgcttttagatattacctgttctaacaaagcttatctctttttcccttgtagatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagtatattcgtgta

SEQ ID NO: 8162 - DNA, 9525 bp, Homo sapiens
gttcccatggtgcacggtgctacgccagccactgtgtccgcagcaacaacatctgccacaagtgttcccttcgctgcaacagccacagccaaccaggtttgctaatttacagctttgtttcttaaaaaacaactctaatagggctcaatccaacagcccttacgcacgtggatttcccattgaggtcagtgggaatcgtgtgtacgtgagggctgtagagggtgctttaataagcatggggtttcaaagatacctcttgttggcctacacattctctctatgatgagcagcagaatgcttttatgccatttataagtgctccaaagtcgtcgcagctccatttctgaagctactaaaatgatatttacacaagcaattctcaattggtttcaaccaatcgtgcaggtattttgaccaatcaaaaatagaggccattttaaggtttttatttaaaatatttggtatatacagtttcttagttcttgcctaaatgattaatagaaagtaaaatacttaaatgtattacgtatgccacaaatgaccactcttgtaaataagtttgttataaattcattataatctgaatcatttaatgagcagattcaaaataaattgtttgcatgtagcatttctaagcttttattctcaatgctttcagtgaaagaaaaatcctaagcgctcttatttttataattaccctgcataaatgttggagatttatgaaggaaaagaaaagaaattaagtatggcaaattgacagtcattctgtattccatgcaaatttattgcaggatacttttaagtgaaagggatttgtttcataaatttaaattttatgatatacaataataactatttaaaaataaatgatgatttaaaatatttaaaatttaaaaattgacatttattcacccagcattttctgattctacttaaaaatattttctagaaaatactggttgatttcaagtttcatttatgtagatttgggcttcaatagagttgatagtgtatgaaaaacatagagccaagccacatttcagataatccacagaggaagattaaaggtagccaaatgaatctcaaaagaatgagtgtcagatgaaaatgaacatgttcccccttgggaagggaagaccaattaagacatagatttgttgttattactgtgaggagtagccacccttgttctataatacatcacgtactgttgatgaagaacattcagctattagtacagccattaaaaactttcaaaatcagaacacaaaaatgaatttaacgtttcagtcaagctttaaacatttcttggcaaagaatcattaatttttcagaagcttgtcaaaatagccctgggtttacatgaacacgtcagactcatttacaagaatgctagattgtgcatatgtggcatgttaataagtaacctttggtagaactattatgatggattcaatacaatccatctatggtgcaaatcaatgataaagaactctcatgcgtctaccatgtatgactgtagaattgctggtgtaagcagaactatagcagagcaaatttcaacatgcccttggccacctgggttgtaggggacactttactttttgcattgtgctgtgaccatttcatgcataatcttggatcttcatactatttgacaaccaaaagaaagaaaagggaatggatatatatatacacacatatattatatctacatatacatacatatgtatatgcctacagtacattagcaatgctggaaatagctgatgccacaaaatgcagcctgcatgcatgcagaagtttatagctggcccttcatctgcatcgattggtgttgaaggtccttggtatgtttcgacagccccatccttgatgcttctacactgttgggtgcaacatcctgtcctgcagcagcaggaaaaatggtatgagaagcttcattatgcttggagcacattttcgtgccatttgccaatgctgtaaaattgtgtaaaaatgtcagctgagaactggaaataaaacagggacatattaatatacacgccagactgtggattgtagtatgttgaattagcctaagatgtctaaattgaaagaacagcaacaaaatgcctttgtgtatctgatttcattattctcccaacaacattgctgaaatgggattagtatcattttatagaagagacttaagcatagagtaatgagttgctttgctcagggtcacacacacagtaaatggatctctggggatagcacccgtgtcatcagtcctgtgacagtctcaatccattgtgctgcctctctcaggtaagcaggcattaatttcaggttgaagaatcaagctacaaatccgaagttcttagctttgggaactattgaaataagccccctctatattggtttcttattgtattttctcccaagttctctaattctctggcccatttaaaatacaataaaaggtgtcatcaggattcagaaatatgttctgaagtaaacttaggctcttacctagttcttttgaattactgctttataattcttacctggtatttttaatttggaaaaaaaaagttagacaccctaatttgaacgaaaatgttagaaatttggttgcacaaaaataggcaagacatttccttatctgatttctggatgattactaagtaactgaaaccacgggggtgcgtgtgtgtgtgtgtgtgtaggccaacaaaaagggcttctttcaattactgctctgcatgaatttttgatagttttacttatttcctaaaagctggtaacatttatagaatagtatttaacatgaagattttaaagttagttgctactttggcatttaagtttacattaacttactgttatgttgaccagataaggactatcacctcacagctgaatttcacttttctttaaaaatttaatattaaaatgttttcatctcttaattgttggcttgcttgcatggatcattcattaaataattttttatttgctagatacccataatatctgccgaacatctgactagccacaagtatgttacccagatgtagaattttcatcactaaacagtaagttcattatgtaatatatagttgcatatttgtggtggttttttttaagatagcaattgtatagtgcacttaaaattttgcgaaatctctgagaaaatatatacagatcacatttttatcttaaatgggtgtgaggaattttatcagacatctttataacaaatatggtaatatcacttaaatatacaaagtactaagagaaaataaattttttaaatttctgattagagataaacacagcataaagaaaatgtatgaccaaaaagtaattagaaggtgtagatcaagggttggcaaactttcttatagggtcagacagtaagtatttttgctgtgtgggccgtatcgtttctgttgcagctactctcctctgccattgtatcatgaaagcagccagagaccacatgtaaacaaatgggtgtagctgtgttccagtaaaactttatttacaaaaacaggcagtacatcacatctggcccacaggcagtagtttggctgacctctggtgtagattatcacttttttttttttttttcattctttggctaaaccttaaatgggaccatgtacttacttcatcccatgcaccaccatacacaggggcattagaatgtaatgagtttggctaagcgtggtggctcacacttgtaatccaagcactttgggaggccaaggtgggtggattgcttgagcccaggaatttaagactagcctaggcaacatggtcaaaccctgtcctacaaaaaatacaaaaaaatcagctgggtatggtagcacactctgtagttccagctactagggaggctaaagtgggaggatcacttgagcccaggaggttgaggctgcaatgagctgtgattgcgccactgcactccagcctgggcaacagagcaagacctgtctcaaaaaaaaaaaaatgtagtgagtctgactttaaataaatatatacacataatcaaatatatgtgtacacacaaatctacatattcaaatgaatcttagttactttaaagtagttacctcagaggatcatataattctgaaaatgttgccattgccacattttaaaaatggtttgaaagtcttgtattttgtctttaaaaacactgtggtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttaaagtataaaaaaaaaaacaaaaaaaaaaaccactgtcttaaatacttaaaaaggtgtccatttttcatccataggaatatgttttgtccagtatgcatgcattcaagttataacatgtgctcagatgcttgttatttatttttatatttagaaagagacattacatttaaaactgaaattggttaagatgggtgaccattctttgttgcttcctttatttatttattaacatatttacaaatgagtttttggtgctactttgtgttagttaccatggcaaggagataaaggtaaatagataataagataaagatgtaaggaatttcaggataatatagtaaaataagagaggtttgaagaaatttctcttagagcaaagatgaaggagcagctgttcccaacaggatccgtaaacaaatgaatgtggacaatgaaggtgttgttctaaagagaatggaggtgtaaaggccttgtaaaagaaggacagtgtgccaagtcaggaaacgatgatggctgagaaccaactcagaaacccttgtgatgttaatctgtagcaaagctggacaaagtcaaagcccatgcaggagaacaggcagaattcaatagccatttaagaaagaaatgagaggctcaactggagaagtactgccaaagatatgctgcaatcgtgaattattaaaattgatttttgtctatttcataagttttctcaaagcagttctgataaaaaggttcagattctgaacaatagccacatttgtagaagaagaggcattactttgcagtgttgtaggtttagaagaagaggtttttttgacatgccagaaaaatctgtttcaagctcttatagtcaattaggtgtgtttggtatgtatatatttaactaaattctgtttcttagcaataatccaggttgaaaaaaatttctaaaaataattagcaaaccagtagttttgtctgtattgaagctaagcttttaatgttctgttcatttaacaaatgattgctcatcttcatgaggagttgcaacatttaaactggtttttgagtcactagattatgatttctttcattttcaaggttgtattgtgaagcatacttttaatatatgtaaatattcgctgctgagaacaaatttcatgtaaaaactggaactgttaatccacaagtacattgtaatgtctattacagcttaattcatgagtaataattctgtaattcaaaaagaatgatttttattttcttagttttaggtgaaaaaagttcaacaaactgaattacccaaagccatcacttaaagtatcattctttttttttcaaacatgcattatgctaatcaagcacccaaaaagaataaatcttgtttaatagaacatattacatgaattttaattttgtagaccagacctttactcttgaaaccttattaaacttcagaaaagaagtttaaattttgccctacaacaattgtgctaaaaaagagctctgtatattaggccccctgattctgcaaatgtattttatacttttagtttaggattggtaaattttggagcacattctacagttttattaaattgtacgtgttatttcattcgtgtagagatgatagacaaattttgatctgtctactcttgtaaaatggtttttgtttttatatgaagatataatgtaaatatactggttaatcaaaaagaaaattttcatattaaatgtatattagaaactgcttttagatattacctgttctaacaaagcttatctctttttcccttgtagatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagtatattcgtgta

SEQ ID NO: 8163 - DNA, 2731 bp, Homo sapiens
attatttcttccatgttattgttttcagaccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcattcttactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcatttttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtatattagtaagatcttattttgaataaaacgtctttaatacaaggagttttggtaaggctaatacaatgacagactgagcaaaatgccttgcaaaagtgggcacagagttagcactccataccccttccaaacatggtgctttgctttcttgtggcagcttggagttggccaggattttttcagctgaaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagctcaaatttcatggttttaattttcaactcagaagcactcaaaaatgcaaaatgtgataatgggcacttgtttaaaagaattagggtatccagccttcactccagctggttaaaaatgttgcacttatcagcaaccctaccactttcatctgctgaaaggacaaatgtgcttggttttactattatgtaatcacaacttactttctgcttgtagttgcttaaacttatgtattttgtcttgggctgcaatttgttttatgcttattttattattactgcagtagttgactttgctgtatggaaaaataaagtgaaattgccctaataaaacttctctttcttaagtatattcgtgta

SEQ ID NO: 8164 - DNA, 12390 bp, Homo sapiens
cacatttctcagaagcacaccattctgctctgcaaatatctttgtaggagaaattggaaattgacaaatacattcacttaaattttgctttgtgctgaaaattgaggaaaaatttaaattggccatttgcacattattagtagtaaatcaacccatgtaaagatggaaactatggtcatttcaaaagtgattttcatttttggtaagtgggtcctacagcattatgtcctcatatttgtgagttattgcaccctggctagtattttcattgctgccttatgtttatttgctgcaaatccctctcaaaactgtgtgcattggttataatgctaatgaggaagataattcaaactaaaattcaaatcataatagctttaggattttagagagatagtataaggttaactcattttcagcatgtgcagacttaattatgcatgggatgaaatacagtaggcaagtctcagcctaataataaataattgaaaaatataacctgtacaatatttaaactggctttaatattacttaattatcacattattctttttcattcatcatttcttttccaattctctcaccctaccattaagacagtaatgattttataagatgtagatccggtattaagttttgcttgctctactgtctcaaattattataacttctttgttattactggcttgtttctgtttgtctttcacaagtctttgactcagtagtagtagcaaatgacagagatcttcaagtgtcttaatgcttgtcaatataatattattccacttgataggatgtgtccccagatacattacagagtttaatcgttgatcactctgcccacagtctaattgtgataacaaactaatcgcagctgttacagagatgccagttaagtaatccgtgtttcagctgagtttctcaatggcagctttattttatagggccatctctgacgagattcatttggcagatatttttctaacaaatgttcgtcccagatgctgctagtatttaaacaggatatgctaagatttagatagaaatataaaatccttggatattttaaaacctagaattctaaaataatcccatagaaagaacagtagttctgcatatgggaaagtgccttgtacttggtaaaataagttaaattttcaatatttacatgtcaaagagaacaaggactatctatatatgcaacatttatttttgcttatcatggttgaacaattgtcagcatcagtgctaacaccccatatgtgatgtatgtattttcactctctcccactcaaggtttttattgaactctaattagcagtttcttgcgtgtgaaattttgtagaacatttgctactcccagaagtcttgaaggtctaaaccagcaatgaaaaccactctgatttcctagatactgtgaagtaaaccaatttgatacttataagaaattatattcccccttaatgcttttcctacattttaatttcaaactaaggaaaggcacaaatttcacttttttatgtataatttattgcttggcatccctccaaatacaaatcctgtatgaataattacaacccctttcatgtttatatggttgctgctacaatgaacaggaaaataaagcaaaaggaatgaaaatgaatgtttgggtttcattatattgttaagtcagttttgtacattgaattatttagtatttaataataaatatctttagtaagttaatatgtgcctgatataaagaaaatgttaaggcattcataagttaaagtcagaaatagcaaaacgaccagatggttagtaatcagattaaaacaaaacagattacaatattatttttaaaagaattaagtggatttaaattacttccaaaatacttttgtttataggcaacaattaagagaaacaaagtgtaccagcacacagttaaactggcttttattcttcacttgagactagttctaattgatcactgtgctattgtatgatttgattgtgctgacagttacatgccactgttcccataataacaatttttcttctttgttcaaatgaattttctaattacacgtgtgatgggatgttttaattcttttcccttttcaaatccaccttcctgttgcaatgcatgatgggcaggctcaatattgtgcatgacacccgctacaagtgttggtaggtgccagctttgtttcttgattatcttaaacctatggtgtacctcacagcccctcaaaatccactgctaagtttaacttatatctattgggcaagtccatttcccttttactaacacttgtcaattaaatgccattttctgtttaattgacatggactcacataagtgttttctttacacacaacagtttcctttagtcacctttggtggattttgattggactatgagttctggtgtgtaaaaaaaatctatttcataaaagtaatatactgtatatttttataatagtaaatgagaaaaaaatactttcattcaaacagataactgtatatatgaagtaaatacttgtattttgacttagattttgaatgtctgactatgaacactatataaaattcttgtttttgacttagcatattaagcctgtttgtgtcaattttcttgatttgatggtaacaagcttttttcccccttttttttctctttcatccctcctccccttctctccttggaatgttgtcctgctttgcgctgtgattgcatgtcactcgctggtgatgatgtcctgtcacatggcttattgctgtgataaataccatgcccaattatctcttccatgttgccatggtttccatattgctacactcttctgtatgttcgcttatatgattttccctccgaaagttcccatggtgcacggtgctacgccagccactgtgtccgcagcaacaacatctgccacaagtgttcccttcgctgcaacagccacagccaaccaggtttgctaatttacagctttgtttcttaaaaaacaactctaatagggctcaatccaacagcccttacgcacgtggatttcccattgaggtcagtgggaatcgtgtgtacgtgagggctgtagagggtgctttaataagcatggggtttcaaagatacctcttgttggcctacacattctctctatgatgagcagcagaatgcttttatgccatttataagtgctccaaagtcgtcgcagctccatttctgaagctactaaaatgatatttacacaagcaattctcaattggtttcaaccaatcgtgcaggtattttgaccaatcaaaaatagaggccattttaaggtttttatttaaaatatttggtatatacagtttcttagttcttgcctaaatgattaatagaaagtaaaatacttaaatgtattacgtatgccacaaatgaccactcttgtaaataagtttgttataaattcattataatctgaatcatttaatgagcagattcaaaataaattgtttgcatgtagcatttctaagcttttattctcaatgctttcagtgaaagaaaaatcctaagcgctcttatttttataattaccctgcataaatgttggagatttatgaaggaaaagaaaagaaattaagtatggcaaattgacagtcattctgtattccatgcaaatttattgcaggatacttttaagtgaaagggatttgtttcataaatttaaattttatgatatacaataataactatttaaaaataaatgatgatttaaaatatttaaaatttaaaaattggacatttattcacccagcattttctgattctacttaaaaatattttctagaaaatactggttgatttcaagtttcatttatgtagatttgggcttcaatagagttgatagtgtatgaaaaacatagagccaagccacatttcagataatccacagaggaagattaaaggtagccaaatgaatctcaaaagaatgagtgtcagatgaaaatgaacatgttcccccttgggaagggaagaccaattaagacatagatttgttgttattactgtgaggagtagccacccttgttctataatacatcacgtactgttgatgaagaacattcagctattagtacagccattaaaaactttcaaaatcagaacacaaaaatgaatttaacgtttcagtcaagctttaaacatttcttggcaaagaatcattaatttttcagaagcttgtcaaaatacccctggtttacatgaacacgtcagactcatttacagaaatgctagattgtgcatatgtggcatgttaataagtaacctttggtagaactattatgatggattcaattcaatccatctatggtgcaaatcaatgataaagaactctcatgcgtctaccatgtatgactgtagaattgctggtgtaagcagaactatagcagagcaaatttcaacatgcccttggccacctgggttgtaggggacactttactttttgcattgtgctgtgaccatttcatgcataatcttggatcttcatactatttgacaaccaaaagaaagaaaagggaatggatatatatatacacacatatattatatctacatatacatacatatgtatatgcctacagtacattagcaatgctggaaatagctgatgccacaaaatgcagcctgcatgcatgcagaagtttatagcctggcccttcatctgcatcgattggtgttgaaggtccttggtatgtttcgacagccccatccttgatgcttctacactgttgggtgcaacatcctgtcctgcagcagcaggaaaaatggtatgagaagcttcattatgcttggagcacattttcgtgccatttgccaatgctgtaaaattgtgtaaaaatgtcagctgagaactggaaataaaacagggacatattaatatacacgccagactgtggattgtagtatgttgaattagcctaagatgtctaaattgaaagaacagcaacaaaatgcctttgtgtatctgatttcattattctcccaacaacattgctgaaatgggattagtatcattttatagaagagacttaagcatagagtaatgagttgctttgctcagggtcacacagccagtaaatggatctctggggctagcacccgtgtcatcagtcctctgacagtctcaatccattgtgctgcctctctcaggttagcaggcattaatttcaggttgaagaatcaagctacaaatccgaagttcttaactttgggaactattgaaataagtcaactctatattggtttcttattgtattttctctcaagttctctaattctcttgcccatttaaaatacaataaaaggtgtcatcaggattcagaaatatgttctgaagtaaacttaggctcttacctagttcttttgaattactgctttataattcttacctggtatttttaatttggaaaaaaaaagttagacaccctaatttgaacgaaaatgttagaaatttggttgcacaaaaataggcaagacatttccttatctgatttctggatgattactaagtaactgaaaccacgggggtgcgtgtgtgtgtgtgtgtgtaggccaacaaaaagggcttctttcaattactgctctgcatgaatttttgatagttttacttatttcctaaaagctggtaacatttatagaatagtatttaacatgaagattttaaagttagttgctactttggcatttaagtttacattaacttactgttatgttgaccagataaggactatcacctcacagctgaatttcacttttctttaaaaatttaatattaaaatgttttcatctcttaattgttggcttgcttgcatggatcattcattaaataattttttatttgctagatacccataatatctgccgaacatctgactagccacaagtatgttacccagatgtagaattttcatcactaaacagtaagttcattatgtaatatatagttgcatatttgtggtggttttttttaagatagcaattgtatagtgcacttaaaattttgcgaaatctctgagaaaatatatacagatcacatttttatcttaaatgggtgtgaggaattttatcagacatctttataacaaatatgttaatatcacttaaatatacaaagtactaagagaaaataaattttttaaatttctgattagagataaacacagcataaagaaaatgtatgaccaaaaagtaattagaaggtgtagatcaagggttggcaaactttcttatagggtcagacagtaagtatttttgctgtgtgggccgtatcgtttctgttgcagctactctcctctgccattgtatcatgaaagcagccagagaccacatgtaaacaaatgggtgtagctgtgttccagtaaaactttatttacaaaaacaggcagtacatcacatctggcccacaggcagtagtttggctgacctctggtgtagattatcacttttttttttttttttcattctttggctaaaccttaaatgggaccatgtacttacttcatcccatgcaccaccatacacaggggcattagaatgtaatgagtttggctaagcgtgggtggctcacacttgtaatccaagcactttgggaggccaaggtgggtggattgcttgagcccaggaatttaagactagcctaggcaacatggtcaaaccctgtcctacaaaaaatacaaaaaaatcagctgggtatggtagcacactctgtagttccagctactagggaggctaaagtgggaggatcacttgagcccaggaggttgaggctgcaatgagctgtgattgcgccactgcactccagcctgggcaacagagcaagacctgtctcaaaaaaaaaaaaatgtagtgagtctgactttaaataaatatatacacataatcaaatatatgtgtacacacaaatctacatattcaaatgaatcttagttactttaaagtagttacctcagaggatcatataattctgaaaatgttgccattgccacattttaaaaatggtttgaaagtcttgtattttgtctttaaaaacactgtggtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttaaagtataaaaaaaaaaacaaaaaaaaaaaccactgtcttaaatacttaaaaaggtgtccatttttcatccataggaatatgttttgtccagtatgcatgcattcaagttataacatgtgctcagatgcttgttatttatttttatatttagaaagagacattacatttaaaactgaaattggttaagatgggtgaccattctttgttgcttcctttatttatttattaacatatttacaaatgagtttttggtgctactttgtgttagttaccatggcaaggagataaaggtaaatagataataagataaagatgtaaggaatttcaggataatatagtaaaataagagaggtttgaagaaatttctcttagagcaaagatgaaggagcagctgttcccaacaggatccgtaaacaaatgaatgtggacaatgaaggtgttgttctaaagagaatggaggtgtaaaggccttgtaaaagaaggacagtgtgccaagtcaggaaacgatgatggctgagaaccaactcagaaacccttgtgatgttaatctgtagcaaagctggacaaagtcaaagcccatgcaggagaacaggcagaattcaatagccatttaagaaagaaatgagaggctcaactggagaagtactgccaaagatatgctgcaatcgtgaattattaaaattgatttttgtctatttcataagttttctcaaagcagttctgataaaaaggttcagattctgaacaatagccacatttgtagaagaagaggcattactttgcagtgttgtaggtttagaagaagaggtttttttgacatgccagaaaaatctgtttcaagctcttatagtcaattaggtgtgtttggtatgtatatatttaactaaattctgtttcttagcaataatccaggttgaaaaaaatttctaaaaataattagcaaaccagtagttttgtctgtattgaagctaagcttttaatgttctgttcatttaacaaatgattgctcatcttcatgaggagttgcaacatttaaactggtttttgagtcactagattatgatttctttcattttcaaggttgtattgtgaagcatacttttaatatatgtaaatattcgctgctgagaacaaatttcatgtaaaaactggaactgttaatccacaagtacattgtaatgtctattacagcttaattcatgagtaataattctgtaattcaaaaagaatgatttttattttcttagttttaggtgaaaaaagttcaacaaactgaattacccaaagccatcacttaaagtatcattctttttttttcaaacatgcattatgctaatcaagcacccaaaaagaataaatcttgtttaatagaacatattacatgaattttaattttgtagaccagacctttactcttgaaaccttattaaacttcagaaaagaagtttaaattttgccctacaacaattgtgctaaaaaagagctctgtatattaggccccctgattctgcaaatgtattttatacttttagtttaggattggtaaattttggagcacattctacagttttattaaattgtacgtgttatttcattcgtgtagagatgatagacaaattttgatctgtctactcttgtaaaatggtttttgtttttatatgaagatataatgtaaatatactggttaatcaaaaagaaaattttcatattaaatgtatattagaaactgcttttagatattacctgttctaacaaagcttatctctttttcccttgtagatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaagacgtggtgagggagggatctgacagagatgaatgtgccaagcaaaaccacaactgtgtatattttaaagcacatcatggctttaagtaccatgttgttaaggattctcatgaagtgccatagactgtacatcaaattagagtattatttcttcagtgttattgttttcagagccacattttgttgcatatttgctagtactaatcagtcaaagggcaccattctttttttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgtatggaaaaataaagtgaaattgccctaataaaacttctctttcttaagtatattcgtgta

SEQ ID NO: 8165 - DNA, 392 bp, Homo sapiens
tagtgatattttggaaatcttttcattgaaaaaatgcataactaaaagtccttgtaacttttgcaatactttaaatgaaactgtattttgttaatcacaacagcatatacatgcatctgaaaaattattttcagaagagttattattacaacgcccactaggagtcctcagctcacagaatgggactctgttagaagtcattcgtttttcatttggagaacaaaatcgtttgctagagctattacttcatcacatacccttggtactcatggaatttaaactttgaaatgatactaaaggtcagtgatgtagcaatctattatttcactgagacatacttttgaatgcctgtatgaatgctttcatacaggaagtagtcactaaagcactgg

SEQ ID NO: 8166 - DNA, 2533 bp, Homo sapiens
cacatttctcagaagcacaccattctgctctgcaaatatctttgtaggagaaattggaaattgacaaatacattcacttaaattttgctttgtgctgaaaattgaggaaaaatttaaattggccatttgcacattattagtagtaaatcaacccatgtaaagatggaaactatggtcatttcaaaagtgattttcatttttggtaagtgggtcctacagcattatgtcctcatatttgtgagttattgcaccctggctagtattttcattgctgccttatgtttatttgctgcaaatccctctcaaaactgtgtgcattggttataatgctaatgaggaagataattcaaactaaaattcaaatcataatagctttaggattttagagagatagtataaggttaactcattttcagcatgtgcagacttaattatgcatgggatgaaatacagtaggcaagtctcagcctaataataaataattgaaaaatataacctgtacaatatttaaactggctttaatattacttaattatcacattattctttttcattcatcatttcttttccaattctctcaccctaccattaagacagtaatgattttataagatgtagatccggtattaagttttgcttgctctactgtctcaaattattataacttctttgttattactggcttgtttctgtttgtctttcacaagtctttgactcagtagtagtagcaaatgacagagatcttcaagtgtcttaatgcttgtcaatataatattattccacttgataggatgtgtccccagatacattacagagtttaatcgttgatcactctgcccacagtctaattgtgataacaaactaatcgcagctgttacagagatgccagttaagtaatccgtgtttcagctgagtttctcaatggcagctttattttatagggccatctctgacgagattcatttggcagatatttttctaacaaatgttcgtcccagatgctgctagtatttaaacaggatatgctaagatttagatagaaatataaaatccttggatattttaaaacctagaattctaaaataatcccatagaaagaacagtagttctgcatatgggaaagtgccttgtacttggtaaaataagttaaattttcaatatttacatgtcaaagagaacaaggactatctatatatgcaacatttatttttgcttatcatggttgaacaattgtcagcatcagtgctaacaccccatatgtgatgtatgtattttcactctctcccactcaaggtttttattgaactctaattagcagtttcttgcgtgtgaaattttgtagaacatttgctactcccagaagtcttgaaggtctaaaccagcaatgaaaaccactctgatttcctagatactgtgaagtaaaccaatttgatacttataagaaattatattcccccttaatgcttttcctacattttaatttcaaactaaggaaaggcacaaatttcacttttttatgtataatttattgcttggcatccctccaaatacaaatcctgtatgaataattacaacccctttcatgtttatatggttgctgctacaatgaacaggaaaataaagcaaaaggaatgaaaatgaatgtttgggtttcattatattgttaagtcagttttgtacattgaattatttagtatttaataataaatatctttagtaagttaatatgtgcctgatataaagaaaatgttaaggcattcataagttaaagtcagaaatagcaaaacgaccagatggttagtaatcagattaaaacaaaacaaattacaatattatttttaaaagaattaagtggatttaaattacttccaaaatacttttgtttataggcaacaattaagagaaacaaagtgtaccagcacacagttaaactggcttttattcttcacttgagactagttctaattgatcactgtgctattgtatgatttgattgtgctgacagttacatgccactgttcccataataacaatttttcttctttgttcaaatgaattttctaattacacgtgtgatgggatgttttaattcttttcccttttcaaatccaccttcctgttgcaatgcatgatgggcaggctcaatattgtgcatgacacccgctacaagtgttggtaggtgccagctttgtttcttgattatcttaaacctatggtgtacctcacagcccctcaaaatccactgctaagtttaacttatatctattgggcaagtccatttcccttttactaacacttgtcaattaaatgccattttctgtttaattgacatggactcacataagtgttttctttacacacaacagtttcctttagtcacctttggtggattttgattggactatgagttctggtgtgtaaaaaaaatctatttcataaaagtaatatactgtatatttttataatagtaaatgagaaaaaaatactttcattcaaacagataactgtatatatgaagtaaatacttgtattt

SEQ ID NO: 8167 - DNA, 392 bp, Homo sapiens; identical to SEQ ID NO: 8165

SEQ ID NO: 8168 - DNA, 2529 bp, Homo sapiens
cacatttctcagaagcacaccattctgctctgcaaatatctttgtaggagaaattggaaattgacaaatacattcacttaaattttgctttgtgctgaaaattgaggaaaaatttaaattggccatttgcacattattagtagtaaatcaacccatgtaaagatggaaactatggtcatttcaaaagtgattttcatttttggtaagtgggtcctacagcattatgtcctcatatttgtgagttattgcaccctggctagtattttcattgctgccttatgtttatttgctgcaaatccctctcaaaactgtgtgcattggttataatgctaatgaggaagataattcaaactaaaattcaaatcataatagctttaggattttagagagatagtataaggttaactcattttcagcatgtgcagacttaattatgcatgggatgaaatacagtaggcaagtctcagcctaataataaataattgaaaaatataacctgtacaatatttaaactggctttaatattacttaattatcacattattctttttcattcatcatttcttttccaattctctcaccctaccattaagacagtaatgattttataagatgtagatccggtattaagttttgcttgctctactgtctcaaattattataacttctttgttattactggcttgtttctgtttgtctttcacaagtctttgactcagtagtagtagcaaatgacagagatcttcaagtgtcttaatgcttgtcaatataatattattccacttgataggatgtgtccccagatacattacagagtttaatcgttgatcactctgcccacagtctaattgtgataacaaactaatcgcagctgttacagagatgccagttaagtaatccgtgtttcagctgagtttctcaatggcagctttattttatagggccatctctgacgagattcatttggcagatatttttctaacaaatgttcgtcccagatgctgctagtatttaaacaggatatgctaagatttagatagaaatataaaatccttggatatttaaaacctagaattgttagataatcccatagaaagtacagtagttctgcatatgggaaagtgccttgtacttggtaaaataagttaaattttcaatatttacatgtcaaagagaacaaggactatctatatatgcaacatttatttttgcttatcatggttgaacaattgtcagcatcagtgctaacaccccatatgtgatgtatgtattttcactctctcccactcaaggtttttattgaactctaattagcagtttcttgcgtgtgaaattttgtagaacatttgctactcccagaagtcttgaaggtctaaaccagcaatgaaaaccactctgatttcctagatactgtgaagtaaaccaatttgatacttataagaaattatattcccccttaatgcttttcctacattttaatttcaaactaaggaaaggcacaaatttcacttttttatgtataatttattgcttggcatccctccaaatacaaatcctgtatgaataattacaacccctttcatgtttatatggttgctgctacaatgaacaggaaaataaagcaaaaggaatgaaaatgaatgtttgggtttcattatattgttaagtcagttttgtacattgaattatttagtatttaataataaatatctttagtaagttaatatgtgcctgatataaagaaaatgttaaggcattcataagttaaagtcagaaatagcaaacgaccagatgttagtatcagattaaaacaaaacagattcaatatttttttttaaaagaattaagtggatttaaattacttccaaaatacttttgtttataggcaacaattaagagaaacaaagtgtaccagcacacagttaaactggcttttattcttcacttgagactagttctaattgatcactgtgctattgtatgatttgattgtgctgacagttacatgccactgttcccataataacaatttttcttctttgttcaaatgaattttctaattacacgtgtgatgggatgttttaattcttttcccttttcaaatccaccttcctgttgcaatgcatgatgggcaggctcaatattgtgcatgacacccgctacaagtgttggtaggtgccagctttgtttcttgattatcttaaacctatggtgtacctcacagcccctcaaaatccactgctaagtttaacttatatctattgggcaagtccatttcccttttactaacacttgtcaattaaatgccattttctgtttaattgacatggactcacataagtgttttctttacacacaacagtttcctttagtcacctttggtggattttgattggactatgagttctggtgtgtaaaaaaaatctatttcataaaagtaatatactgtatatttttataatagtaaatgagaaaaaaatactttcattcaaacagataactgtatatatgaagtaaatacttgtattt

SEQ ID NO: 8169 - DNA, 392 bp, Homo sapiens; identical to SEQ ID NO: 8165

SEQ ID NO: 8170 - DNA, 392 bp, Homo sapiens; identical to SEQ ID NO: 8165

SEQ ID NO: 8171 - DNA, 1710 bp, Homo sapiens
aagcatcattcaaccatacatccatccatcctcctatcattctgttctcccctttcctttcctctctttatccttttttccttcctcccttcctctgtccttcagttttccatccatctattcatccccccatttatctatccacccatctttccatttattcagtcaataaacattgattgtatgccacatggtataccagtatttatgtgaaggattgcaaactgatagctcaagggtaaaatctagtatctagaaatatttttgtttaagagtgtttaaatgaaaactaaatgtaaatcctttagataggacacatactgtacccttcagttccaaacgctacaattccctattgccttaggccaggttgtttcagatattttgttcaaaagagctacgttttattgaatggttgctcttgttccctgctgcactgagtgctttgcctacattatctcattttttttcacaacgcccagaaggttggcattaatattttcattttacgaatgagtaatttggagcctagtaaggtacagtgatttgtcccaagttaaatggcttttgtaaggtttagatttaagtacaacttgaactcaagtcaggctgacttggttagtctctcaatatctattacacgaagaccttaaaaatgatttgggagagtggaagtagcccttactgaacacctaactccatggtgtttcacaccttccacctcatttaaagataaatataagtattaggttaaattcatattgaagttttgtcttttcaaatttcgatatatacttgttttaaccttcccctttcaggaccagattgattatttgtagatattatgcataatttaggatctatttatgttatatatatgagttttcactcatgaaattacggcgtgtaagaaataccactttcctttacaccatttcttttttcgttgaaattaagtctagctctgaactgtgatctctatctccctgggttgagagaaataacaggcattactgggaatccaggactacatgccccagctccctctctttcctgaccttacctcaatgtgaggtcctgtacagtctagtattctcagacaggctatgcattcttcatgcttcagtcaccgctgctcactgctgatgtgatcattgtctatgcttgcaagagctcttaagacaggtactccaggggttctgtgcttgccttggatataggcttccttgtctatgccctccaggctcccatgcccttgaggacctgatgtctgcagggctattgtgaaagaacaggctacctacccagctacctgtggagctgcacactgcctgccacttcaatcttgaggaatttttttctctgccctccatcaccatttttgcttacctaccatcttcagaatcacacctcttgtctccctctctagcatatctccctcaatcagtgttggcttatgagttttaacagttctgaaaatacatttactttaaacaacttctattttggcttgtattacaactctaccaagaataaggcaacgaaaggccaggaaactcttaggtggtggtgtaggtctaagggcaggggtaggcagggttgtgtttatgcaaagaagagaaaaagatttgtcacatttagtatcattaatacatataatcatttataattatgtatattaataaattacttataattaataaaaataaa

SEQ ID NO: 8172 - DNA, 9525 bp, Homo sapiens; identical to SEQ ID NO: 8161

SEQ ID NO: 8173 - DNA, 9525 bp, Homo sapiens; identical to SEQ ID NO: 8162

SEQ ID NO: 8174 - DNA, 2731 bp, Homo sapiens; identical to SEQ ID NO: 8163

SEQ ID NO: 8175 - DNA, 12390 bp, Homo sapiens; identical to SEQ ID NO: 8164

SEQ ID NO: 8176 - DNA, 392 bp, Homo sapiens; identical to SEQ ID NO: 8165

SEQ ID NO: 8177 - DNA, 2533 bp, Homo sapiens; identical to SEQ ID NO: 8166

SEQ ID NO: 8178 - DNA, 392 bp, Homo sapiens; identical to SEQ ID NO: 8165

SEQ ID NO: 8179 - DNA, 2529 bp, Homo sapiens; identical to SEQ ID NO: 8168

SEQ ID NO: 8180 - DNA, 392 bp, Homo sapiens; identical to SEQ ID NO: 8165

SEQ ID NO: 8181 - DNA, 392 bp, Homo sapiens; identical to SEQ ID NO: 8165

SEQ ID NO: 8182 - DNA, 1710 bp, Homo sapiens; identical to SEQ ID NO: 8171

SEQ ID NO: 8183 - DNA, 17495 bp, Homo sapiens
atcccaggccggggaccgcatcttctttgtgtctgctaaggaggtgctcaacgccaggattcagaaagcccagggcatgcctgaaggaggtaatgatgagaacagatgtcctccttttctctgatgtttgagacattttgtctcgtgctgaggagtctgtcagtagaaaatccttctgagaaggggatgctgagaagagcagagaggctcttgctctttagccagtggcttggtttctggggatttcatcgttttcctctgctgccaagttgtttctggactaatgcagtacaatcctcctagggggcgctctcgcagaaggctttcaagtgaggatgtttgagtttcagaattttgagaggagatttgaggtgagtcctctgattctggtatctggcgattctgtgcctccccagctcccattggctgtgtccctggcagtgaaaaccagagtctggcccttggttgtaggcccctggtggcccccacctccctccgtgcctctgtgtgttccaggagtgcatctcccagtctgcagtgaagaccaagtttgagcagcacacggtccgggccaagcagattgcagaggcggttcgactcatcatggactccctgcacatggcggctcgggagcagcagtaagagtccaagactgcagataggtggagagagctgccgagacaagggtgctccacccctgccttgggcagttaggacacgccttgatggcagggctgagtctctgggctcccatccagagccctttccctggccaccagaccatgttagaaccacatagacagcctggtgaggagggcggctgggtgcttcatcaccccacctggtctgtgcagcacgattccctgtgttggaggtcttggcccatgccctgctgagctctgcagccattctcagagcctgaacacatttttcaaaacaacattccagccaggagcagtgactcacacctgtgatctcaacactttgggagaccaaggcaggaggactgcttgaggccaggagtccagcccagataacatagtgagatcccatctctacaagaattttaaaaatcagctgggtgtggtggcacacacctgtagttccagctacttgggaggctgaggcaggaggatcactggagcccaggagttcagggttccagtgagctgtgatcgcaccactgcactccagcctgggcaacagagtgagaccctgtcactaaagaataatatgaaaacaccttgcttctatcacacagaattgactttctcagttgtttatgttaagttaaaattttaaaaagttcagttcccttttgattcttttgcacttgtcccagtgtcactctgccctgaggcaccataatcatgaatttacattgttctatcacccaaacagtactttttacataaatgctgaggaatatgtcaggtttttacatgcttcagatgtacagatgtggcatcacactgtctgtcactgtacctggctttgctttctcaacatcgtttttccctctatccttgttagtatgtgtagtttgtttatgaatcggaactgctgtagtatattccattgtgaatatgcctcattttcctatggatggaattttagattttttttttgctattggaaaccctactgcagtggacatttgttcatgtgtccccttgtgcacctttttaagagtcttcctggggtgagttcctaggggtgtggcaattctgttttagggtacacgcgtttccagttttagtcagttttcttgatgctcttcagaacagccgtacccattcattgcatgaccagtactgtccataggccttccatttcatcagccctcaccagaacttcagacctggtcatttttgccaggccttggtagaaaatagtgcctttaaaaatttcatttacaactgggcatggtggctcacgcctgtaatcccaacactttgggaggccaaggcggatggatcacctgaggtcaggagttcaagaccagcctgaccaacacggagaaaccctgtctctgctaaaaatacaaaattagctgggtgtggtggcgcatgcctgtaatcccagctactcgggaggctgaagcaggagaatcgcttgaacccaggaagtggaggttgcagtgagtggagatcgtgccattgcactccagcctgggcaacaagagtgaaactccatctcaaaaaaaaaaaaaaaatcatttctgtgattactagtgaggttgagcttttttccctatattaattggcagaatttgtttaaacccccttaaagcgccctccctgttttgtgcccaccacctgacccacatcgaagactgaagagtgcatggttggctgcagggtcctcttcttacctgggaaggggaaggccatgcccctgggtgcgtgtgtgcagccctgccaggcaagatagcgggcagggcggcgtgggatttctggcatcccctcttgctcctctgcttagtcagacaggaacatggatttctcaccagtactctgctttcagggtttactgcgaggaaatgcgtgaagagcggcaagaccgactgaaatttattgacaaacagctggagctcttggctcaagactataagctgcgaattaagcagattacggaggaagtggagaggcaggtgagaaatgaggaggaggcattctgggaagatttggactccgagtagagtccagaagaaagcagacctcctcctcttagggacttctcagcctttcagaagaaagttgtggccctgtttcaagaatacagagctgccgtttgggttccattgtcgggttgtgtgatgctgggcatgttccctttcctctggacctccacagatcatgtgggcgtttgatcagccagtttcccagaccctctcacttcagaggctttaattccatagaggagctgaggaggctgctggtttgagaggaaggatgtgccatctgctaggatctctcctggtgctgcaggagtgaactttggtcttccttgatacttaacagtgtgcttccttttgctgtaggtgtcgactgcaatggccgaggagatcaggcgcctctctgtactggtggacgattaccagatggacttccacccttctccagtagtcctcaaggtttataagaatgtgagtcatggagcaacaggtcctcttggcaggaggcccccaaaagtgattcaacccctgttggtctgggtcagggccccccagcagtgacagtagaagccacagagacaaggcccaggcttccgtcagccttctggggtcacctggtggatgtggcctgaagggaattttgatggacatgcttctcttaacttccctcttctggtggcaggagctgcaccgccacatagaggaaggactgggtcgaaacatgtctgaccgctgctccacggccatcaccaactccctgcagaccatgcagcaggacatgataggttagtgcccatggggaactgggcagctgtggccctgggctgcccaaagatcagatgcggaggccaagctaaagaaatcaggactttccttatctgtcacttttcatgatgattcaactcgataccttcaggttctgggtacatgttctgaactcattcttgtttgctttttgagacagagtcgcactccgtaacccaggctggagtgcagtggcatgatcttggctcactgcaacctctgccaccgaggttcaagcgattcttctgctccagcgtcccgagtagctgcgactacaggcgtgaccaccacacctggctaatttttttgtatttttagtagagatggggttttgccacgttggccaggctggtctctaactcctgacctcaagtgatctatctgccttggccttccaaagtgctaggattacaggcatgagccaccggccctggccttgtgaactcattctgtacacagggttggggagcccatcttgttctactacatgggtctaccctaggctgagaattgggcctgctcctttaagtccacgtgaggcataagtgttagcagtatggcatctgagtccacacttgcctgggagagctggcctcaagtgaggcatgctcagtctcacgggccaacttgactggggtgtggttcccaggcaaagctgttcagcatccctggcagtagctggtagagccctgtctccaaggcttggtgccgctgtggtgcagggctgagctgataagcttttcctccatttctcttcctgacagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggcaagcaaagttcctcacctcaagggcattgtggggggtcagtctgtaccctgcctccagacacgggaaccattctaaaacgggggttccctaaggtcagcagctgtggtggtgtgccccaccacacagtacaccacagacagaatttttgctactgattgacctggatttgttctaagcagtgatatttgtgaaatgacagatgctagtatttttctctaatacacattaaagtaagtatgtaactattaaaaatagacgactttaaaaataaccacctacatacgactattttaaagttcagattttaaaaacattcatctctaaaccacttgagttgtcacatgtactgccctctgtacacatcccacactcggggaagctgccaggcgggtcaggatggctcctgctcacattttgcacgtcccgtggtgctcacctgagggtctcctctgctacatctgaagctagttgtcccctttttgccttttggaaattgaagagccactctgtgtccctgttccccagactagggcaacactgagggttcacgtgaatgagagactcaatacgtccccctcacccctctcatgtttctctcctcaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtcagtgaccagttctgctcgggaaggtgggggcggagggcaggtgggcggggcctgagggctaggttcctgctgtggcccctgcattgggccacactccacagtccactgcatactttctcctctgtgattgcatggggagcgcttactccctcaccaagtttccctcacttcctgctggacatggtcccagaccttctggcctcggtgggatcaaaggagacattgaaagaggaactcagagtagaaacatgaaggctccttggctggggcccttcagatggccctggtagtgatgggccccagaggagggtgggccacagagaggctgcactccaggctgaccatgtgctctgcaggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcagtgagtggccctgtcggaccccagcaggggacttcctttaggcagggtcagccccatctcccttccccatctctcttcccacgtggcctggaagccactgggtcctaagcatcgtagaccctgggccttcaggtgtgcagggccagctttgaggccagtcatggggagaggggtctcccagggacactttgcgtcttgggctgggacggggtaggcctctgggccccttggtgaggaagaaatgggaaggcaagagatattcctagtaggagttttagaggttgccttgaagagcttgggctgtggatgtagttttgaagtttttgaacccagcctgatcttcgtgcacatcttaggtcaggtgggaatctattgcctaatctggggtggtggggatgaatatcctcgcttccttttttttattgtgtgtggcagaccctttgctctagacattttgcacctaattatttctctgactcttggaggtagatgttgtcttatagccatctcctttttctttctttcttttttttttaattgatcattcttgggtgttttggcagggtcataggacaatagtggagggaaggtcagcagataaacaagtgaacaaaggtctctggttttcctaggcagaggaccctggggccttccgcagtgtttgtgtccctgggtacttgagattagggagtggtgatgactcttgacaagcatgctgccttcaagcatctgtttaacaaagcacaccttgcaccgcccttaatccatttaaccctgagtggacacagcacatgtttcagagagcaccaggttgggggtaaggtcatagatcaacagcatcccaaggcagaagaatttttcttagtacagaacaaaatggagtctcctatgtctacttctttctacacagacacagcaacaatctgatttctctatcttttccccacatttcccccttttctattcgacaaaaccgccatcgtcaccatggcccgttctcaatgagctgttgggtacacctcccagacggggtggtggccgggcagaggggctcctcacttcccagaaggggtggttgggcagaggcgccccccacctcccggatggggcggcggccgggcggaggcgcccccacctccctcccggacggggtggctggccgggcgggggctgaccccccccacctccctcccggacggggcggctggccgggcggggactgaccccccacctcccggacggggcggctgctaggcggagacgcttacttcccagacgggggcggctgcctggcggaggggctcctcacttctcagacggggcggctgccgggcagagacgctcctcacctcctagacggggttgtggctgggcagaggcgctcctcacatcccagacggggtggtggggcagaggcgctccccacttcctagatgggatggcggccgggaagaggtgctcctcacttcccagagtgggcagccgggcagaggggctcctcacatcccagacgatgggcggccaggcagagacgctcctcacttctcagacggggtggcggccgggcagaggctgcaatctcggcactttgggaggccaaggcaggcggctgggaggtggaggttgtagcgagctgagatcatgccactgcctgggcaacattgagcactgagtgaacgagactccatctgcaatcccggcacctcgggaggccgaggctggcagatcactgccggttaggagctggagaccagcgcggccaacacagcgaaaccccatctccaccaaaaaaatacgaaaaccagtcaggcgtggcggcgcgcgcctgcagtcgcaggcactgggcaggttgaggcaggagaatcaggcagggaggttgcagtgagcagagatggcggcagtacagtccagcttcggctcggcatcagagggagaccgtggaaagagagggagagggagaccgtggggagagggagagggagcgggagagggagagggccatctcctttttcaaaatcaagaaactgagatttgaaaaatagtgacgtgtcctctgctactcggctgatgagcagcagagtcaggatctcttgtgcccaaaccagggtgcacagctctgtgctgttgcttctcaggccgtggtgatgctgagtgtgtttggttgttatgattattcagtctcagcagggtgtaggagattctgccaaaccaggcctggctcagggcagagctgctggcagggatatagacaggcccagctgctccctactgtgggtgggctaagccaccagtggcatcttgctccacacaccccaactgggtcccttctctctcctccccagggaactgtctgggacctttgctcatctgtgtcagcaagttgacgtcacccgggagaacctggagcaggaaattgccgccatgaacaagaaaattgaggttcttgactcacttcagagcaaagcaaagctgctcaggtgaggctggcccgtgtggccaaaggttagggctccagggtgcagcccaggcacactggggctcagctgctgggcttgcgtcttgggtgtggacacaaatttttctggtggggatttagctcattcgtgttagatgtgtaccatgggctgggcacggtggctgacgcctataatcccagcactttgggaggctgaggcaggtagatcacctgaggtcaggagtttgagactagcctgaccaacatggtgaaaccccgtctctactaaaaatacaaagattagctggtcgtggtggtgtgtgcttgtaatcccagccactcgacaggctgaggcaggagaatggcttgaacccagaaggcggaggttgcagtgagccgagattatgccattgcactccagcctgggcgacaagagcaaaactctgtctcaaaaagaaaaaaaaaatggatgtgtaccacgtacctcatggatgccagatggtgctggaggctcaacaagacacagcgtcgctgccttcaaggcacttgcagttgaaggcatgatggcatcacagtactgcgagactgcagttcacagcgccctgtgctgaaccgcagggcctacagcgcttaacatgtgctatttcactcagtcttccctatttctccattttctacatagaaatgttggggaacttgtctggcatctcaaaaaatggccaggctaggaggggagcccaggtgtacttggctccagcagcccccgcactctgattctccttacctgccactctttggacccatgaagagggcatagccccccatttacccacagagaagctggttacttggctggggactggcagagctgggattggaactcagatctccatggggtctctgtggagctttcattaataatttgctggaaagaacatcagtctgaggagtctggagtcctgggttctctccagccactcatgtttggcccaagctcttaactctcctgtgtctcattattttcatctgtaaaatgggagtaagatttcatgacacagctgcatgactgaatgtaaaagtgccctgcaaaagtcctcggcctgcccagctcatgataacatcagcacacggggaccctgcagaagtcctcggcctgcctagcccatgatagcatcagcacacggggaccctgcacttcctgccctcgcccctgacgtcagagtctgcagggtggcagagccagaggggagatggatcagagggtgtcagctccaaccctcaccggatcactgggctttccctgccctcgactgcggatgtgccccccccgcacccccacctggggacagctgcttcctagggacacactgcttgccctctggggactctcagaaagggggaatggggggaactgctgcttgtcagccacagtgacacagctgaacctggaaagggtctcctgtcagcacctcaaccccttgcttggcaagcagggaaactgagttcccgacagctcagggacttgcacatggtcctgggtgaaggaaacacagggcttgagaatcagaaaagcctaacttgtagctccctggcttattagccgtgtggccttgggaagttatttaacccctctgggcctccttttccccatctgtgagacagggataaacacgattgttggaggatgatgtaagggtgtgtgtcaagcgtccttaggatggtgcctggcgggtagtcctaatactgcctatcatcagctatcatggttacaaaagaaccatttctttgcaggaataaagccggttggttggacagtgagctcaacatgttcacacaccagtacctgcagcccagcagatagtgggcacctgaggcggagtctgcgtggagaggggcggtgctgccagccctaagtgccatgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaatcctttgtgagatctgtctttttgggttcttgtacaaactcctctttgacatggccagctgtattctgaagtgaccataactttggggaagttcccactataatctggctccttattcttggaaggaatttgatactctcaaaagaacagatggtttaactgatctttaaggatcaggaaatcgagactgatttctttacagatttctctgtaactccagaccatttttcacttaaaaagtaaatgactcactgttccatcctgctttgccttctgagaatttggttgccactattcttttttttttttttcttttttgagatggagtcacgctctgtcgcccaggctggagtgcagtggcacgatctcggctcgctgcaagctccgcctcccgggttcaagcagttctctgcctcagcctcccaagcagctgggattacaggcgccgaccaccaggcctggctaattttggtattttagtagagacagggtttcatcatcttggccatactggtctcaaactcctgaccttgtgacccacctgcctcggtctcccaaagtgctggcattacaggtgtgagccaccgcttttttttctttttttttttaagggtcctcaggagtagatacaggggtagtcagtcagtttccccgcccctacagctgtcctcttggctctggtgctgcccagtgtccgccctgctcgcccacagaggccacagctcagctgatagcaacctcatccttccagattcccaggctacacacttggggcatcaccctcgagtccacggtcacacgtgctgcaccaaatctgtcacctgctgtcttccaagtctgttgaccctgcccagtttcctcacctccatcataaccatcagcccggatctaggttcctgttcctgccttgtccccgcctatcctcgccatcttgtggctgtttcaaggcagcagccaaagactttctcaggtaacaaaaaaaaaatgaatcattaccttttttttttttgcaatccacaaaacaagtagtttctgtcattaacaagatgttatgtacaacccactaaattgttcacgacagcatcatcccgggtgatgagccatagtttgaaaaagggccttcttgccttatgcaaatgctgcttagttattcccagtcaaggccagcctcattcctgtgctttctctgactacctcatctgtccactggcgaatctgagaggctggaagttttagccctctggtaacaatgtccctatttaatcacaaaaagtaggtagtcaggaatgttccactgtgtcccaagcactggggtgacagcccaggcagctctctcggagagcatctggcttcataatgtggcctcagaagcagggccctcctcgcagatgtcagctaagttgttcaccgtgtcctcaagtggatggtttcctgtgtctaagtgggactcttaggcttgagataagaacagcgaactttgagagtttagtatgtcagacatttcatacgcatgagccctaatctcaaaatccaatggtctattttccctaatttcctcaaatgaggaagttcattaattcagcaaaatatttgtgcacttactatgtgctaagcatggttctaagcactggagatatagcagtgactaaggtggataaaaatctgcccctggggccagacgcgatggctcacgcctgtaatcccaacacttttgggaggtgggcggatcacgaggtcaggagttcaagaccagcctggccaacatggtgaaaccccatctctactagaaatacaaaaattagccaggcttggtggcgtgcacctgtaatcccagatactagggtggctgaggcaggagaattgcttaaacctgggaggtgggggttgcaatgagccgagatcacgccattgcgctccagcctggcaacagagggaggctccctctcaaaacaacaacaacaacaacaaaaatctcactcactgattagtaacctttttcagttacaaagaaaaacaacatactcgctaaactccctaacatcaggagccatcaggcaaattatctcaagtcttgatttacaaaccaaacccttatgcctctgattacacaggggaccggtctgacaaactttttttttttttttgaggtaggtttttgttggctggagtgcagtggcgcaatcacggctcactgcagacttgacctcccagactcaagtgatcctctcaccttagcctcccgaatagctgggattaaaagtgtgcgccaccatgcccggataattttttgtttttttgtagagacgagggatctcactatgttactcaggctggtttcgaactcctgatctcaaatgatcctcacaccttggcctcccaaagtgctgggattataggtgtgagccaccatgtctggacacaaatattctttttctttttttaatttaatttttcaaatagagaatgtatgttggctgggcacagtgcctcatgcctgtaatcccagcactttgggaggctgaggtgagaggatcgcttgaattcatgagtttgagaccagcctgggcaatctggcaaaaccctgtctctacaaaaaatacaaaaattagcccagcatggtggtgtgcactggtagtcccagctattccgggggctgaggtaggagaatcacttgaacccaggaggtggaggctgcagtgagccgagattgcatcactgcactccaacctaggcaacagaatgagaccccgtctcaaaaaaaaaaaaaaaaaatagatgggatcttactgtgttgcccaggctggcctctaattcccaagctcaagtgatcctcctgccccagcctcccagagtgccggaactacaggcatgagccatcacacccagccaataaacattcttttctgataagcaactgcagaacttaagccagtttcagccagcttacagaagctgtgaacaacctgtttagccaatgcacatgagctcacctcctctcataaatatgtatacagcttttccctcaaacctgctaaatatgtatgaatatgggccctgtgaggcataaaacccaacctgtcctttctctcttggaagagagcaccttcagtgcatgctgcaaaccatctcttcctggtttgcaaacaagtatcaacaataaagtgctcctttctactatttagccaccctggtgatcttctagacaacattatgcgtatttctgctaggaacattagtgttcaaatctctgtgtaggcagatgttttcattttttgtaggtagatatctcaggctggacttgctgggccatatggtaaatttatgtttaacttctacagattttgtgaagtggttatactgtcttatatccccaccagtagtgaatgtgggttcatatatatatatagttttttttttttttttttttgagacagtcttactctgtcacccaggctggagtgccgtggcacaatcgcggctcactgcaacctccgcctcccaggttcaagccattctcctgcctcagcctctcgagtagctgggattacaggtgcccaccaccacacccggctaatttttttctatttttaatagagacggggtttcaccatgttagccaggctggtttcaaattcctgacctcaactgatccgcccgccttggcctcccaaagtgctgggattacaggcctgagacgtcgtgcccggcctcatttcattttttagagcatcacaaactacctctccagctcatcttgctagagttactgcataatccatgcattcctgccaaggatcagccatcttcttgagtcggagggcttcctgctagctcggtgcctggtgttatcaccctcggctcttctggaggtagaggggctacctatcttcttttcattcttttttttttttttttttaatttgagacagagtttcactcttgttgcccaggctggagtgcaatggtgcgattttggctcaccacgacctccgcctcccgggttcaagcgattctcctgcctcagcctcccgagcagctgggattacaggtatgcgccaccatgcccggctaattttgtatttttagtagagacggggtttctccatgttggtcaggctggtctggaactcccgacctcaggtgatccgcctgcctggacctcccaaagtgctgggattacagacgtaagccaccgcgcccagccaatttttgtatttttagtagagacggggtttcgccatgttgcccaagctgatcttgaactcctgacctcaggtgatccacccgcctcggcctcccaaagtgctgggattacaggcgtgggccactgcgcccggccccagtttttctaagttatatagtttaggtttcacaactagatctatgatccattctaggttaatttttgcatatgggtttcttttttttttttttaggatgagtgtgtggatatccaattatacctacaacatttgttgaagacaccatctcttcttgttttcccaagtttccacacacattattgataaaataaatttttttggggggggtgctgggtgtcgctgggctgtaactccttacctcaagccatctgcccacctcggcatcccaaagcgctgggattacaggcgtgagccaccgccccgggccgaaggcattatcctttctccactgaattgcactttcatttttgtcaaaaattaattgctcacatatcggaactctattctgttgcattgatccatttgtctacctggacgccaataccacactttctttcttttttaaattaatttatttattgagacagggtctctcagtcagggtggagtgcagtggtgcaatcaaagctcaccacagcctcagcctcttggactcaggtgatcctcccatctcagcctcccgagtagctggactacaggtacgtgcctggctcattttttgtagagacggggttttgccatgttgcccaggctgggtatcttttttttttttttcttttttgagatggagtcttgcgtcttgctctgtcatccaggctggagtgcagtggcgcgatctcggttcactgcaatctctgcctccctagtagctgggttcaagcgattctcctgcctcagcctccctagtagctgggattacaggcgccggccacctcgcccggctaatttttgtatttttaggtttactggcgtgagcaaccgcggccggccccaatactacactttcttgtttactgtgtagtccttatcttctggcgcaaagcgggcactcgctaaaaacctgaatgaaagtataaagcaggccgggcgcagtggctcatgcctgtaatcccagcattttgggaggccggggcgggcggatcacgaggtcaggagttcgagaccagcctggccaacatagtgaaaccctgtctctactaaaaatacaaaaaaaaaaaaaaaaaaaaaaaaaa

SEQ ID NO: 8184 - DNA, 12580 bp, Homo sapiens
aatcaagacggccggccgaggcccctggaacggctcaggcggctgcggctgctacggcggcgcatgctaggggattctgccgggtgagtgctgggcggcaggactggggtggggcggaagggctcggcaggaggccccacgtgcattcccgcgaggggctcgggggccgcagtggaaaagaagggtaggctgcatctgcctctgcgggggtcccgcctcggcgtccgcccgctcgccctctgttacttctgcggccccggtgtttctggagcgtcgctttcccggtgtctccgctcagcttttccctttccaaagcgcggccggggccaggggagggcaaggcctgctgtgccctttgaccccgtgcgaaaacggcgaccctctgactataggggtgtggcccagagccacttggccagttaggggtgggggccgggatctttgtcctgcggatcaaacagttggcccctctggactgcatctccgtgccccccggccctgcggggtaatatacgtgtgtgggggaggttccggggtagtcggctactctgtgctccagaccttgcacccgatcctgaggatccttggaggtggggggcaagggctgggaggaggaggcggagttttcccaggctcccccacacttccagggaaaggctttccaagaaccctgaactcatggaccctggagtcaaattttggttcagatctagcctcttgctagctgtgtgacttggggcaagttgcttaacttccctgagctttggtttcttcatatgtaaaaagaaagtgaaggaggaagggagggcaggaaaggaggaagaatcccttttgaagcctgatttgtgttggactcaccagttataaagcaagcttgtccaaaccactgcccaggaggcggaggttgcagtgagccaagaaaaaaaggaagcatgcccttgccccagccattttggtaataatagacgtttattgaatgcttactgtataccactgtaagcactgtattaagtaagcactgtactgagtgctttgttttttgtattttgtgtgtgtgtgtgacagtcttgctctgtcacccaggctggagtgcagtagtgtgatctccactcactacaacctccgcctcccaggttcaagcgattctcctgcctcagcagcctcctgagtagctgggattactggcgcccaccaccacacccggctaattgtttgttgttgttgctgtttttgagacggagtctcaccctgtcgcccaggctggagcgcaatggtgcgatctcggctcaccgcaacctctgcctcccgggttcaggtgattctcctgcctcagcctcccgagtagctgggattacaggcgcgtgccaccacgcccggctaatttttgcatttttagtagcgacgaggtctctcgccacgttggctaggctcatctcaaactcctgacctcaggtgatcctcctgcctcagcctcccaaagtgctgggattacagacgtgagccacttggcctgttttttgttttttttacagtgatgcaaccatggctcactgcagcctgggtctcctgggctaaagctatcctcctgagtagctggggccacagacaagtgccaccatggccagctaattaaatttttttttggccaggcactgtagctcatgcctgtaatcccagcactttgggagaccgaggcaggcggatcacaaggtcatgagatcgagaccatcctggctaacacggtgaaaccccgtctctactaaaaatacaaaaaattagctgggcgtggtggcaggcgcctgtagtcccagctactcaggaggctgaggcaggagaatggcgtgaacccgggaggcggagcttgcagtgagccgagattgcgccactgcactccagcctgggcgacagagcaagactccatctcaaaaaaaaaaaacaaaaaaacaaaacaaaaaaaaatgtttctacaaatgttgtccaggcttaacatgctttctttaattctaacaacaatcgtatgaggtagatactgttgtcgtccagcagatgaggaaactgaggcacagagaagttaaataacttgcctgaggcagtacagttaaagagtgtcgaatgggggtctctggcaccacagggcaccctactgagccccgtgtcctgctgtcttgacttcaggtagaagagctgggcctggaacccagccctgaggacatcctgcggcccaggggcaagtgacacctgctgagagaggcccaggatggtggaggctgaggaactggcacagctgcggctgctcaatctggagctcctgaggcagctgtgggtggggcaggatgctgtgcggcggtcagtggccagggcagcctcggaggtgcgtgcccgccttgggaaccccagaggaaggggctacctgaccttcaggccagcatccaggcttctgggctcatcttgttcaatacacccattttactgatgatgggacattgagggctggggagggaagagactggccttggtcactgctgaggccggagcaggatgaggatgcttgccttggtgcctggcgtaggcccggtgggtaggttctggcagccactccctgggtgacccggcccctctctccagtcaagcctggaatccagcagcagctacaactcagagactccatcgaccccagagacgtcctcaacttccttgagcacctcctgcccacggggccggtcctccgtgtggggcccaccagatgcctgtcgaggggacctccgtgatgtggccagatcgggggtggcctctctcccacctgccaaatgccagcaccaggagtccctgggccgaccgagaccccactcagcaccctcgctgggcacctcaagcctgagggacccagagccctcagggaggctgggtgatccaggaccccaggaggcacagaccccgaggtccatcctggctcaacagagcaagctgtccaaggtaacgtgggagagcgggacatctgctgatgggaggagcttccttgggcctcagtttccctatctgacacatgtgcttgtgggtagcctcccttgcagaataagaggctcctgggagatactgtgagttgggtcttgctcagcctaaatgctcgctaggtggtagctgtgagtatctcatacagtgctttgagaagaggccaggatttgttcacagccacacataaagtggggccaaacgtttcccttcttgctcttgtgcccttggctgagccctgggctgcaagtcagggtgtaagttaagacacagtctctctgtccctcgaattgcggcttcctctgggccaggcctcttggcttagtccttgtccctctgtgcttccttcctcagcccagggtgaccttctctgaggagtctgcagttcctaagaggagctggcgcctcaggccatacctgggctatgactggattgcaggtaaggcgtgctgttgccctgcacacactttgcctgggagtgggaggtggaggcctgggatcctccatgctcctgtctgagcctccacccggtgctgttgcttgtttctctgaccgtgccatcctccgtggggagcaccctcttttttttttttttttttttttgagacggagtctcactctgtcccccaggctggagtgcagtagtgtgatgttggctcacagcaacctccacctcccaggttcaagtgattctcatcccttggcctcccgagtagctgggattacaggcgagcaccaccacgcccggctaatttttgtattttaagtagagatggggtttccctgtattggccaggctggtctcaagctactgagctcaagatatccacctaccttggtctcccaaagtgctaggattacgggagtgagccaccgccccccacagccaccttctttgttttcttatttatttatttatttatttatttatttatttatttttgagatagtctctcgctctgtcgcccaggctggagtgaagtggcgcaatctcggctcactgcaagccccgcctcccaggttcataccattctcctgcctcagcctcccgagtagctgggactacaggtgcctgccaccacgcctggctaatttgtttgtatttttgttttttttagtagagacgggatttcaccgtgttagctcgcctcagccttccaaagtgctgggattacaggcatgagccaccatgcccggctttttttttttttttctttgctttttaagagaagacaggccgggcacggtgactcacacctgtaatcccagcactttgggaggatgaggtgggcggatcacgaggtcaggagtttgagaccagcttgaccaacatggtgaaaccccgtatctactaaaaatacaataattagccgggtgtggtggcacgggcttataatcccagctacttgggaggctgaggcaagagaattgcttgaacccgggaggcggaggttgcagtgagccgatattgcaccactgcactccagcctgggtgacagagtgagactccgtctccaaaaaataagcaagcaaaaaaaaccagatgagcagcagtgagaagaagggggaaagagtagaacaaagagtttggtctgtcactgactgtgagtatacaattgcgataactcactaccttcacgccagcctctgagcaccttctgagccgtatctgctctctcaacctcaggcactgagacggtgcatctgttgaatgaatgaatgagtcccagctgccgtatgtttgaacatttgttatgtgccaggcccctgcacaacttcataccaatgccagctcttttcacgttattgtccagctctccccgacagcaacctaacctcagctgccttctggctggtttccccctggcctatgtcccattgctgtcctttgcatgtgtatgtgtgtttgtgtaaatacataacataaaatttaccactttagcattttttttgagatgaagtctcactcttgtcatccaggctagagtgcaatggcgtgatctccgctcactgcaacctccgcctcctgggttcaagcgattcacctgcctcagcgtcccgagtagctgggattacaggtgcctgccaccacacccggctaatttttgtatttttagtagagaaggggtttcaccatgttggccaggctggtctggaactgacctcaggcgatccgcccgcctcagcctcccaaagtgctgggattacaggcgtgagccactgctcccagccacatgtagcgttttttaagtggactgttaagcggcgtcaactatgtctacactgttgagctatcattactaccatccacctccagaactttttcatcttcccaaaaacttctctccccattaaataattactcccattccccctccctccagccctggacagtcaccattctactttctgtccctatgaatttgactcctctagggacctcatataagtgaaatcatatagcctttgttcttttgtactggcttattttatttaacataacggcctcaagatttattcatgttgtactgtgtgtcagaattcccttcctttttttttttgttttttgttttttgttgttgttttttttgtttgttttgagagagagtcgcactgtgtctcccaggctggagtgcagtggtgtgatctcggctcactgcaaccttcacctcccgggttcgagtggttcttgtgcctcagcctcccgagtagcaggtattacaggtgtgcgccaccacacccagctaatttttgcatttttagtagagatggggtttcactgtgttggccaggctggtctcgaactcctgcactcaagtgattctcctgcctcggcctcccaaagtgctgggattacaggtgtgagccgctgtgcctggctggaattcccttcctttttaaggctgagtgacattctgttgtgtgtagatgccacatgttgtttatctgttcattcagggatggacacttgggtgctttccatctcttgactgttgggaataatgctgctggtgacatggttgtgcactgtcacttttgacatagcagccagagggaatttttaaacatgggaatcagatcatgtcactcccctactcaaacctccccatgggcttttcccagcacttactgtaaaatccaaaatccctatctagacttacgaggcatgatctggcctctactggccccatgatgtgacctcccgtctttcttccagcctcgcggcctcctccttttttatttttatttgttttctctgttgcccagagtcaagtccagtggtgttatttctgctcattgcaacctccgcttccttggttcaagcaattcttcctcagcctcccaggtagctgggattacagacgtccactaccatgcttggcttatttttgtatttttagtagagacggggtttcaccatgttggccaggctggtctcgaactcctgacctcaggtgatctgcccgccttggcctcccaaagtgctgggattacacacataatggggtggccacaggcatggcaggaccagaaaggaggccacgaccaggcatggtggctcacgcctgtaatcccagcaatttgggaggccgaggtgggcgaatcacttgaggtcaggagttcgagaccagcctgagcatcgtggtgaaactctgtctctactaaaaatacaaaaattagccaggtgtggtggcgggcacctataatcccagctactcaggacgctgaggcaggagaatcatttgaatccaggaagtggaggctgcagtgagcagagatcaagccactgcactctaacccgggcgacaaagtgagattctgtctcaaaaaacaaagacaggtgtactgtggagttgctgagagcaactggtggcggggacacaggccctgcccttgagtacttcttgaactctcagctcactgccctccttcctggttctgggaaaatggaagcgcctgtcccagtacctgctcttggtccatgcgctctgctcccctgcctttgccgaggtgactgtccatgctgccacctggaccctggccctgctccagcgtgctccgcccctctgcttctggctcctccagggtttccttcctgtgatcctctccctctctgtcctgcatcctcatcctgccccttagcatgagcatgaacgtgcaggaagcattctgggagctggttgtatctcatgctccctgcaccaggcaccgctccgagctgtgcttcctgttcctcccgctgactcctttgcccttcatgataagcttattaggtaggcaccaccatggtgcccattcacagatgggaaggctgaggcccggtgagacagaatcttaccagcagctcacatccagtcggggtaaagccgctgtctgttatttctcatcccgatgccacattcctacctttagcccacatttgcttccagtgactgcctgttttctcgataacaaaacttcctcttcaaaagggctgtctagcctcgttgccttcaatttctctccactactattccttttctttttctttttttttttttttttgagatggagtctcgttctttcacccaggctggagtgcagtggagcagtgatctcagctcactgcaacctccgcctcccaggttcaagtgattctcctgtctcagccacctaagtagctgggattacaggcatgcaccactacactcagctcatttttgtatttttagccagagacagggtttcgccatcttggccagtctggtctggaactcccgatgtcaagtgatctgcccgccttggcctcccaaagtgctgggattataggcatgagccactgtgtccagcctccactactatttcttaaatcgggcttcagctcccagcatttcatcaacatggccctcagttgggtcatcagtggcctccgtggtgccaactccccagcttagccctcatccacatcttcctttgagtagcaggggacacagtggtcactcctgaagcactttctcccctggacttccagccacttgcttcccggttctcccccatctctgttggtgctccttcccaggcttctggggaaggaaaggtccttgttctgactgctacacccctaggcctgggactcggtcttctgactcctcctctctatcttccctctatgatctcccaaacgctgaggtgtttggacactttctctacttctccatttgtatctctagcccgcacctctcctccgaattccagacttgtatatcccactgtcttctccacatcaccatgaagttattaaccttctgtccgaaatcaaggtcctgatttccactgctgtgctcctcctgcagtctttcctgtctccataaatggcaactccaaatactaaataggtcaggccataaacttgctggatttaccatccagctacatcctgatacacccaacataagttgaaaatactgtttaggccgggtgcggtggctcacgcctgtaatcccagcactttgggaggccgaggcaggtggatcaggccaggagtttgagaacagcctggccaagatggtgaaaccccgtctctactaaaaatacaaaaattagctgggtgtggtggcgcacgcctgtaattccagctctgtaggtggctgagacatgagaatcgcttgaacctgggaggcagaggttgcagtgagccgaggtcgctccactgcactgcaccctgggcaacacggtgagattctgtctcaaaaaataaaaaaagaaacatcctaagtcgaatcatggtaagttgggggctgcccctacctctccccagctgaatcctaaccgatgcctctgcttcccctcaacttgaagcagccagaggaggagttctgtaaaaatatgtggctgatgtggttgtgtccctcccattccccagaccctccctgggcttcttaacctcatctcctccaccctcgctgccttcctgccactttcccctcctggctgttcctcagctgaaccatgcacatgcccaccccggggcctttgcgcttgctctttcatctccctgcgatgtccttcctgggaggtctctgtggcttctccatgtctctgctcagggtcatctcactcggagaggccttccctggtatggctgcccggccatactaggctctgacgctgctctcttgctttctggcaggtatcagcattcagtcttgtatcacgggtttttttttttttggtggctagttcatctcttgccaccttacagtgtaagcctcattaaggccaggggctttgtctgtctagttcctggcacatgaaacagcatctagccctgtcataagggctctgtcgatattttttccatggatggttggctatgcatcagggtagacagacactgaaaccaaccaacagtcccagtgactggaggggccctcctggcctgtttgaggcacagtagggatgaagcaggtggcctggggtgccagggctgatcgtctctccaagccttggccggtggccacacagcagcccccagcccctctcccgtcagctgcctggtgctttgcccacaccagggtctctggacaccagctcttccatcaccagccagcctgaggccttcttctccaagctgcaggagtttcgggaaaccaacaaggaggagtgtatctgcagccatcctgagtgagcaggggcgggcgagggtgggcgagggcggctgagcggctccatcccccggcctgctcatccccctcgccctctcagaccccagttgccaggcctgcgtgagagcagtggcagcggcgtggaggaagaccatgaatgtgagtgcgggccctcggctaggccgctgagtagtccagcctcgcgctgccctggcctcccctgccccagagcagtcccatttgaggtttggggcctggggaggcccctgagatgttgagactcatggagggaggcctgcagtctggacagggtggccaagccctggtaggggtggagtgagctaaggcctggccaccgaattaggggctgccctgtgtggcaccatcccaccctccccagcagtgcccctgtgctggtgggactccatcccagctcctgagggccccaggaggatgtccctccccaccccttagggcgtgggccccaggttctgggaggaaaggggttaggaggaaatgggccgaagggcttcccagagggattggcagcttgtgtggttgggggccgctgagggcagcacggagcctggggacctgggttcctggctcagggagagctgtggcttctcatgggcctcgcaggcgtgtactgttaccgtgtcaaccggcgcctgttcccggtgcctgtggatcccggtaccccctgccgcctgtgcaggacaccgcgagaccagcagggccctgggaccctggcgcagccagcgcacgtcaggtgagtgaccagagtattgggacaccttgggggacagagcctgaaccactggttttaagaaaagatgggcctgggcgtgggcccccaaccgctgggaggctcctcaggggtcccccactgcccccctgcgcagggtgagcatcccgctgtcgatcctggagcccccgcaccggtaccacatccaccggcgaaagagctttgacgcctctgacacactggccctgccccgggtgagcagccacgtggggctggatggtgatgagggcggggctggctcagactggcccagatccccagggagggtcacagagcgagactgggctcgacaagggtgagcgcccaagtctctggagcacagcctgggcctcttccatcacccacacctgtacctaagggaggtaggacccccgctccacgtaccccggtgcttccagggtgatctgcctgcaggctggcatgacatgaatgggtcctgtttattgcgcttttgtgtactgcaggcacagtccttagggggcttatctcatggagcccccacagcagccaggagtgtaggcactgctgtacccccaccctgcaggtggggagaccgaagcagagggggaggcgccttggtggaggagctgggattcgaacctaggtctctgtgctgctgctgctgctttttttttttttttttttttttgagaccgagttttgttcttactgcccaggctggagtgcattggcatggtctcagctcactgcagcctccactgtagtcccagctacttgggaggctgaggtgggaggatcgcttgaacctgggaggcagaggctgcagtgagctgagatctcgccactgcactgcagcctgggtgacagagtgagactccatctcaaaaaaaaaaaaaatgtcctttcctgtgtctccaggtcgggatggggtgccagtggcaactccccctgactcctaaattgagagtagggcagctggggtcagaggaggagaaggatgcagaggaaagtcagtttgctggtccgtaaaatggacataacagcgccatcctcagggatgttggtggtgaggtggggctgttgagtgaagcaatccatgcaggtgcttggagagcctacagcaggaagtaccctgtgaatgtcactgtcaccgtcctatcctcctcccatttcagctctcagggccccagggatggctggatctgccaggataagaaaggggagagctggggtagtcttgtgggtagacacaggccctgccttggtgggggcctccttcctaatggggggcacagttcctccctgatgggggtgtgcccagtcagcggggagcttgtcccaggtcaggcacttttaactccttgccttccacagcactgcctgctgggctgggacatttttcctccgaagtctgagaaaagctcagcccccaggaacctggacctctggtcctctgtctccgctgaggcccagcaccagaagctgtccggcaccagcagcccttttcacccggtacggtccagatcgcatcctagcctggggtgccccctagagggacagagacctcgcagcaggcctggggactgcagagcctcctggggggtaggattgaggtggggaggatggagcctgggagtgtctctctgcagggtccagccctccagccctgaccctagccatccctcggaactcctctgctccctgccgcctgccctgctccacccaggaaggccaccctgactgcaagatccaggagggaatgtggctggaactggggatgacctgtccctttcaagtggcccccctgagacttccctattccccatccaggcctcaccaatgcagatgctgcccccgaccccgacctggtcagtgccccaggtccctcggccccacgtcccacggcagaagccctgaggactgactcctgggggagaacagcattcccgccgcctccagcctctcccctctggcaggcgcacccaggagatggaatcccctgcccgcccagctcaggcccagctgtcctaggttgggcaggtgggtggacccaagcttgtctgctgcctgagttccagagagggaggaccctggggtggagggtgagggattctgtggaagtttgtaaataaagctcagtgctctgcagctcaagtcc

SEQ ID NO: 8185 - DNA, 34364 bp, Homo sapiens
caaggagatgccactcttgaacattccacaaatttagactcctcaccatccttaagttcagtgactgttgtgcctctgagggaatcgtatgatccagatgtaattcctctgtttgacaaaagaactgttttggaaggtagcacagccagcacctcccctgcggatcactctgctctccctaaccaaagtctgactgttagggaatcagaagtccttaagacaagtgacagcaaagaaggtggtgaaggtttcacagtagatacaccagcaaaagcaagcatcactagcaaaagacacattccagaagctcaccaggctactttattggatggtaaacaaggaaaggtaatcatgcctcttggaagtaagttaacgggcgtgattgtggaaaatgagaatattaccaaagaaggtggcttagtggacatggccaagaaagaaaatgacttaaatgcagagcccaatttaaagcagacaattaaagcaacagtagagaatggcaagaaggatggcattgctgttgatcatgttgtaggcctgaatacagaaaaatatgctgaaactgtcaaacttaagcataaaagaagcccaggtaaagtaaaagacatatcaattgatgttgaaagaaggaatgaaaacagtgaggtagacaccagtgctggaagtggctctgcaccctctgttttacaccaaaggaacggacaaactgaggatgtggcaactgggcctaggagagcagaaaagacttctgttgccactagtactgaagggaaggacaaagatgtcaccttaagtccagtgaaggctgggcctgccacaaccacttcttcagaaacaagacaaagtgaggtggctttgccttgcaccagcattgaggcagatgaaggcctcataataggaacacattccagaaataatcctcttcatgttggtgcagaagccagtgaatgcactgtttttgctgcagctgaagaaggtggggctgttgtcacagagggatttgctgaaagtgaaaccttcctcacaagcactaaggaaggggaaagtggggagtgtgctgtggctgaatctgaggacagagcagcagacctactggctgtgcatgcagttaaaatcgaagccaatgtaaatagcgttgtgacagaggaaaaggatgatgctgtaaccagtgcaggctctgaagaaaaatgtgatggttctttaagtagagactcagaaatagttgaaggaactattacttttattagtgaagttgaaagtgatggagcagttacaagtgctggaacagagataagagcaggatctataagcagtgaagaggtggatggctcccagggaaatatgatgagaatgggtcccaaaaaagaaacagagggcactgtgacatgtacaggagcagaaggcagaagtgataactttgtgatctgctcagtaactggagcagggccccgggaggaacgcatggttacaggtgcaggtgttgtcctgggagataatgatgcaccaccaggaacaagtgccagccaagaaggagatggttctgtgaatgatggtacagaaggtgagagtgcagtcaccagcacggggataacagaagatggagaggggccagcaagttgcacaggttcagaagatagcagcgaaggctttgctataagttctgaatcggaagaaaatggagagagtgcaatggacagcacagtggccaaagaaggcactaatgtaccattagttgctgctggtccttgtgatgatgaaggcattgtgactagcacaggcgcaaaagaggaagacgaggaaggggaggatgttgtgactagtactggaagaggaaatgaaattgggcatgcttcaacttgtacagggttaggagaagaaagtgaaggggtcttgatttgtgaaagtgcagaaggggacagtcagattggtactgtggtagagcatgtggaagctgaggctggagctgccatcatgaatgcaaatgaaaataatgttgacagcatgagtggcacagagaaaggaagtaaagacacagatatctgctccagtgcaaaagggattgtagaaagcagtgtgaccagtgcagtctcaggaaaggatgaagtgacaccagttccaggaggttgtgagggtcctatgactagtgctgcatctgatcaaagtgacagtcagctcgaaaaagttgaagataccactatttccactggcctggtcgggggtagttacgatgttcttgtatctggtgaagtcccagaatgtgaagttgctcacacatcaccaagtgaaaaagaagatgaggacatcatcacctctgtagaaaatgaagagtgtgatggtctcatggcaactacagccagtggtgatattaccaaccagaatagcttagcagggggtaaaaatcaaggcaaagttttgattatttccaccagtaccacaaatgattacacccctcaggtaagcgcaattacagatgtggaaggaggtctctcagatgctctgagaactgaagaaaatatggaaggtaccagagtaaccacagaagaatttgaggcccccatgcccagtgcagtctcaggagatgacagccaactcactgccagcagaagtgaagagaaagatgagtgtgccatgatttccacaagcataggggaagaattcgaattgcctatctccagtgcaacaaccatcaagtgtgctgaaagtcttcagccggttgctgcagcagtggaagaaagggctacaggtccagtcttgataagcaccgccgactttgaggggcctatgcccagtgcgcccccagaagctgaaagtcctcttgcctcaaccagcaaggaggagaaggatgaatgtgctctcatttccactagcatagcagaagaatgtgaggcttctgtttccggtgtagttgttgaaagtgaaaatgagcgagctggcacagtcatggaagaaaaagacgggagtggcatcatctctacgagctcggtggaagactgtgagggcccagtgtccagtgctgtccctcaagaggaaggcgacccctcagtcacaccagcggaagagatgggtgacaccgccatgatttccacaagcacctctgaagggtgtgaagcagtcatgattggtgctgtcctccaggatgaagatcggctcaccatcacaagagtagaagacttgagcgatgctgccatcatctccaccagcacagcagaatgtatgccaatttccgccagcattgacagacatgaagagaatcagctgactgcagacaacccagaagggaacggtgacctgtcagccacagaagtgagcaagcacaaggtccccatgcccagcctaattgctgagaataactgtcggtgtcctgggccagtcaggggaggcaaagaaccgggtcccgtgttggcagtgagcaccgaggaggggcacaacgggccatcagtccacaagccctctgcagggcaaggccatccaagtgctgtttgtgcggaaaaagaagagaagcatggcaaggagtgccccgaaataggaccatttgcaggaagaggacagaaagagagcactttacacctcataaatgcagaagagaagaatgtattgttgaactcccttcagaaagaagataagagcccagagacagggacagcagggggcagtagcacagcaagttattcagcaggaaggggcttagaggggaatgctaactcacctgcccacctgagaggaccagaacagacgtctgggcagacggctaaggatccctctgtcagcattcgctatttggcagcagtaaacaccggtgctataaaagctgatgacatgccacctgttcaagggaccgtggctgagcattcctttcttcctgctgagcagcaggggtctgaagacaacttgaaaaccagtaccaccaaatgtattactggccaagaatcaaaaattgctccttcccacacaatgatccctccagctacttacagtgtagctctgttggctcctaaatgtgagcaggacttgactataaagaatgattatagtggcaaatggactgatcaagcatctgctgagaaaacaggagatgataacagcacaaggaaatcattccctgaggaaggagacataatggttactgtgtcttctgaagaaaatgtgtgtgacataggtgagaatctgtacctaattgcaaattttaatatttacaaggatgattgtacaacagagtgcatttaggacagtcttccaaaagatggttttggttccagaaagataaaatatctataaatttttttctcatatcataatgttgcaaaataactctcatcaaacttgaaggtcaaacttctctaaaagctacttgtgtttaaaagtttaaagcctttggcccatttctcatgtgtggggagagaaaaagcaggaggctgaggcatgggaagtccacatgttatttacatgactgctgcaacttactaaacctttttgacctacaggttttttgtcaatcaaaaagaagaataccctaccacaacccaatgaaagcaatacattttttttttaccaccctcattttacaaacgaggaaatagggtcagaaaatttaaatagcattcatggtcctcgggtgacttttagaggaaaaatcagtttctgagcctccatttcttgttgtataaaatggggataataagacgggatgataatacaaaggcaaacacgattccaaccctcatctgatcataggtttgcagtatttgtttgttcagtctgttagttcctttgaatcaaaggagcatgttatttttaactgagcttatttttcaggtgaaatgagtttctagtttagaatatatttgaaagtgaaaagaaacatttttccctgctgacagattttggacagtgctggtcttttagaaatagttaataactttcaaagatattatctcagtcatgccttataccgtccaacttcagatactttataccagtccagattggagaaaagtggacagtgacactttaaagcatgacaattgcatagactgggattaagcacaggatgctgtaggaacaaaagggtcctcatgggctggacttgaagggacagaggaattcttttccactctggctatataaattgtagcatcctggacttttaactgaaatagaccttagccatcatctaacccagtctcaggaagctgaggctaatagatttagtcttgttcattatagagacttaggagactttaagaaatgctccaagggttgaaacaagtaactttacaagtttctgttgaatttagcctggagtaaattgaatgctccagaagtttttatgactcaatcattgctacaattactcattcctccttttttcctgaagaagtgaaaatagaagggtttccacagaagcttctacacaatctaaagaaggatataagaggcaagaccagagtagaactgaatctctgcacctgagaaaattttttctttttgtctacctcacagtttaactttgtgttcaatttttctgtgttcagtgtgaagcaagtaaagtgaatctgttaataaatcacctttactgagaatagaccttagtgactcagaatatttttaaggacaaacttgatggagatcactgcagaaaaatacttggaaatgaagatgtctccacagataatacttttgtcattctttctgggcagttatcttactgtgcaaataagaatttcactcacccaaaatgagcaaataatccctgcctttcatccagattcttttatacaacatattccttttgatcattttctactgacagcaaaataaaccagaaaaggaaggtgcaacagcatgtcagataaccacattccattactttttgaccccagatgtattttgcaagcaaattcttaaactgtactaaatggcttgaattttattaggcaatgaagagtctccattgaatgttttgggaggattgaaactgaaagccaacttgaaaatggaggtatggcttataattcagctgtgctgaactgtaagtgattaaatactgtttcatcacatatacacatatatatacttatgtggtatataggtcctgttctcattgtacttatgatatttagtgttgttattgccatatcctgtggggggaaagctaagaacctcagtaatcttagtaaatagtgctatcatcagttcatttactcaagccagaaacacaagagtcaccctcagtttctccgtcatcccacatttaatctatcgccatttcttacaggttccatttccaaaatataacatgagtccatctatttctgtttctacagtcatcaccctaggctaagccactacttcagtagcctctccattaggcttagttcactccagccctcctccagtgtgattcacacagtcctgcaggtagtcattagaaacataacttaggccctgtcattgctctgcttaaaatttgtggtggcttcccatcatgcttagaataaaatctgcttttttttttttaagcatggctttggtgctttacacaatttagtctccatatcctctttctagcctgatctgaaggcaccatccaagtatatgtgacaaaacagcagtgaacatgggggttatgaacactacagaggaaacacaacttgcccaatagtagcaataggcaggtagacaggagggcttgcaaggaggacactggaatagaattttgaaagtagagtggaaatttcccagaaaagaaagaaaagagccttccaagcaaagagaatgttgtgttctagactcagagacaggagggcacgtggtgtgtctcaggcgctgcagtggttcacggtgagctgtgatgagacttgagcctggaagggagtgggagcccatcaggaagagtcttgtgtggtgtgctgagttggggtttttacctttaaagcaatagaatacccattgatggatgaaatacgagattaaattgattttttacttggctttgtttttaaaggttgatgtatttatttttaagttttgtgtactcttgaaaataggcttttatattgtttcaggatgctgggtttttttttgtttaattcacttgaggttagtcttcttgtaaaaaccctggttaacttatttttatggtgctttggattttttaggcttatgtgccttcagaggaagagaaaaatggtgaaattctggcaccaccagaaagtctgtgtgggggaaagccaagtggaataggtgagctctttagaatggttgttcacattgtttttgtttttgccttgcatgtggttttacctttctaaaaatcaatagctgatgcatagtaacatacaggctctattaacttgcctctcactttttaaaatagattagggagaattctttactattttatttttaacatacacttttcctcatgaaatgtcaatcaacattatgtagggtaattgtttaaatctgattacccccaaataataatgcaaaacgaaagttgttttggagcaaactcttgctctatcccagaaatgtttctccatacccctgcctgtccccagatgctattgcagcttacttccaaaaggctagtctgaggataagggcccactttacaccatttgctcttgtctcttgctcaggcttttccccagtggctgcacagatactgctctcagcttgtataacctcatctcagtctctctgtgcaacattcttcactgtggactacagattttaagggagatcctcaatatcagaaaggataaaggcaggagctcttaaacgttttggtctcaaggaccaaaaattactgaaaaattaccgaagaccccaaagagattttgttatatggcttatacctgttgacatttgccaaataagaaattaaaattgagaaaagtaaatattaagtcactattaattcaatataattaactcactataagttaacaactcttttttcatgaaaaatggctagattttccaaaaaacccaattaagtgataaaagtgacattgttttgcatttttgcaaatccctttaagtctggcttaataaaaaacagctatttctcgtatctgttttcacattcagtcctgttgctgtttattgttttgattaaagtaaatgaagaaaatccaacattacagatagacggttgggtttttgttttttgttttgttttattttgttttgttttgtttgagatggagtctcactctgtttgccaggttggagtacagtggcgtgatctcggctcactgcaacctctgactccctggttcaagctatcctcctgcctcagcttcctgagtagctgggattacaggcacacaccaccatgcccagctaatttttgtatttttagtagagatggggtttcaccatattggccaggatggtctcgatctcctgacctcgtgatccgcccgccttggcctcccaaagtgctgaggttacatgcatgagccactgaaagccactgcgctcggccaatggttgggttttagtagccttttcagataattatgggtacatcttagcctctggaaaattccattgagcactcatgagtctgtaagacaaataatgttagtttggcccttgtggattccttgatggaaagcctcaggaattccccagagaggctggaccatactggcttaaggaaatggaaatgagaagaactgtgacagtgaggaattatttctaatttgtattacaaacatgattgtgtattttcttctgtttcccacaatatttttttctaagtactaggaactatagagtatgtgaccaaatttaagccagtcctcaatttttttccacaatgttaaaatgtccatgcaagtcaggtggagtaaacagtcagggtgatttttgttgtaaatacttataacaaaaaactctataggcatttgcttaaagggactttattagctcacaaaactgaaaaattcaggtaaagcataatccaagaggatgcagatagctccaaagacacatctagtagaaactccattttatgtcttcttcctcatcccctgaataagggtcattgctttctcattcatagcctctacttttagctttggcttaccattcctggccaaaaacctgagacttattctgatttagcataagtacatgtgtccaccctaaacgaattactgtgaccagaggaatgtagcttactagttgacttaagtcaggtgctgtgttcctggatccacatggtattccagaccacagtctgggctcttgggaaaggtgccaggagggcaactgtaatgtctactgtagttggattggctctttaaattatttccctgacaaacatcaagtctgctacctgtgagtactagggaaatcaacatggaaatgactgatggaagtaagtcattcactgaaatcaacgtgcaaataagtaaggtactataataaagatacgtacttgactgtgggagtcagcttccctgaggtagggcctcagggaagacttgtgttggctcaatcaatctcttcccccaccccatcttctttaattatagaaagtaaaatatacagaaatgcataaaaagtttcccactccctatgagtaaccaccttcagtacaataaaattatatttatattgttatagaattttttttcactcgatcatgtattgcaggcacccatcattactttattagcatatacagatccactttctttgttttaatagctaaataatcatccctaataccaattttaggtcttttaatggcctcggggtttctactgttacagggctgcaacgaactttcataatgcatatcactacatgtgttttaccaagtattttcataaaattggattgggggagggagggtcaaagaatatacaggttaagtatccctaatccaaaaggcttggggtcagaagtatttcgaatttcagatttcttagggtttgggaatatgtgcattatacctcattgagcatcccgtatctaaaaattcaaagtcaaacttccagtgagcctttcctttgagagtcatgttggtactcagagaatttcagattttggagcatttcagatttctcatttttgaatttgggatgctcaacctgtatacgttttgaatttttataagtacttgttactcatttgaggctaaatattgaataatgagtaggtatgcattaagtgtacaaggcaaagagaagggcagtagatgtggaatgattcagattaagtgaatagtgcatataaatcctcacccatgactatctggggaggtttggggagtgggagcagttgaggaccttcttacacaaaaccatctgaaagggtctcagaagactcgtaagaagtgtcagccagtcctggaagaccacaccaagacttggtaagtcatttatactgacatgttaaaaccctgaagatgactaatctattcaaaacttggaaagatacattaattaaaatgtgcatgggtgttttatactacaaataattaacgtctcatttgttaattgtcaagaagctaacatttttggattctgaagtccgttgttcccacagttatatttcagataactttactgtgtttaggtacagttcagtaagagatctacttacgtaaaaggaagttgtttaaaagaaaaatgtgtgttctgtcattgttgagtagaaacagtagactttgtacttcatgtttccaaagcatataaacagaccattgctgttggaggggataggatctaacttttcatttgacgctattattttaaatgaaccagtgttatactgcagcttaacagctacattaaggtcttttactttttttctaagcttcagatcaccaacatagttaaatcaccatagtgatgtaatataccactgccgttattataaaaaatgcaggcaacattaatttatgttgtctttttctggtagtatattctggtagtacaacatggattgattgtgggaaataactggtcagatttttataatttatgaaagcagctaagccacttggtgacataggataggttccctatcctaaaaatcttcaaatttgtttctctgcatttcagaaacaatattcagtttctttacatctcatttttatttttgaacagctgaactccagagggagcctttgttggtgaatgaatcactaaatgtaagtcactgtaatggttttgatttttgtggttattgggttttttaattttatttttttggagagctattgaggaggagccatctgaaggggttgcctgtgtatttctgtagtagccaggaggcatttggtagtgtactcttcatttgagttcagcatcctgacagcagctttcactagctcttttccatgttcacctatacccactgataaagaactttgaactttctattgtttattattataacgggattgaaaattagattttgatgtcttaaatcatcctggtgctatagacaaaatagattttagtttgagaattaaatttcactttatgtttttagaaagcttttctcaagatactaacctgtaactgctatgtgtacatattttttcccagatgtggctctcataatcccgttcattcttgaaagagtcttgtttttggtctttctgtcttaatgtatttataaggaaccttgtattgtaccaggagtgaacattttataaaatgtttccaaatgtgcagacaactgcattctttccaatgctcctagaggaattggggtactatcagtgaaccgcgggatcagagtacttcctcatcaagcactctgttttgtagctagaaactcatacaccatatgctgaataagaagaaagagaaaagcaccacttggtgtggttcaagtttgccatccaagagttaaaaagattatggctgggcacagtggcatggcctatagtcccagctactgaggaagttgaggtgggaggatcatttgagcccaggagtttgggtccagcctgggcaacatagcataattttttatttaaaaaaaaaattttttttttaataaaatacactttaaaatttaaaaagactttaaatggggttggagcttaccgagccagctggcatgttctccatcctacctcagtcccttgagtccaccagcagctgtcttttccccagtcgagcataaatgtcctttccaaatttgtgcaaaagtctgtagctaggacttaggatattataggatattctgagcctttcccctcagtttaaaaaaagaaaaacagtagaattgataagatttgccaaataggaaatcttattacagaatcctatagagtttttaaataaagaaaaaagaaaatcatgcaggatttggatgggaagggaaatttatggaattcagaaaatttttctcttatttattcttactcttttgccattggctgctttaaggacaggcagaataagcacaataatttgttaaactgaaattttttcaaaaagaagatgctgcatgcttttgagcttctgggtgaaattaaaaagaatatgtaccccaattccttttggcatttgtacaaatagccaggttatgtaaattaccttctctcttctttctttttgcctttaaatttttgtgagactatccataaatatcttttatattgtatatttaggttgaaaattcaggcttcagaacaaatgaagaaattcatagcgaatcttataacaaaggaggtaagttaatgaatttcatagttatagttttaatattatagttaacatttattgagtgtggtctgtataccaggccttgtgttaattattttacatactttctctcatttaattcataaaaattcagtaaagtgatagttaacagcatcaggagtatagttgaggagaacgagtcttaggccaggtgacttattccaagccatacagcttaaaagtgatgtcttgctttaaatagctactagaactttgccattaatctcccagttgactcaatccaacataaatacaaaacgaatagccccctgtggattgcaagtacccaactgtgaaatgtgttaacttctgacaggcagtttaggatggtagcatatcaaggatgtcacatttatgtgggtcttctcccaggggtgaggtctggtggccacacaacccgtgcaggctgccaactctgaacagaaaattcccttctcaaacagaacatagaattttcttgatgcctactaattttgttaatttcctattataggagtggggagagaggcttatttacttagacagttatttttataatgtataccatatttcaaacaaaagtaaagcagtaataaacacctatgtgcccccaacctagttttgccctatcttacaatttagtatatttgcttcacataccttttaaaaaatgttaacagttatggtggaatccccatttaccccttcccaatcccaatctctttccttttaatcccactccaaaaggaaccactattctgcattaattatatataggtccataaacaatatgtaacctatgttgcctgctttaggtaaatatgtggtctcacgttacataaaccctccccaccttatttgctcattcagcagcgttctaagattttgttctgttgatttatattaactctaattattttaattgcttttgaatataccacagttagtattttttgcttcatttgtacattattttgcacatgtaggtattttgaaacttttcccaattacaaagaatgctactgtgtatgttctcatacctttcccagtgcttatgtagtgtacttgtaattctgggtatggaattgctcagttataggcacctcttcaactttactgcatgtgctaaattgaccccaagtggtgtaccagttgtcactccacaccatctgccatatttggtattgtttggtgactgtttgttagcctgatgattatgatgcaatgattcattattttcagtgatgcttcttaatactgtgttgctacacaaactggggggaagggccttgaagtcttctgtgtaaagtccagtgttgttaccccagacatgttactgaccttcttgaaccccattccctcacatctacaagtggaaaaaagagaatttaactgacagagttgtgtggaggatcccatcaaaaatcatttgtgactatctaccacaatgccctgtatataactggtactcaataaagttactaactcagttttctcccagccccctaacacatacctaagtaagtattggaatataaaaatatttaagatttttttttcttttttgtatttattactcagagatatccagtggtagaaaagacaacgcagaagccataagcggtcacagtgttgaagcagatcctaaagaggtgcattttaataaactcaagtgtttgatattttatacataatattttcactgtacacaaagaagggctttagaaaggctttatttctttgtataaattaaatattaaatgggtatactgagagttccacatgtcacttttacctgtatatgccctttcaatgtttaggcaatttggcagttcccaggactgtttggaagtgcccacgttgtacagtcagaatggtttttcatgcacctttcatcaaccataagaagtccatttttaataagccactaagacagtagaaaaatactaattgtgatgtgccatcagttgtaagatatatatagcttgacttcagaaatggtgaaatgataaataatttttttaaatgcgttttagaattattgaaatatagtatgtagctagaaacagcatgtgttgtatgaatttgcattcaaacccagaaaagagactgaagtttacaaaattagtctaatccaaatctaaatatcaagtgttctagatttttttttctttttttttttttttttgaaacagtctccccctgttgcacgggctggagtgcagtggtgtgaacgcttctcactgcaagctccgcctccggggttcacgccattctcctgcctcagcctcacaagcagctgggactacaggcacccgccaccacgcccagctaatttttttctgtatttttagtagagacggggtttcaccgtgttagccaggttggtcttgatctcctgacctcgtgatccgcccacctgggcctcccaaagtgctgggattacaggtgtgagccactgcacccggccaagtgttctagatttttaaaaaatttatatatcaacttattccaaaggttagaatctagtacagtgtgctcctctttcagtttatttgaatcaagattctatggcctttgatatagtcattcttaattccaggttgaagaggaagaaaggcatatgcctaaaagaaaaagaaagcagcattatctctcttcagaagatgaaccaggtatttatatttatgtttctgttttagacatctttgaaaatcattatttttatatccaaaagagtgagccaaaaacatagagaatttttgaggatagtaactctctactttacaagtcttgaggctaatttgtttctagactggcttgatacctccggagtcctttctggaccccaatctagaaactagattgcttcctgcagaagacccaaccgctggatctcagacaaagacaggctctctctggaaccacaccctggagcccagccaggtgccactacagtctgtattttatatcataagcagataccctacagagctagtgaagcactttagtccaaaagtgcctctaacacccattctgtgcttcatactgttgattttctcatggtctgtaacggtgccctctagtagaactacagtgatagaagtcttgtacatttattttgtctaatacagaagctactagccacatgtcactattgagcacttgaaagtggtcagtggaaatgaaagactgaatttttaattgttttttaattattttatatttcagtagccagatgtggttagtgactatcatgttgaacagtgcagtgacctttaatacttgacacaaaggagaagttcaatacttattgaatgactacatgagaaagaatgagtgaagaatgaaatatttatattttatattatttggtagcaatttaatgagttcctgatgtattcaggtactatccatggtacattatacacattcccatttaatctttacaataaacctgtaagttaggtggtgttgtcatcttatagataaagagattaaggttctgaaaaattacgactttatcttcaccacataaatctgattccaaagcccatggtctcaattactaagctatacctcttaggtggtaactcatttagaaagttaaagtatctctggaaactatacgctaagcccttcccatagaacccactacttcattggtgtcatgtgaacatatggggatttttgtattttgttttatttttactttgccagggcgaaaggcaagtgttcagtgctcaaatcacatgatattataaatatagagtaacttttggcttctctgtatcacaggcctaagaaagaaggctcaaacagtcttaaaatagaactatgcatttcatttttcatttagcttttgttcctttgtgattctgtctaaactgatttacagatgataatccagatgtcctggattccagaatagaaacagcacaaaggcagtgtcctgaaacggagccacatgacacaaaggtattttttccacatattagttttaagttttgggtgggggtagggaggcctaattacagcattgtaaatacttagtataatatttttttcattttactatccctctttaaatgtctctaataataatcactttattataaaaggtgtctattttttagtctcctcccaaaaatcaaatgttgcactttataattcttaaactgcaagatcgtgttaattattacaatttagatataacattgcttaggtttttgttcagtagtagtattgatttcttgaggtttctaaatgctttcttccaaaagtataatgtgctttatcacagatatacttgcaccaaaatattgaaatacagttattattagtactctgctctctagcttacctcctgtattagtctgttctcatgctgctaataaagacatacctgagactgggtaatttataaaggaaagaggtttaattgactcacggttccgcatggctggggaggcctcacaatcatggtagaaggcaaaggaggagcaaagtcacgtcttaacatgacaacaggcaagagggcatgtgcaggggaactcctctttataaaagcattagatctcaggagacttattcactgtcaggagaacagcacaggacaaacctgccccccgattcaattacctcccactgcatccttcccactacaagtggggattatgggacctataattcaaaatgagatttgagtggggtcacagccaaatcatatcacctcctgcctctaaaatctgggtactctaaggattggcctcacccattgccttttttcctatggttttattttcatcttatgactcacagaacctcctcacaaatttgtatttgtgttctgccgtctcttgttgtaggcccagattttttcattccctactagatacctcttcttgggtgttcttccatttctgagactcagtactctaaaatttctcattatctgtctaaactagttccatcttttcctctctctttctctaatttatatttttataaattattagacgccttattccaaaagtgtttaagtccagttatgaaaatatttgagctgacttccagttctctaaaaccagactttggtctctttttttccccagtaaccgaagaactaaataaaaagtaggaaaaggtttaataacctaagagggaaagtggcatattgtcatgaattttagttggttctgaccaaaggaagaaacaggctcttaaactatccctcaccctgccctgtccaaaatcaaaaatcctgagacaatacttctaaatttgaagaaaagcagattgaaggggtatcatttcattttctcttaaatttcgtgattttttaatgttaaatttaaataaaatcaatttattttcattaagcagttttatagacacagtattttcagttactacagaagaatgttacatggaaagctgtctgcaatagcatttatttaatatcatcttaatattagtaatttttggacagtaaattgggagtgatttcatcatttctgttaaagttttctgtgtagtaaatatgtgccattttataaaatcaataaagtcattattctaaaatgtgtatagtaagaccaaaagaccaaaattgaatacgtgaaaaaattccaggcactggaaaaataaaagcaggaaataaaaagtgagttgcgtgcgtgtcatcaggatctgattaagtgcttacaggaccaagtgttggctctgaaagagccagttcaaaaacagaaatgcagttcgtccaatggtttgaagacttttgtgcaggacatcttcagcccactatatgaaacagataaaagtgtagatgttctggctgaaatgagggagaagaccccaaaaacttctgcctgctcctaaactcgctccaacacacacacacacacacacacacacacacacacacacacactctctctctctttctctccccgccacacacgcacacatgctgactctctccatctcacacactctgtctctctctctcacacacacacacacacagagcacttgaagaggtcctgagctgaaaatggcagtgcagcatgagtgtctcagtgaagcctcagtgttgatgtgctgataacagagcaaataggtttctccttggctttcccaaacgagttgaccttccatcctctaaatcaacaccctcccaaattggatgtacgacaagccatcagaatgtgagaagaaatggtagaaccacgatttatatatgccttttatctaaaaatcttaaaaagtaatctctactaatatttactgtatagattgttggccctggtgccatcactgaaagtgagctctcctctgacatcacctgttagtcttgcacattattgcatgtcttggacctagttatgtagtactgtcaaagtaccttaagggtagctgggagtcccacaacacagaggacttgagaatgagcccctcacttgtttgttcactttcagcattatatgacttaatagtttacagatgctcaactaaatgaatttgcagagtttgtttaccttgttttaattgaattgaccctcccaataccgacactggtttgaggtttcggcaaaaataaccacaacaaaaaaccccataagacaaagataatatttgtaatgcagatacaaacaaataataagagaaatggctgagctgacacttcttttactaggaagtagcagaagctctgtgtcatcctcattgttaggtaaaaaagaatgaagatctaatcatatctgacatgaagtgggccagaaattccactgtttcagtagactgtgtgaaatgtggaattgcttttatatccatccccttccagtccctgaaaggctatatcaaaacccaatgacattgaatgcatccaagtagggaaatcgggggtgagggcatttcattatagacccctttaaattttgaaccacaagaatatatttctattaaaaaataagtaaaattaacattaatagaaatgaggatttacaattttttataatgggccattaaagtaaaattaaagctttagtttcctatttcatcttgatcttattctactttatgtatttttgtttatatactatattagtattatagttgaaacattttggcatttcatgctgagaactttcttgccactatggggggataatttaattgctgaaagatcactgctccaagtcagcccatctggatacccagaaattccctttggcacctcccaaattattgcttccccacatctctcccctccatcactccacaaagataaatatctgttgccagtatctgtccattcttcctttggagtttgtcttaaaaagacaaaatccaagtagagggaggagaagaacaatttctattttgcaggaaagaaaatggccttgatatgttgtacttgaaccttatctcatgcttttctgttctcagaatgtttattttttttatggtctcactagcagcaataatagttacacttcaaaaacattttccaaaaactatccttaaaaagagctaggaagtttttttgaaatagaaaggcaaacttgtgtggggaggatgaatggacgaaggcttcagtttgaagaaggttctagtctttttcaacttctctataggaagagaactccagagatttggaagaattacctaaaaccagttctgagacaaatagcactacctcaagggtcatggaagaaaaaggtgagtaaaatatctgcttgggtaaattgactgagccttcaaagcagccagcgtgtctctcaaccgaaacgtctattttgctcatttacttttcctgtgtaataaagtgcctcatgcttaagattaatagggctagggaatcatttttaatttggatcctgctatactcaaagtgtgctgtttactagtcacccaaactcaggcttgttaattttgatggtagaaacatgaaaatggagtgtgtggttatgtgtggctgcagctgtgtaggtcacctgggtaaaggtggggaaggctgaccatggtcactagcattgaacaaagttcttccttttctacagatgaatatagcagcagtgaaactactggtgaaaagccagagcagaacgatgatgacaccataaaatctcaggaggtgagatgtgcttttcgtatttgtttgttcacaattatttaagcactaaccaaattaaattcattaaatactgttatcttgagtttttcttaagtactttgaagaagctgcggtttttttagtgcaatggaacaccatttcatacagtgcattttatcagtgtcattttgattaatttttttctcttcatctttgtttcttcaaaacatttgtatgagacccacttatgtcatagccagataggatcagcttagtgctctacgtcagcggcaatgtcaggttcctggcctggcaatgctgagctgccaggccaggcacatggcagcaaacaggaggctgtctgagccatggagtccagctaggatgaaataggaacagcagcagggtgtgcagaaggcatgcagggaatactcgaggggacctagttcatgaggcaaggtcatggattcctggaggctgcatgcacagacagagcatcccagccctgcctgctgtaagcccatagattttcagggagcctgtggagcagagaattgcagtggcttgagactgagcaccataaatcaagagacacagcctgtgcactagccgggtctagataaccattgccaggtttgcccattgttaaatcatttgttattgttctgtctgtatgatatattcagtggacccctttattttttataagggtatcatttggtcacaactaacttgggccaaatcccaaattaaatggacatacatacttattacagaagtaaaaggttacactttgattacttcattgtctcaaaatcctcatggctccattaatttatgacagttagtgatatttatcaggttgaagaagcaatggtgagatcagtaaataaaacactaagccctacatcacatatttttaaagtgacaaagctaggatttgaggtctcttagacaggaactctaaatctgatttttgagaaaactttatataataaaggataaaattttttttcttattgctgttgttgttttttatttcccccttaggaagatcagccaataattattaaaaggaaaagaggaagacctcgcaaataccctgtagaaacaacgttaaaaatgagtaggtacttggtgtgttttcagttcacacacaagaaattttcgaaccgattttctaagtgaattttttttttttagaagacgactccaaaacagatactggcattgtcactgtaagtaattgcaaaacatgacaatttcaaatacttgctcttaacctgaaaaacggtataatgcaatatctagtattttgaactttattttttttacttgaaaagctttaaaagactgagtaaccattcatatattttgattactagtatctttgtgtaaacagagttacattagttgttcttcattctgattccattctaattcaggagtttgattatttaaaaattatctagggatttaacttcttgtggccacccttggttaaaatatacaaattagctattttataagattttgagatagtggcttctttatagagacttgtgagttgtcttaccatcttactactttctttggaattctttttgacctaaaatattcactgagttcagtgcaggaaactccttagtgatattttatgtttgaacgttctttatctttgaccctgacgtatacccaccaaaatcattgtatcaggattccatcgcatgcatttcaatggattattataaggaggacattacaagaagagcattgtaaggaggacagacgtgtgttcactgacctaacaaaacaacatgggattcaagcctcagctttgtcacttatcccgagacctgtgacttagggccaatcatgggaccctctggtgactcagtttccttgaatgtgaagtggtatgatgcctgcagtacttatctcatagaattattataagacaaaaccagagaagcacatgtgaatgcatttagcaacatgtaaaatggtttgccttgggaaacattaaccacagtggccatgctgcattgcctcacttctcatcctgtagcatcacaaaagggaagttacttattggaaagtctgtatttagaagctcaggcatccatgtttgctaggtatacttaatcaattacagaaaataggtctcaaatacgcctatgtaaataaagatcctataccacctttacatcattgattgcatttctatgtgatgattataaactgctgatttaaaatttttttttgtttgtttatttaaacataggtagaacaatctccatctagcagcaaactgaaagtaatgcaaacaggtatgtacctaccgcattcctctgtgtgttatctgagggaggggcaggagaggctggctgttggagaaggtttggaacttccattctgcctctcattgaagtgggtggcccccttggtaaaaataattgtccttgtatctgggagagactgtatctattggcttacagagcccaggactcaagaattgaaattgttttgactatttttctcctcattccaaggagaagaatatattccaaaatgttgataatgattagctctggagggtggaataatgggagcattccatattatttgtcaatattgcttgcattttccagatattttttgcaatgtatatgtatgcattttgtggtctaaaattttttacataaaacaagaggtgccattagtgagctttgaagtgttgatatcaacaacaaagattaatgtgacagctattttgtatcaaataaatagtatggtcagactgagaaagtacatattctcatcagcaaataaagcaaataggtaatatatagttgtttccacatttaactatgtgtgatcgtacttcattttttcttgtgtcttggtaaattaaggttcatttattttttgaaagaggaaggagattatgcacgtttggtcttaaccagtttttattaataattttgtagtattttgaatccatacaagaaatctttataacttcagtcccctttaaggactccaattaaagctgtgttattcagaatgttttctgaatgtgggtaaaatgatgaccattttaagacagtcctctttgttgacatttctattgggttaactttttcatcttcattggtattttaaacttgcaaaaaaggacaactactaccgtcactaaaaagaagtacctttgagtttttgagtgcctgatgaacatccccataatttcagcttcaactagtgcattgaactaatctttacttttcttaccatgatacagtctcagaaaattgtaacatctgcagaaagcaaatgcataaagaatgtatgtatgcaccctacaaacaggtcataaaatgtacttttttagctaccatgatgtatttggagtcaaaagaattctacctgtcactctacttgttagttatgtgactctaaacagattactcaagcctggtttgttcagactataggctgggatcataatacttgcagagctacactgaaattgaaaagtccatattagccaggtgtggtggctcacacctgtaatctcagcactttcagaggcctccacaggagaatcactggagcccaggagttggaggctgcagtaagctataattgcaccactgcactctagcctggccaacagagcaagaccctgtctcataaaaataaaacaaaagtaccagttatatatccttattcaaaatgcctaggacaccagaagtgtttcagattttgaatttattcagattttggaatatttgcatttcccagttgagcattcctaatcaaaattcaaaatgctgcaatggcatttcctttgagggtcatgttggtgctcaaaaagttttggattctagaacattttaaattttggatcatcagattagggatgctccgcctgtatatcattccaacttgcagttactggtacatattgtgggctccttatatgcccccttttttcttcttttttggggtcagaacatttaagctgaaagggaataagagtagtctaacccagccgggcgtggtggctcacacctgtaatcccagcactttgggaagccaaggcaggcagatcacctgaggtcaggagttcaagagtagcctggccaacatggtgaaaccccgtctctactaaaaatacaaaaaattagctggacatggtggtgggcacctgtaatctcagctactcaaggaggctgaggcaggagaattgcttgaacccaggaggcggaggttgcattgagccaagatcacgccactgcactccagcctgaatgactgagtgaaactctgtcttagaaaaaaaaaaaaagtagtctaatccaacttcttattttgcagctgaaaaaactgagggtcagcaaatttaaataaaatctgaaatgaaaacttatgtttcgtgactcacaatccaatgtgatctctgctaggtattctgattctatctttgcttgactgatacaagataatgatgaaatgtataacaatgtattaatactgatacattgacagacaagccaggctgattgttgaaatttaaatttacagtaataaaatattaatgcagagatttcccttttcttaaagatgaatccaataaagaaacagctaacctacaagaaagaagtataagcaatgtaagtgttaaatttcttatcaagatatgttgtttagaaatcaacttaaatgctcagctgaccacccttttgactttaattttattgcttctaggatgatggtgaagaaaaaatagtaacaagtgtgcgtcggagaggaagaaaacccaaacgttctctcactgtatcagatgatgctggtatgtttctagcaaattcttaataagtcttattgtttcaaaaccacctttttaaagagtttttctttgaatgaggaaaaatccaatgggtacagctaatattaatattatataaatatgtgtgaaataggtctaatcccgtgtcagaaatggtacatcccagatgcttttctgagtacatgtcaattttttatgaacgctggctgtgaactgcatatgtaaactatccaaaatgtgtttgagattaagttaaacagttgtgaattgcaagtgctgaaacaaaaaggaagtggaaaaccatttctctgcctccaagtccctaatatcctaagttctaaactccatgactctctctcttggaagtatctttgggaattgtaaaatccaggtgttacccttctatttgaacagaatcctcagagccagaaagaaaacgccagaaatcagtttctgatccagtggaggacaagaaagagcaggagtctgatgaggaagaggaagaagaggaagaggacgagccttcaggagccaccacaagatccaccaccagatcagaggctcagaggtaatgggggcagcacagagctgccagagaccttcaccagcttctccatctgaaaattgctctgggttttctgggattctctttgaactgaatcattcatgctgcagtggaagttcttccctttcatttttattgttagcagtgggcacatagttcttggagaacacattttctgtcctaaaccattttgggggattgcctcaaagtctttaccaggttttaaatgcctatttggtggaacccattcaattccttacaaatatattttttgagcatctgccatccttcagatgtcgtattgagcaccattcatgaatatggacatacataaaacatcatccctgctctcagcatacttaattcaacccagaaagcaggaggaaccaggcccacgcaccgtcatcacatgcatctcaccagtgctatgcaataggttgatcataggaaagtgcccaaatttgaccatttttgaggtaatttcatatatttcccaaaatgtgttctctcaaaccctattgtagccagaaacctctgagaaaaagagtaccacggtcagatgagtttgggaatgtcattgaattctctctccttcctcagttacatgttcattaaaatattaagggtttggcaaactccagggctgggcgcggtgactcacgcctgtaatcccagcactttgggaggccaaggcaggcgaatcacgaggtccggagatcgagaccatcctggtcaacatggtgaaaccccgtctctactaaaatacaaaaatcagccaggcatggtggtgagtgcctgtaatcccagctactcgggaggctgaggcaggggaattgcttaaccgtgggaggcggaggttgcagtgagctgagatggctccactgcactccagcctggtgttagagcaagactccatctcaaaaaaaaaaaaaaaaaaaaaaaaaagggtttggcaaactcctaaaggaaagaagcctgttgaactttgtttaaacaagcattatttgctgataccacttttctgttgttggcctatatcattatacctgttcacatcatccagtgttcctttccccatggcacatttgagaaatggtacataactgtattgtctcatcctaaccgttaatcactttcccaaacatgaatattttccaggctgagcacggtagctcatgcttgtaatcccaacactttgggagaccaagatgggaggatcacttgagcccaggagtttatgagaccagcctgggcaacacagggagaccccatctctacaaaaaaattagaaaattagctgggcatggtggcatgcacctgtagtcccggctacttgggaggctgagatgggaggatcgcttgagcccaggagcttgaggctgcagtgagctgtgatcgcaccactgcactctagcctgggtgacagtgagactctgtctctgaaaaaatatatatttttttaatttttaattaatgtgatttacaagctattaatcttggtatcatcttgtttaatttcattattcaagattgatcaaaaagttcaggaagatttatttcaaaaataacactaacagcataatataatagtatcttgtgtttacataaagaactaaaatcggggctgggcacagtggctcacacctgtaatcccagcactttgggaggctgaggccggcggatcacgaggtcaggagttcgagaccagcctggccaatatggtgaaaccccatctctactaaaaatataaaaaattagctgggtgtggtggcacgtgccagtaatcccagctacttgggaagctgaggcaggagaatcgcttgaactcgggaggtggaggttgcagtgagccgagatcacgccattgcactccagcctgggtgacagagtgagactccccgtctcaaaaaaaaaaaacaaaaaaaaacaaaaacttaaaatcaatctgtttctaattcctccagacttaacacagtattagccatttgtgccatggtttgatttctcaaagaatcagattttagagccaaaggactctagaagctcacacggctaaagttataaggtggtctcatatttgtttttttaggtggagcagctcacataaatagaaaagaagtcacagaatccaaattgctgctgctaggagagggtgagggtgctggagcccaacacccatgcatttgggtatagcatccatcccaccagaattactgcttccctttaaaacagttgtggaaagtagggctcaactcagagaaagttccataggccttctagccatcttcgagtgagtgtctagaaattgctctcagatttgccttttataaattctttaaaaataaatcttatttgatttatatggttctgtaatcacctggattatcaaagctcttccttcatgcactttataatataaacttttgatttacaaatgagttgttttctctctagtttagattccttggcattggttgatcagtcccagggctctggtgtcttcataattttacaaattgtctgagttgggtgggctctcagtggtcatgtagtaccaatagccagtcagtgcctgagtcactgcacctgcagctcctctgaaagggtcttcctgcttttgcatggacctcagtggcagggaaagccacatcctccttagcattctctgacttgtgttcagtagaagccggcctccctgtggcttctactcttgattctagttcgactttcagaaccttctgtctaattttgccttacatatttgagggcagcttccaggtcttctctgcttgcttattgagccccttcatcatccctgtttgtgctcatcagttacctttatcctcttttagaagcaaatgtgcagctgggcgcagtggctcatgcctgtaatcccagctactcaggaggctgaggcaggaagattgcttgaggctgggagttcgagaccagcctaagcaacatagcaagaccctcttaaaagaaaaaattaaattaaattaataaaatataaaagaggccacgcacagtggctcacgcctgtaatcccagcactttgggagtccaaggctggtggctcacttaaggccgggtgttcaagaccagccttgccaatatggtgaaacctcatctctactaaaagtacaaaaagtagccgagcattgtggcagactcctgtaatcctagctacttgggcagctgaggcaggagaattgcttgaacccgggaagtggaggttgcagtgagaagagattgtaccactgcactccagcctgggtgacagagcgaggctctttctcaaaagaaagaaagaaagaaagatagatagatagaggctctttctcaaaagaaagaaagaaagaaagaaagatagatagatagatagatagatagatagacagacagacagacagacagacagatagatagaagcaaactctgtataccaagtgtggtctaatgaatccagaagaggactgttctaccttattttctggatattgttcttcagtgtgcatcctcattactgagcctcaaattgaaaaatacaccagctaaacaagttcctttttcagagtttttactggaatcagaattccttatctgattcttgtgcagttgactacttgggccttaacacttagccttgtgaattgtactttcgttaatcttggccctttattctaccctgatgagctcttttgtaatctttattttgtcggccagtatattttctatttttcgcagatacatcttttttctaaatcacaataaaatatcatgcacagtaagaacaaagatagtgtcacacaagcagaggtagttgtagatgacattaagatcgacttatcagcagtggtcaggaaaaccaaccatttttctgattttagttcctattgttctgacttgcccacaaggagcctcatacttcctacagagttccagggactggagtattcagtgctaccattgcccagtgtttctataatctgtttcagaaagcaacatagcaagccatctgcacgtgcaacatccaaacttggcagcccagacacagtttctcctagaaatcgccaaaaattagcaaaagagaagttacctaccagcgaaaaagttagtaactctcccccattaggaaggtaagtccctgcttacacttcaagccatttttaaccccctaagactatttttggtacaataatgctttcttcctaatttcctttaagattttgtctcaccaaataactgtttttggggatcattggtttccaagaagaacaggaagggctgcagaaggtgtctgtgtggcctcaccagtctggccttgccgcagtggactgccacacaggcttgtccttgacacctgtgagccttatctgccttctcccatccaccaagaccaaaggcaaggcagtgtggtaaagcatttaacagcccagaatcatttctgttttagctagagcattggagaggtgatgaggtgataaagcttcctctttcaggcacggcccctgccagcttacacctttcactgcagccttactggtcttactgcttcccagaggtggtcctgagccttcctttcttgcctttgcttgagccagtgaggagtgtcctcaccaccagcacccctagtaagtcagatcctttccgtcccgcttcagcccattttcatctcttcttgctgcacttctggtcagtactgggcacttgagatgccacatagcattggtttggtatattccttttatttacccctctgagctctaggtttctttcttgagataggaatttgtcatactttctatacattatcatattcaaaaataaaagactcttcactgtacacaaaaactgttttgacctcttaccacattttcatcttcacagcatacttgtatgtatgtgctgttttccgcacattctagaaacgaaagcaaactatagtgccaggcagtttcacatacatgctctcatttaaccctcagtgagtgaattgtaatagttactcttattttatatgtgagggaaagaatctcaggaaggtttccatgcatactactcaaaattgaacatgcagtcaaatcacttgaggctgttggtaaaatgcagatcctgggtctgtaagtctaggctggggcctgagagttggcatttccaacaagctcctcagtgaccaatgcccctcctcacagaccacattctgggtggactagaagggcctggataaactacgaagctcacatggctggggagaagcagcctgactcagagcttctgttggctgccacttggcccccagcacaatactgcgcacggcacctttactgaagaggtgttcattgagtggctggtggctttccatggaaacagtttgaaatggattatcaacaaacacattttcagtcattgtcaacacatgtcaaaaccacatcatctgcaacaatttttgactcagtttatttacttttgctgtcaaacaagaaacggaagacgtgtcttcatatcactaagagtcccatttctccatctcctgcaattttggttttccaactctttgattcattgacaggacatttactgcccgcttgccatgtgttgggcattgcactaggcactggagttagaaaaatgaataaatctcagcagctgccctagagaatcatcgtgtctaatgggggagatatatgtgtataagactttcaaacttttttggcaacaacccactataagaatattttgcaatacagctggtgctcacattcctgctgctgtaactgaaacaaaatttcatgagtcaaatttaatagatgtgatatgagtggtattttctgttgtgtcctattaacatgttgttttaaaatattgattgtaacttgcagtttgaaaaaacacagcagatgaatcacaatggtaaatgctgtggtaaagacctaaagtcttcatatcaataaagtcacatttctctgtgggggattccaaagatggggcatcttgctttgtgatgtggaaggtgcaggactacaggcccagatggtgcacaagtagaaggcagaactataaaaggctctggatgattttctcctgaaagcatcagagacccaagaggaacttcatacatctctaggacagtaacatgattaattggagtttccaacaaataattttaatcacagactatatcaacagggtatgctggtgatagggagattggttagaatgttcttctgaaattcccgtgccttttctaacacaggtattttctgtaatactgtgctacgaaacatgattttgcacttggtccaacctagattgcagtcctgctgtgttcttgctagttgtttgaacttgggacagtctgtatattggtgggacccgctgttgatgtctttgttttctagatgaaagaactagggcccagagaaggaagtggatttgagcaccatcagcacctagagtgtggtagagctggaaccagagcacaggcttcaaacttctcttccagtgtcctgtgtttgtgtgtgaggttgacagcaaataaccagttagttcaagctcttcgcgaggtagctccttttcatgtataaatgttactgggtttttctcttcttagctgtcaagttcaaaactcttctgttttttaaggaactcccaagttatttgaagcagctgcttttaaacctcaccattgccttgactttgcttaatgcagatcaaagacacagctctccccttctatcaagcgcaagagagaagtcagccctcctggggcccgaacaagaggccagcaaagggtggaggaagcccctgtgaaaaaagcgaagcgataatcctgaccactgctgccctaggcttatggaggaacacggtggagaggaaagagacatgccttggtggccataggcttctctttaaccaggaaaaagatatgcatgtgctgtaagtccctaggtgcaagctttttcttgttatgttttaaacagctttataaactattgttcatagaagatattatgtacatttatttcagataaaggacaataagtttactttgtatctgaactcaaaacaaagtagttgtatattttaacattcaaaattgggatttcccaatgtgacacatcatgaatgcaaacccctccagcccatcagacgccaggctgcctactggtaatctgtgtatagtatataaacatgtaaaaataggttgtattttactctatgtatgatgctaatcaatgaacactttatttattttacagagaaaacttatctgtgaactttactatatatctgtttattttactttattttttttttaaataaaaagggttttaaatgctatgcagtcattagtagaaaattttttaggactctgcctgctctgtaactatcttaatatgatctggcagaaactcgcatgtatccaagtaaagtagtttagctaaagaaaggttcttcattgcttttctgttcacagttgtggctctgttttttaagaatgtaacttgtttttagattatacttgcatctgtgactttactaccagccacgttgacacaaaacaggttctggttcaggtaaagttgcgtcagtcacctgcagcagaaatccctcttcattcctcttctctgtgttcattcctcttctgtgctgttctgaagcttctaccaatactctttccatattgtctttttcagtgaagagaaatgcattcaagattaggtccctcctgtctatccagtttcaggattttatgttgttttatacacagttatttcagtatagaaactggctttattgccaagtgtttttttaaacatgttttaactctcatatgagcaaactgtccaacttcagtttttcataagattaaacttcttacgatcaaatttgtctcttgcaatgatgtgatgagttgccaaataattgagattattttaaaatgttttgttcatattcttgttttataattaaaatttacattcagtgtgtatgggtttttttttttattttgactcttaatgtaaggtggatatttctgtcattttacatggtttcttactgagattttatatataaattataaaatgtttaccaaaa

SEQ ID NO: 8186 - DNA, 323 bp, Homo sapiens
aagagtggtgatatgacattgatccctgaacaagagccaatggaaattgattctgagccaggtgttgaaaatgtgtttgaagtatctaaaacccaagacaaccgcaataataattctcagcaagacattgactctgaaaatatgaaacaaaaaacttctgccactgttcaaaaggatgaattgagaacttgcacagcagattcaaaagcaacagctccagcttataagccaggccgtggaacaggagttaatagtaattctgaaaagcatgccgatcatagaagcaccttgaccaagaaaatgcatatacaaagtgctgtgtc

SEQ ID NO: 8187 - DNA, 640 bp, Homo sapiens
aaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8188 - DNA, 606 bp, Homo sapiens
gttatatttttgttaratcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaarccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaagkaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8189 - DNA, 628 bp, Homo sapiens
aagcgtaatatttgtaaaattcgcgttaaattttgtaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8190 - DNA, 640 bp, Homo sapiens; identical to SEQ ID NO: 8187

SEQ ID NO: 8191 - DNA, 513 bp, Homo sapiens
gagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8192 - DNA, 612 bp, Homo sapiens
ttcgcgttaaatttttgttacaatcagctcattgtttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8193 - DNA, 640 bp, Homo sapiens; identical to SEQ ID NO: 8187

SEQ ID NO: 8194 - DNA, 640 bp, Homo sapiens; identical to SEQ ID NO: 8187

SEQ ID NO: 8195 - DNA, 654 bp, Homo sapiens
aataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8196 - DNA, 647 bp, Homo sapiens
  misc_feature (29)..(29): n equals a,t,g, or c
cgcatcaggaaatgtaagcgttaatattntgtaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8197 - DNA, 640 bp, Homo sapiens
aaattgtaagcgttaatattttgttaaaattcgcgttaaatttttgttaaatcagctcattttttaaccaataggccgaaatcggcaaaatccsttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaagsaagggaagaaagcgaaaggagcgggcgctagggcgctggcaagtgtagcggtcacgctgcgcgtaaccaccacacccgccgcgcttaatgcgccgytacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8198 - DNA, 640 bp, Homo sapiens
aaattgtaagcgttaatattttgttaagattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8199 - DNA, 571 bp, Homo sapiens
aataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8200 - DNA, 640 bp, Homo sapiens; identical to SEQ ID NO: 8187

SEQ ID NO: 8201 - DNA, 639 bp, Homo sapiens
  misc_feature (88)..(88): n equals a,t,g, or c
aattgtaagcgttaatattttgttaaaattcgcgttaaatttttgttaaatcagctcattttttaaccaataggccgaaatcggcaanatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8202 - DNA, 648 bp, Homo sapiens
gcatcaggmaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8203 - DNA, 624 bp, Homo sapiens
tattttgttaaaattcgcgttaaatttttgttaaaccagctcattttttaaccaataggcggaaatcggcaaaatcccttataaatcaaaagaatagaccgagatagggttkagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8204 - DNA, 509 bp, Homo sapiens
gttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8205 - DNA, 654 bp, Homo sapiens
aaatacgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8206 - DNA, 546 bp, Homo sapiens
  misc_feature (20)..(20): n equals a,t,g, or c
ttataaatcaaaagaatagnccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8207 - DNA, 654 bp, Homo sapiens; identical to SEQ ID NO: 8195

SEQ ID NO: 8208 - DNA, 1232 bp, Homo sapiens
gcaaagcctcttctaagaatagctgtgaagggagctggaagctatgagatcagaatgaataataatttttgcatttcacacaaaagccaggtaggaagtaaagcataatgggggcctcttggatgccaggtgtttaacacctgatggcatctaatcctcacaaaaaccttcactggtgccaccatgcccagatgagacatgagagggtctgagaggctgaggaacctgcccgttgtctcaccacaaatgctgacccagccaactgctcaccctggccccccgcccccagcccccaaacccagtcctttctacaacctgctctctctccaaatagcagtagtcagaggctgtgctgaggcctcccagaaacctttcccctatgtggatgtaaccttctcgagacctgcttttggagttcaacctgtgctgaaggggcagagaaaaatcctatggcaggaggggcacttgagataagcctcataggaggagagaagcttctccctgtgtggaaggaggcagcacacaggccacagagaggcgcagaagggacaactgaggccaagagaggcggaaggtccccagacgggttttctaaaatatctttctctgaatagcatttttacttaaatttgatatgcaaatgcagataattggtattcatgtaaatatttactgcttaaaacagaaagttacttgtaataggccaggcacagtggctcacgcctgtaatcccagcactttgggaggctgaggcaggcagatcacgaggtcaaaagatcgagaccatcctggccaacatggtgaaaccttgtctctactaaaaatacaacaattagctgcctcaggaggctgaggcaggagaatcacttgaaccagggaggcagaggttgcagtgagccgagatcgcaccactgcactccagcctggtgacagagcaagactccatctcgaaaaaagagaaagttacttataatagaaagcctgttcaaatgtggcaagtgcaacgtattcttttggaggctctaaacccaagcctgcaggtccctgatacgtcttctttgccatctagtggtagccattagaactgcatgtgtgggcccggcgccgtggctcacgcctgtaattcccgcattttgaggggccgaggtgggtggatcccttgagcccaggagtttgagacagcctggacaacatggcaaagccctgtcaaaaaatacaaaaaattaaaaaaa

SEQ ID NO: 8209 - DNA, 1232 bp, Homo sapiens; identical to SEQ ID NO: 8208

SEQ ID NO: 8210 - DNA, 2249 bp, Homo sapiens
ccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcaggtgagcctggcggcccaggaagggctggtctatgtgagctggcggctcctccccagctgccttgctgccaggtcctgccaaccatgtacaagtcctacacagcactacctcctctgatcttcacatgcattagtgtgcggctgcagctgagatggttcacgctcagaggaggcagccccctgccatggccctatagtacatttgcggcacaggctgcctccagagccccatgctttccatttatctaggctgcctcccaaatgtggctgcctcccagatgtgcctgtcagagaggggacgaggggagacaagcaggccatctcctctgcaccaaggccttgctgagcacagtggacatgggcagttaaatataacagaaaggagggtggctatgctcgaaggcccctggaggctgagtagtccagtggcaggagctcgagctttggagccagccctggccctctcaccgtgtgacaattccctttacctttctgagcctcgtactcagcctccataagatatgtgcaaagagctgggcacagtggctcatgcctgtaattccagcactttgggaggctgagatgggcagattgcttgaggccaggagtttgagcccagcctgggcaatatattggaatcctgtctctacaaaaaaaaaaaaaaaagaagagtggtggtgcacgcctgtagtcccagctactcggaaggctgaggtgggaggatcacttgagcccagaaggtagaagctgcaatgagctgagattgcagcactgcagtccagcctgggcaacagagtgaggccctgaaaagaaaagaaaagaaaggaaggggggaagggagggaaagaaagaaagaaaaagaaaggaaggaaggaaggaaggaaggaaggaaggaaaggaaggaaggaaaggaaagaaggaaggaaggaaggaaaaaaaaaagatttaggcaaacacacctgctttgcaggatcattaggattaaatgagatagtgcaggcagggcacagagtggaggtgagtcaacattgaataaatcaaaggccttctggaacgggtccccagctgtcccacctgtctgtcattggtgctgtctgttccccgtccacccctgcgcttactggctgtggtaagtggggttctgtatgcacagtgcaggactccttgggcctaaggctgcatggagtaataagagggtcctttatatttgcatagaattagtaaatatctcttgggcatttactgtgtaccaggcactatctaggcccccagcatcttacaacagaggatctcgttgggtctttaggaggcagagcagggattcccatatgcattatacagattcgcaatctgaggttgggagaactgaagtgacctgcccagagctgtgtggttaaccctcagtgaaggcagggcaggaacctggcctggggtcctccctgtcaccaccaccccttatctagggaagggctctgcaaggtgttgctaacgtgcacttttgctggcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggtaagccaccaaagcccagtgaaggtgtgatctttaccttttggagcgcaggtccccaaccctcagactgtggacaggcagccatctgtggcctgttaagggg

SEQ ID NO: 8211 - DNA, 2249 bp, Homo sapiens; identical to SEQ ID NO: 8210

SEQ ID NO: 8212 - DNA, 7071 bp, Homo sapiens
gtggggctggtgtccgagcacttctcgcaggccccgcagaggctgtccttctacagctggtacggcagtgccaggctcttccgcttccgcgtgcccccagatgctgtgcttctacgctggctcctgcaggtctcccgggagagcggcgctgcctgcaccgacgcggagatcaccgtgtaggtggctgcccgcccgcctgcccaccctcccgcgcctggccaagccctgtgcctgaacccggtgctgctctcccgtctccaggcacttccgttccggcgcccctccggtcatcaacccgctgggcaccagcttcccggacgacaccgcggtacagccctccttccaggtcggggtgccgctgagcaccacaccgagaagcaatgcctccgtcaacgtttcccacccggcccccggggactggttcgtggccgcccacctgcccccctcatcccagaagatcgagttgaaggtgaggggggctgccctccgggatggaggcagagaaccttgcggcgatggcctgtccctgccgttcacctctttggggtggtcctcgctctaggctccacgctgcactctggggccagccctgctccctgcatgccgggggcgtctggtgagaccatgccctcacacctgcattctctgacaccgcccccgcccacacctgttctttccctagggcttggctcccacctgtgcctacgtcttccagcctgaactgctggtcacgcgggtggtcgagatttccatcatggagccggacgtgccccttcctcagaccctcctctcccatcccagctacctcaagtgagcgggggcctggggggcagcccggctctgccctccggccccttctcagattcggtggagtgggtgcgagagcctggccctgagtcctggggttgggctgggaagtggtccagatgcctggcccccaccagagtgggctgaggaacagcagagcctgggcacgctgcgtccctgggctgaggaatggcagagcctgagccagctgtgtcccctcgctgcagggtctttgtccccgattacacgcgggagcttctgctggagctgcgggactgcgtgtccaatgggagcctgggctgccccgtgcgtctcaccgtgggcccggtcaccctgcctagcaacttccagaaggtgctcacctgcaccggtgccccctggccctgccgcctgctgctgccctcaccgccctgggaccggtggctgcaagtgacagctgagagcctggtggggcccctcgggacagtggctttcagtgctgtagctgccctcacaggtgggccgcacaagggctggagggatggccctgcccctccccagatccccagactttcctccagccaaaccccttgtcctctcggcagcttgcaggccacggagcgtgaccatccagccccttctgcagagcagccaaaaccagagcttcaatgcctcctctggtctgctgtccccgagccccgaccaccaggacctgggcaggagtggcagggtggaccgcagccccttctgcctcacaaactacccagtcacgcgggaggacatggacgtggtgtcggtgcacttccagcccctggacagggtctcggtgagggtgtgttcggacacgccctccgtgatgcggctgcgcctgaacaccggcatggacagcgggggttccctcaccatctccctgcgggccaacaaggtacctgctgtctgcaagcggcctgtggcctgggctcgggcagggcgccgggcaacccctgcagcgcctcctcatttaccttggcacgggacaggcggcacagtgacaccagcaggcacgggccaagacaggggcccatgttggggggcctcccctgctgggcagccttgttcctgtcaacaggccccggggctgtggggtagctcgggtcagaggtggggtggaggcaggatgtcccagggcccggggaggaaggtcccggtgcaccgtgggcctgcaggagtctcagagaaaggcaccagcaccggccgggcgcggtggctcacgcctgtaatcccagcactttgggaggccgaggagggtggatcacgaggtcaggagattgggaccatcctggctaacacggtgaaaccccgtctctactgaaaatacaaaaattagccgggcgtggtggcgggcgcctgtagtcccagctactcgggaggctgaggcgggagaatggcatgaacccaggggcggaggttgcagtgagccgagatcgcggcactgccctccagcctgggcgacagagcaagactccatctcagaaaaaaaaaaaaaaagaaaggcaccagcaccaggctgagctggcacgtggggcagatgaccccactgcggccaggggctgctggagctgagccggcaccgcctccctttccagacagagatgcggaacgagaccgtcgtagtggcctgcgtgaatgctgcctcgcccttccttggcttcaatacttcgctcaactgcaccacaggtatgatgggcaggcgtcaccgtcagcgtggccccggccagccccccgccccggcctcctctgatggggccctctggctcccctgcagccttcttccagggctaccctttgtctctgagcgcctggtctcgcagggccaacctcatcatcccctacccagagacagacaactggtacctctccctgcagctcatgtgccctgagaatgctgagtaagtaaacctagggcagagacgggggccaggcaccctgtcatttcactcaggaccacaggccgggctgcctgaggttggcgttcggagtgacccagctagaggggtgcttcctccagggctgctgaaagctgggggccctaatgctgcgttctcatgtctgtcagcctgttgggagcgctggtggcagctgggctgtcagatcactgcaccagctttcctgtggccccttcctcaaagggactgtgagcaggctgtggtccacgtggagaccaccttgtacctggtgccctgtttgaacgattgtggaccctatggccagtgcctcctgctccgcagacacagctacctgtatgccagctgcagctgcaaggcaggtgagtgccagggccccgcccgccccgagacgctgctgctgttggcttccagtgctgtgctgtgcctttcccctgggggagcgccgcaaggggctggagagagacccttgcagagcaatgcaggggcaaagcctcctccccactcccccattccccaccaacaatccgtctgcctggcacaggcaccaggtatccccggggggtggtactgcctcctgaccttggaccccgcccgccgtgcctaccctgcttgctcctgggtgaggaaggggcttctctgcagggtcctgggtgaggggtgggccctgaggttcagcagtgcccccagcctccgcgtcggggttttgtgaccgcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacggtaggctggcccctcctgcagggatgtggggtgggagggcaggaccgcgctcatggagcctccccacagttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgtgagtggccctcgacgtggggtgtgggctccgggggagcagggcccccaagtgcagcctgcgaaaggcagtaccgtgggagaggccggacctggcgttgggcacggcccctggaaacctcacatctcggccgagcatggtggctcacacctgtaatccctaggccgagcatggtggctcacacctgtaatgccttggccgagcatggtggctcacacctgtaatcccaacacttgcaggaggatcccatgaggccaggggttcaagagcagcctgggctgtacaaaaaatcgaaaagttagccgagcgtagtggtacatgcctgtggtcccagccactcgggagactaaggtgggaggatcgcttgatcccaggcattggaggcgttggagtgagccgaggtcacagcactgcactccagcctgggtgacaaaagaaaagaaaagaaacctcatgtcttctgtgatgccacacggagatgcgggtctgagaccccgcaggcagttgtgagggggcagtgccagctgtttggaggatgccaggaaggaaggtggtaggcaggggaggccaggccccctgccttcgagaagcccccacccatgctccctgggtccttggggccaatgatgctttggggactctctgtggcagctggccctggcaaggggagactcatgccctgggcttgtgagctgcatgctctgccctcccatctgctctgggaactgcaggctgggtactgccccaagggggtgcccatgggagccccacagccagggcagaggggaggctgggaagcaccagggtcctgcagggctgagtgcggggcctgaacctgcagataggcagagaactgtaggctgtgggcagaggtgtctgatggagactggggggtgggagcccctccccatggaacagtgggtgggagactgaagccaccctgatgggggacttctagaaacccagtggtacagggggctagtgagtgtgtgggtgcagagcggccatatgcgtctgtccagtttgtgtgagcatcgtctaatcccccagagatgcctgcctggccacattcacctgtggatgcaatacagaagctgaaggaggggcatgtccctgccggctggcagagctagtcagaggctggcagagctggtctgagggtggcagcagctccgagggggcaggcagaggtgctgtggggccgtggggtacgcgtgctcctgctgggccttgagccctcagagacgtccctgcagtcatccctgtgtcttgcgcaggtgctgtttcttctgggtacactggtcatcgccatgtccttgcagctggaccgcaggggcatgtggaacatgctggggccctgcctctttgccttcgtgatcatggcctccatgtgggtaaggagccgggctggctggcactgctgcccaggtgctcggagaagagagcctggccccttgctctagccacgttcctggtcctgctccaaccagtgaatgcccatatctgctgggggttgccatggcacccacagaggcccagcatggctgtgtccctgaggcctgggcctgaggaccagtggccttgagccccctcgaagcagcccacccttgtcgttctgctgcccagacctgggcaggcccccagtaaccaccgtatctgggccctgggagctgcagccgcggccccacctgcactgatacctgcgtggctgttttctccaggcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccctcttacttcctcctactgaggagagggccacccctccctcacacgcacctctcctcgccagctgcctgctcgctgctgagatccctctgcagatcccagctgctgtctgcagtggcccctggggcctgggcttggttacttggagaccacaggtgcctgtgcgagggtggggctgtgtgctctgctggcctgtgggtggctagagatggggagaaggactccctatggtcctgttccctggcgaggctgtggtgagacccatggcgcccaggagccctgagcccaccactggggccgggagctgtggactccgagacccctgctcctggcccctgtgtggccctgatgccagcctgcctggggcatggaggatccccctctgctgctgtggtcaccatagggacgggagacggaggtttcccccagagctgatgggcactggggatgcaggctcccgccccgcccctccctttttcctggctctggagccttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccgccctggagaagtgagtggctgagacccgggtggggccctcctacccttggctctgggggcttcccttctgggtcttgtccgggatatggccttcctgaaggtcttacctcccccagccgccctgcacttgaccaccaaagcaatctctaagcttataaaggagaaacatatatatatggggttttttggagtaaaggaaaattctaagatattaagacatatttttatgtagatctgatctatctgtgtttggtgaatttaatattctacattgatttttcaaactaaacgagtttttaca

SEQ ID NO: 8213 - DNA, 3158 bp, Homo sapiens
atcggcttccggttccggtgggctctgaaccctgaaaggtgggcgcgggcaggtggggtgtgggggggcgccggggcagaaggggaggggcaggtgggtgcgggacaggggccggagtgagaaccgggggccggggtagggggtagcgggtgagagccgggggccggggtagcgggtgagagccgggggccggggtagcgggtgagagccgggggccggggtagcgggtgagagtcgggggccggggtagggggtgagtgccgggggcctggccaggctgcgactgactgcgagcccccacctcccgccaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaaggtgggtccgcaggcggccttcaggggctcctctcagggcttggctgtgccggctctgtgccggacgcccggggtacctggagagacctgggtgggccctggggattacagcctggaggcgacacatctccggcaaaggagcacgctgagtgaagaaccgcagttctggcaaacaggactgataaagtaggggtgaggtggggtgactcaggccgggggagcaaccagaggccgtggggagtcggggtaaagttaggatggggaggaggcctgtgtgatgagcagagcaggtgggagaggcgagcagagcaggtgggggaggcgagcagagcttcgaggctgcttgtggtggacttcctggcgggactgctgaagcctgtggggagacttgtgtcacctccaggttggaatgtgacaacctgtaaactgtggggtcgcacatgtttctgaaacacatgcagcaaccatgtgaccagggcgggaacgcccagcttgttggggagcagctgacttctgggtacacagtcaggacccgggtcgggctggggcggcactgggctgggggccggcccagttagctctaggtccccagtctgacagcagtggttctgtgatggagcctccgggggggaggtgagggcagttgcctgggccccccttggtatgtaagagaaagcagcagtactcatggaggctctgttgcaccctcagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaaggcaagcggggtggggcgagtcagtgcacacagggtctgggatgggccagtcagactcacgggagccccaggtcagcatcacaccggggcacgctgacatctgcacaggagggtcactgggaaagcgtgagtggggccatgcccctttctggccagcaccagtggggtttcctgccttcaggagaggctgtcgctctgtgggtggctgacttgcccgtggggcctgagcgagcacagccgcccctttccctgcacttggacttgcttctgtgctgatcccaccccccaggctggggtgctgaggcggccccacccgggccttctctgtcctgtcctgggaccaccagcggctagagaggagccaggtgggttggctggaagggtaggtggggccctgccaccagcacctggccccatgtgagccttctgccagaccccgaaggaggacctgtgctccaagtttgggatggacctgaagcgagggatgctgctgcggcttgcccggcaggacccccagctgcaccccgaggaccccgagcggcgggcagccatctacgacaagtacaaggtgagggtttccgtcccgctccctacacctggggactcgtggcccggccctgggcctcactgccctttccatctctgcctgcctaggaatttgccatcccagaggaggaggcagagtgggtgggcctcacgctggaggaggccattgagaagcagagacttttggaggagaaggtgagtgtgtgagcaccagccgatgctgcctgcccagagcctggtgttcagggtctgggagtgtgctgccttggagagagcctgcacaaggggctggtgcactgggtgggcttggggaagagctgctgctctgcattgcccacccagaggagcatggcccgctccctcccctccaagtccccaccctgttctgtcccaggaccctcagtaggaggagtgggttcctgcactgagggtttgctcggccaccagcatcccagggtctggagcctgaggtagctgtcaggacagggagcccctgatggcatggcagctggctgcccctattccctctgtttatccatgaccacagggatgggacaggggtatgtgtgtgcctccggcatccccaagggagggggttcctcatctcaccgacaggactctgccctccagggcctctcatgccccggttcctctgggcggcagctgctgatcccatccccgtcggaactccagctgccctgggcttccctggcctcaccatgagcccctctctccttcaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggctgtgtgtgtgtatcttt

SEQ ID NO: 8214 - DNA, 1533 bp, Homo sapiens
tttaaactactgcatcaggaaatattgtaaaacagttttgccttgaatatttgtgatgaaatctacgatgatcttcaagattctcttaattttgctaatattcagctgatcagaatttgtttttaaaatgtctggctggtgggtacttcccactgacaactgcttattgcttacagtatgtctgccttgtcaatgaatgaggttcagggtgcttcctagggatcagagtcagtaccatttttctctttcatctacagctgatcagatgtttattttacttacattaaatgaatgatggagatccaaagtgaatattatagaatattattctaggatcaacatcttttgctttgaaaaatcaacatctcttggcttttcctcagccaacccagcaaacagagattatcagactctgttgattttttactttcatttggcattggcctttttcttactgaaattaaaaaggctaatgatttgcctggtttctgtctctgacctttgcaggtctattttcttaatttttagatactatatatctgaaactttttttaatgtgtcaactttttaatggatagaaaatagacacgaatagtgattatgtgttcatttttcaattttccagaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatgggtgtaacatatgtattcccttc

SEQ ID NO: 8215 - DNA, 9692 bp, Homo sapiens
  misc_feature (4436)..(4436): n equals a,t,g, or c
ccacgccagctaatttttgtatttttggtagagacagggttgcatcatgttgcccaggctggtcttgaatgcctgagctcaagcaatctatttgccttggcctcccaaagtgctgggattacaggcatgagccaccacggccagccttctcatttgttttttttataaggaagctatctcttcttccctccccaactagggtattctttttccctttcgtcactttgctcatgtactgtattccttcaacttcattaatgaatccatttggaagcagtgaaaaaggcaactcagaaagctaagaagaaatagatagaggaatactcagagctatctgagtattttctttagtttgttagctctttggagctttgaaactggaaagacccagggagtgatgtggagaaagagactgagcttgtaagacacaggagcagtgagctaagggagatggagtagtggggacaaattctggcacattctgtctacactctgggtagatagaggagggaggatggagcacccatggtgggggtatgttggtgacagcattttcccaccagccagtgtaacaagtggctgatttgggggaaagatggcataaacaaatgagagaatgtgtttactatttgatgtagatgggttatttgcttcatttttcaaatcagtgtatataatcaagaatattcagcatgtttgaatagactgtcagagctggaactctttcattaacatctctggcacctttagttttagccctgaacattttatcttaaaattaaacattaccaaatgccttagtttatttcatttattaaatttatattcttatttgttatttatatcagcttccaatcagaagactatacaacctcctagggtaagttaaagtttattaaatgaattgtgaatgatcatttgagggattagactgaggaacttggtaattgagatattttgctatctgttttgtctcacgtcaaattaagagaatggtgaagtcattgcatgacctttgcatgaatgggtccagttctattttaaaacctgtgtttggtcattttagtgtcaatgggatggaataaatgatttcttaagattgtactgacttctcacacccaaaactggaaagtaggaataatggctatattatctctgcaatcagaaggaagctgattccaatatatcacctcacctgttggattcattggatgtgcatacacagaatgacaatttcaggcttaaaaatgaggagaaatctatactaagttgacatcactgataattataatctataaaataaatgtaaatattgctgaaaacatctgttcggagttatgattcgatcctctcccatacaaatgttttataaacattttttcccttaaaactgtgcttaaggtttcattgtaccttagataccttattaagccatctgaggaaattgcaagaaaggagtaattttaggagggcataaatgaagagaaaagcatatttataaacatagacttatcacagtgacaggcccaagaggtatgttgtggacataagctctggaaaggattatattgtacttagcttcctataacggagtgatgatagatgtatctggaatgccaaagagagtcttctgtctgtggccggaggtagaggtcacatatgcttctaagtctgacaagcctcattgtgcctaaagggcaggtggggcgggtatgtgtgtctaccacaggggtatattctagaaagattggtgccatagctatgttggtcacaagaggccagcaacttaactggacctgtgaatcctaacacattttctttcccagttactgagttcaatttgcgatacttaaagatgattctgttttgcttccacctcttcactgtgttatttattctgttgttgctatttatgcttgcactttcatatttttagaagttagaatttcttgagctgagagtggtgaagtgggaaattctgtttagaaaaataatattaagagaataatacagttattattaaactattaacccgacttggcaagctttgctttaacatttacaggcttatttcgttgttttgttttttcttttttttttgactgtaggatttactgcttactacgtaatttaaatattagcatatataagttttactataaaatgacatgacataaattatatttttatgtaaatatattttaaatatttttcagaaagctgtagaggaaccccttaatggtatgtggttatttcactcttaatcctttaccagatcataatttgatctggcccgcaaaacagttagaatgccctgtctatgccttaggaagaatctaggtttttttcctctttttttctttccttggcatctctactcttgattattcatcaagaattatgggctgggtgcggtggctcacgcttgcgatcccagcaccttgggaggccaaggcgggcagatcacgaggtcaagagattgagaccatcctggccaacatgttgaaaccctgtctctactgaaaatacaaaaattacctgggcatggtggtgtgtatctgcagtcccagctactcgggaggctgaggcaggagaattgcttgaacccggaaggcagatgttgcagtgagttgagatcatgccaccgcactccagcctggtgacagagtgagactctgtctcaaaaaaaataaaaaagaattatgaatattacttttataatattctcaccactgggaaaaatgcactattctgtgtctaagtagctgcttaccttaaccaagtgatatttgggcaaggggatcgttgccttttgctactggttgagacgaagcatggcaccccctagtagagaaggatcccaattacttccaatttgtgatgtacacattttagaaagatacaggctattgccacagagatagaccaaaacatctcattttctttctttgtaaacctagatctgatttcccaactaagtctgtttcctttgtgaatgctgtgggtatgatccacagaaaggctacataatgaaatgatagctttacaattaatttggctgtagagttgtagactagttagcatatcattgcatatttgtttatttagaaatgatttccaattgtggaacctcactaactgcctgcttggcttgttactaatcctagcattcaaagaatcaaaaggaatgatgaatgatggtaagtataaaatgcacttaataattatagatcagttaaaacatggacattggaaaacaaaaaagcttcttgaaaatgtggctcttttttagtaaaagggacactgtcagatgataaaggttcacatttcttgatgtatacaacttaaatctactttgctaaaaattgcaaaactactactgtaaaaactgtagggtgtcacgaatcagactccagtcatatggctcccagcaaagagaaattaccactttttgtaaaatgtttttcagattccgtgtctggtgactgtaactttaagatgccttttataaggcacataaataatctggcacaaatctttatcattttgacagagtttcttttatgcttgtgttggtgattttgttgcatttaaccccatggggacttaacatctctgcttttccaatcaggagcttggttctaaccttttgggagatgattaaagagagaggttgagagagagagagagagagagagagagagagagagagagatgtttcgtcctcagcttttgcttccattttttttttaagaactctgggctaataacttctaatctttatagaatatttcaaagaaatatatttgttcttaaagatacataggtttgagatattgagtgctacaagcatttattttggttttaccttaacatattatgattcctcagttttgttggcatttagtaattatgtttatgtttttatcttatcaaaaaatgtcttcttacctttgatatttataatcactcctcggtcatgtaaatagtttgctttatattttactgttttaaagtctgtgaccttacctgccctcttctgtagcaaagtgcagcatttaactcaggaagctatattccccccaagtgtcattaatatttgcataagattaaaaacactccagtcggccgggcgcggtggctcacgcctgtaatcccagcactttgggaggccgaggcgggcggatcacaaggtcaggagatcgagaccatcctggctaacacggtgaaaccccgtctctactaaaactacaaaaaattagccgggcatggtggcgggcacctgtggtcccagctacttgggaggctgaggcaggagaatggcgtgaacccgggaggcagagcttgcagtgagccaagatcgtgccactacactccagcctgggtgacagagcaagactccgtctccagaaaaaaaaaaaaaaaaaaaaaaaaancactccagtcatgcattggtgaacaaagtttaaaacaacgtgtattcagcatggagtcacagaatgatcctacttttgtatgtttgtgtcacagcctttaaaagcatgtcttgttatataagccattaccctcctaaaaaagactatagttcacaggaataagttaaaagacataacaaaacataaaatgactagtaccaggaattgtgaccatggtttgttctggtaactgtggcatggcatggtttgttccaggaattgtggcatggtttgttcatgtttacattctgatgtcctattttttttttttaatttctatgtcctttccttttccttggtggtgtcattgttctgtagctgtatgaagaaactaaacttttctccattttcaggaaagcaatctaagaatcttgagtgcctcttcctttgttaatttctcttaagatgtgacttttttaaactactgcatcaggaaatattgtaaaacagttttgccttgaatatttgtgatgaaatctacgatgatcttcaagattctcttaattttgctaatattcagctgatcagaatttgtttttaaaatgtctggctggtgggtacttcccactgacaactgcttattgcttacagtatgtctgccttgtcaatgaatgaggttcagggtgcttcctagggatcagagtcagtaccatttttctctttcatctacagctgatcagatgtttattttacttacattaaatgaatgatggagatccaaagtgaatattatagaatattattctaggatcaacatcttttgctttgaaaaatcaacatctcttggcttttcctcagccaacccagcaaacagagattatcagactctgttgattttttactttcatttggcattggcctttttcttactgaaattaaaaaggctaatgatttgcctggtttctgtctctgacctttgcaggtctattttcttaatttttagatactatatatctgaaactttttttaatgtgtcaactttttaatggatagaaaatagacacgaatagtgattatgtgttcatttttcaattttccagaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagctattttgttgggctatttctattgctgctacagcagaccacaagcacatttctgaaaaatttaatttattaatgtatttttaagttgcttatattctaggtaacaatgtaaagaatgatttaaaatattaattatgaattttttgagtataatacccaataagcttttaattagagcagagttttaattaaaagttttaaatcagtccaa

SEQ ID NO: 8216 - DNA, 16423 bp, Homo sapiens
tttcttttttaagcacttaaatatagatccggtggtatggatgagaaaacaattgctttacttgttgctggactagtgatcactgtcattgtcattgttggagccattcttttcgtcccaggtaagatgtgcagttcctaggcaggaacgcaggaggtagatgagtgcattccaaggtgaggagggctgcattagtttcctagggctgttggaacagatgaccacaaactgggtggcttaaacaatagcaattccctttccatgctggaggccataagtctgaaatcaggacgtcatcagggccacactccctctcaaggctgtatggaagaatccatttcttggctcttctagcttctggaatttgctgaagaatgacagtgtttatcattccttagtttgcggcagcataactccaccctctgcctctctggtcacattgcctcctccttcctctatgtctttgcctctgtgtttttgttaaatctccctcagcctctctcttatgagcacatttgtcattggaattagagcccactcatataatccagggtaagctcctcctttcagatccttaacttcatcatatcttttgccatataatgcagtattcactcttttgctgtattaggtaatattcacaggttttagggattaggaggtagaaataattttagggccatcattcaactcactacagaggcaaacttcattggccaagacatgaaagtagaatgaatgtgggaaccaagtctggaaattggcagttgcatttggaggatgggaatgtgagtgggaaatgaggatatgtagcacatgtaaagaaaagcaaaggaaggctgggactcaacctaataactatagcacaccatcgtttgtggagaagaatgcagtgcaggtgtaatatttaggaacatgggcttggcagctctattggtatctgaagttagtgaagacagcaggaagaaggaggtgaattcagaagacaacttgaaggaacaattgatttgactttggggcatactgaatacagcagatgaagggaacagtaaaagatgaatacacagtttctcactggaattctgtaaactagttaagaaggaggcagagccaattcaaggtttcagcatgttgaaacttaaatgttgagatttagatgtcttaagtttggtcttaatcaaaaaatagtcactaattttgtgtgaggttttcagggaaacgtatatttttaaaattttcacagttgtcaagcacagaatttagattagtacatttaaaaagtatgtaggaaaatattttaaatgtttttatttattgacaggtgaatattcattaaagaatgctactggccttggtttaattgtgacttctacagggatattaatattacttcactactatgtgtttagtacaggtgagttttcattgttacagtatgattttgtctacctttttcatttacaaaacagcagttttggtgaaaatgctcatataaattttttacaactcaataagagtaggtttattaaaagatttttcatgctattcttagtgacattttcccattcatattaattttaaggttattctaggttagctgttttgtaaaaagtgactttcatatgtatttgatgccaatcagcataattttaaattatgccatataacttcttaatgattattttcatattctaatttcagttttttgaagttataagtggatgttaaacgcagtctttctcttcttttgctaagcttctgcttctgcattaagaagactggttctataaaatggaattatgaatcacaaatagtagaaacatatttgttttaattattagcaaaccttaatactgtagttttaagagatggtatggaaatccaaactataatcagtatcattttcactgcattttgaaagtagatcactaccatatttagttattactattaaagagtcacatttaacacttggtcttagagcctatctctggctcgttgtacattggaaaggtattagtttgttataaaatgacatctagagatagagagcatgatgtttacagtcaggtatttgcataatggttccctcagcaagagcaattccatgtgcatgtggagaagacattcataatagccattcatattgtaaaatgcacaagtgtggtaaaagcagcattgttctaagatttagggtaaaaacttccagtccagcttagctgactgtgaaaattaaaggctgccgaatgtgtgaatttggagctgactacttgtgtggaagggttagatcactgagttaacatctaccgtcaaacaatgaactccagagtcagtctttggtcttaggagatccctgattataccaaatgcaagtggaagttattgctttttaaatactcttgacatgcttctgttacatccttttccttcctccagcgattggattaacctccttcgtcattgccatattggttattcaggtgatagcctatatcctcgctgtggttggactgagtctctgtattgcgggtaagagtcatctttctgtagacctaatttgggttacttttggacagagctcttcttcctttttctttttctttctctctttttaaaaatatatagacttgatttttttttttagtgcagtttttggttcatggcaaaattgagtggaaagtacattcacatggatatttttatgtggacataagttttcaattccatttgggcaaataccaaggagtgcaattacgggactgtaaagagtatgttgaaataaactgccaaactctctgtatcaaaatagctgtaccattttgtattatcaccaccaataaataagagtttttgttcattcatatacttgacagcatttagcattctgagcttttctttttaaacttccaatttaccccagtggtaatagtgctttcctcctcgctacaaagatattagctgtatatatggcttggtggctgattgttctagcacccaaactgatatgcctgtatttgtggaagagcttttaaaataactgggctcaaattggttggagccttagacttgaaacaccagttcccatttcttgatatgataaggtatgtgttatgcaaaggagggctttgttcttctaataattttgagtcattttactggttaagttaataaacatatatggataatttttgttttttgatcgttagaataactctcttaaaacttgggattattactgttttttagtaagttatttcatatgcttttctaatacagaattttatttgtttttacagcgtgtataccaatgcatggccctcttctgatttcaggtttgagtatcttagctctagcacaattacttggactagtttatatgaaatttgtgggtaagtcaatcttattttcattaacctatgccaataatttcagatatatcacttagaaaatgctttttagtttgttcttccagtttaggaccaaaaatgagaaaatacaattggagtgattcgaggataattaaagagggtagaagacatataggatttttagttggttcttccagtttaagaccagaagtcagaaaatacaattggaatgatttgagggtaattaaagagggtagaagacatataggattaatgaaaatttggtttccaaagtagtttaaaggaaaatggctttatctattagaatgtgtacctttttatactaagtaaaaggggagagatctttgaggatccattttaagtaatagaataggatttttaattgttccagtgtttctgtgatagagctgtcctgcacagacctgtttgtttgtcacttgctctttttcttgcagacatagacaccccagacaggaattaaaattcacaatctatcaattttgttcatttaaagagcagtgacctctaatgcatgactttaaaacagttctagttaaaaccaatataatgaaaacattgagtttcaaaatttaggcttttactccttttaaaatcaattattagtaagtatggaatttacttcattgtttctaacttgtatatttaatctgccaattttcaagtaacatttctgcataaattcttattttttattgagatatatgtacacagagagatattttcaattgtgcctgaaactaatgttatcttacctaagctcaagatgttcccaataatgtaatttatattagtttccgttttttaaaaaaattatatttttatgaaataaaacatactcttaaccacctatcaaaataatcaaaagttataaattaatggagtaaaaaaatagtgtttctgctttgctttaggtaaactttgctgtatgtgtttctaaaacttaatacgaaacttgaattgttatagtcaaataatttctcatatgactcacataatagtttcaaaaaacttttacctttatttctgaactttggttcttgatgattgttaattgaattcaattctgtcatatattctgtgtctttctttaattaatgcttattagataaataattaaaatacttaactaatatctgcgtatccttagcatatgagttcataagtcttagttgttgctcaatgaaattttctaattttataccacataatgccataaaatacaatggagacatctaaagcagaatggaattcatgtggtagctacagtgaacatcttgaatgttggtgcatattctatttttgttacatcttccaatcaccatgtgtctggttctggaagatgacactcctggttttgttgctccccacaaatgcctgagaatagtgtgtgatttgcagtatccatacaactctggtgaagtagtatgagatacctttggctgacgggcagcacgctcttattttttcctcactatctgggttgtcctcccttttactcccatgccaccccatgccttccatatctagcatagaatgatcttcagtacagttgccagcaggtctggtgacaatgtctcaagtggaactaagcattgtctatctgccacctccttaacttcactctcctgccttctccatcacttacgttcctccaagcctgtgaaaccactgtactgtacctgtcactgttctgacattaaaattaaaatgacttaaatcttgacaagtaccccaaattattttttctttgtcataggttagcatataagtatactatatgctaaaatttatgctatatgtttaaaatttagtgcaattttattgatagtgtcctaattttattgatagtatcctaaattaactttttaaatcaacttgtctgatgccagggttcagagggacacctacagtcagttgaaaggcaagaagagacaaggtacaggaaagttgctctttagataacatggtagactaggaggaacattaatatggtttgcttatataatctgactgtgtaaatctgaatctatgtaacattaaggttgcaaatttgagcgtttatattaggaagttaaaattttaagtgtctccaaaataatttttactcattgcacgtgttctgttttagaaaagcctaatgattgtgttttgatttaaatgcaataaaatcctcaaatagttaaaaatccaagctttctcttcaagaagaagttaatgtcgctatgagatttttaacttttataatttttattatttccaactttaaatttgtagccttaatttgctattttaaagagtaggcctttcactttctacaactttctgtgaaagtgactttcactttctattttttaactttttaaactgtgttgtattttttttcttttattggaagcattttaattttataagatgagaaaaaggactgggcacaataacttaatgtgaaagcatagaaaagattacaagaacctaaccaaactcactaaagttgggcttgttgtttgtagagaacgtttatataattataaggatcaatactttctcatttttaaagccattaccagttagttcaatataagggcatatagtgttttgatacaaatcaatctggtagcagtaagtaccatatttaccacaacatcccagatttttagaatgatgcatatgcagaactatacgtagaatttatatctatgtatagatacatattcagatattttcttgttcaatttaaggagaggtaaatttggtatcaatagaaaaaatgtttctgaaaaatttaaaccctggaaatgtatttatggcatggagtcagatgtttcagggagagaagaacaaatcaagaagcattgcaagtatgctcatatggaatgcttaaggcttgtggttaaaaaatatatatatatggctgtcaatgtcttaggctcatggtagcagcagaaatcgtaataattcttttgtcacatgggttatatccatattggagagaattaactcaggtgaaattaacttgtacactgtttggttttataatatttagagggatcacaactgactgatgtccctttgaagtaccattcttcataaatctttttttttcagaatgggccagccaactgtgacatcccttggatcggagatttagaactagaaagtattctttctacattattagggaagaaaaggagttacttggcggttagcaatattctattttgttttgttttgtttttagagacagggtctcattatgttgaccaggctggcctcgagctcctgggctcaagcaatgctcccacctcagcctcccaagtagctgggactacaggcatgtgccactacacctggcagtgtttattctgataaatacatttatgagctcaaaaatgtaactctaaaaccttatctctgaacttccatattaccatcagaaatttagatagttgtttagttctctttttctttgtagaacatagatataaggcatggtttcattgaagtcagttgtatatacatgtaactatcctgatgttcccaaataaagctctgtatttctgcttagtttattggggaggctgctaaatgtagtgcatcccaacccattttaccctgttctactttaaaaagaggttggcttcttgtttggatacaaggaccaagtcactcccccaggttcctccacagtaagggaggcctatttaaagccgcccatggcactaacagaaactggactcctatgagctcagatacataactgggcctcacaggggtgggacagtatgtagtctaggaattggaaggatccattccatatcaaagaactgaagcatcgtgttgccctctcagcagcaagagtaaggtgatgcccctgtcagttatagttcctgagttcctctgtctttgattctttgcctattagccagctagctcaccctcttgtttatgccactgttttttatcctattcatgccttctcacagacaacttttcttacctacagctttggactcatccttgtctcctttctgtttctttttcactttcccttcccatcaccaactttctgggtttttttctgtttcttcttagagtccagtggcagggagaaacttgtcagtccagtctgttgccatttttcctgtttgagaaagactcaccagcttttggctggctcacagattggctttccttgggtcaggacccacccttttccctgccagctttggaagcttgacagaattcgagtgtgcagtggtggtaaataaatagtaaggaacacagagcagtcctggaggcgtgcctccatctgctgatgagaaaatccagtgctgtcatccagcccaggtcccagcggaatgggcctctctgttcagtaggatccccctcctgctgagtggttcatggcatgtttctgttcaacgcttttccatctgtaggattcttattctgtatttatttgtttttttgggtttttttattttttgagatggagtctcgctctgtcgcccaggctggagtgcagtggcacgaccccagctcgctgcagcctctgcctcccaggacgagggagatcctcccacctcagccttccacgtagctgggactacaggcatgcaccacaggcatgcaccaccacgccagctaatttttgtatttttggtagagacagggttgcatcatgttgcccaggctggtcttgaatgcctgagctcaagcaatctatttgccttggcctcccaaagtgctgggattacaggcatgagccaccacggccagccttctcatttgttttttttataaggaagctatctcttcttccctccccaactagggtattctttttccctttcgtcactttgctcatgtactgtattccttcaacttcattaatgaatccatttggaagcagtgaaaaaggcaactcagaaagctaagaagaaatagatagaggaatactcagagctatctgagtattttctttagtttgttagctctttggagctttgaaactggaaagacccagggagtgatgtggagaaagagactgagcttgtaagacacaggagcagtgagctaagggagatggagtagtggggacaaattctggcacattctgtctacactctgggtagatagaggagggaggatggagcacccatggtgggggtatgttggtgacagcattttcccaccagccagtgtaacaagtggctgatttgggggaaagatggcataaacaaatgagagaatgtgtttactatttgatgtagatgggttatttgcttcatttttcaaatcagtgtatataatcaagaatattcagcatgtttgaatagactgtcagagctggaactctttcattaacatctctggcacctttagttttagccctgaacattttatcttaaaattaaacattaccaaatgccttagtttatttcatttattaaatttatattcttatttgttatttatatcagcttccaatcagaagactatacaacctcctagggtaagttaaagtttattaaatgaattgtgaatgatcatttgagggattagactgaggaacttggtaattgagatattttgctatctgttttgtctcacgtcaaattaagagaatgttgaagtcattgcatgacctttgcatgaatgggtccagttctattttaaaacctgtgtttggtcattttagtgtcaatgggatggaataaatgatttcttaagattgtactgacttctcacacccaaaactggaaagtaggaataatggctatattatctctgcaatcagaaggaagctgattccaatatatcacctcacctgttggattcattggatgtgcatacacagaatgacaatttcaggcttaaaaatgaggagaaatctatactaagttgacatcactgataattataatctataaaataaatgtaaatattgctgaaaacatctgttcggagttatgattcgatcctctcccatacaaatgttttataaacattttttcccttaaaactgtgcttaaggtttcattgtaccttagataccttattaagccatctgaggaaattgcaagaaaggagtaattttaggagggcataaatgaagagaaaagcatatttataaacatagacttatcacagtgacaggcccaagaggtatgttgtggacataagctctggaaaggattatattgtacttagcttcctataacggagtgatgatagatgtatctggaatgccaaagagagtcttctgtctgtggccggaggtagaggtcacatatgcttctaagtctgacaagcctcattgtgcctaaagggcaggtggggcgggtatgtgtgtctaccacaggggtatattctagaaagattggtgccatagctatgttggtcacaagaggccagcaacttaactggacctgtgaatcctaacacattttctttcccagttactgagttcaatttgcgatacttaaagatgattctgttttgcttccacctcttcactgtgttatttattctgttgttgctatttatgcttgcactttcatatttttagaagttagaatttcttgagctgagagtggtgaagtgggaaattctgtttagaaaaataatattaagagaataatacagttattattaaactattaacccgactaaacaagctttgctttaacatttacaggcttatttcgttgttttgttttttcttttttttttgactgtaggatttactgcttactacgtaatttaaatattagcatatataagttttactataaaatgacatgacataaattatatttttatgtaaatatattttaaatatttttcagaaagctgtagaggaaccccttaatggtatgtggttatttcactcttaatcctttaccagatcataatttgatctggcccgcaaaacagttagaatgccctgtctatgccttaggaagaatctaggtttttttcctctttttttctttccttggcatctctactcttgattattcatcaagaattatgggctgggtgcggtggctcacgcttgcgatcccggcaccttgggaggccaaggcgggcagatcacgaggtcaagagattgagaccatcctggccaacatgttgaaaccctgtctctactgaaaatacaaaaattacctgggcatggtggtgtgtatctgcagtcccagctactcgggaggctgaggcaggagaattgcttgaacccggaaggcagatgttgcagtgagttgagatcatgccaccgcactccagcctggtgacagagtgagactctgtctcaaaaaaaataaaaaagaattatgaatattacttttataatattctcaccactgggaaaaatgcactattctgtgtctaagtagctgcttaccttaaccaagtgatatttgggcaaggggatcgttgccttttgctactggttgagacgaagcatggcaccccctagtagagaaggatcccaattacttccaatttgtgatgtacacattttagaaagatacaggctattgccacagagatagaccaaaacatctcattttctttctttgtaaacctagatctgatttcccaactaagtctgtttcctttgtgaatgctgtgggtatgatccacagaaaggctacataatgaaatgatagctttacaattaatttggctgtagagttgtagactagttagcatatcattgcatatttgtttatttagaaatgatttccaattgtggaacctcactaactgcctgcttggcttgttactaatcctagcattcaaagaatcaaaaggaatgatgaatgatggtaagtataaaatgcacttaataattatagatcagttaaaacatggacattggaaaacaaaaaagcttcttgaaaatgtggctcttttttagtaaaagggacactgtcagatgataaaggttcacatttcttgatgtatacaacttaaatctactttgctaaaaattgcaaaactactactgtaaaaactgtagggtgtcacgaatcagactccagtcatatggctcccagcaaagagaaattaccactttttgtaaaatgtttttcagattccgtgtctggtgactgtaactttaagatgccttttataaggcacataaataatctggcacaaatctttatcattttgacagagtttcttttatgcttgtgttggtgattttgttgcatttaacccatggggacttaacatctctgcttttccaatcaggagcttggttctaaccttttgggagatgattaaagagagaggttgagagagagagagagagagagagagagagagagagagagagagagagagatgtttcgtcctcagcttttgcttccattttttttttaagaactctgggctaataacttctaatctttatagaatatttcaaagaaatatatttgttcttaaagatacataggtttgagatattgagtgctacaagcatttattttggttttaccttaacatattatgattcctcagttttgttggcatttagtaattatgtttatgtttttatcttatcaaaaaatgtcttcttacctttgatatttataatcactcctcggtcatgtaaatagtttgctttatattttactgttttaaagtctgtgaccttacctgccctcttctgtagcaaagtgcagcatttaactcaggaagctatattccccccaagtgtcattaatatttgcataagattaaaaacactccagtcggccgggcgcggtggctcacgcctgtaatcccagcactttgggaggccgaggcgggcggatcacaaggtcaggagatcgagaccatcctggctaacacggtgaaaccccgtctctactaaaactacaaaaaattagccgggcatggtggcgggcacctgtggtcccagctacttgggaggctgaggcaggagaatggcgtgaacccgggaggcagagcttgcagtgagccaagatcgtgccactacactccagcctgggtgacagagcaagactccgtctcaagaaaaaaaaaaaaaaaaaaaaaaaaaaaacactccagtcatgcattggtgaacaaagtttaaaacaacgtgtattcagcatggagtcacagaatgatcctacttttgtatgtttgtgtcacagcctttaaaagcatgtcttgttatataagccattaccctcctaaaaaagactatagttcacaggaataagttaaaagacataacaaaacataaaatgactagtaccaggaattgtgaccatggtttgttctggtaactgtggcatggcatggtttgttccaggaattgtggcatggtttgttcatgtttacattctgatgtcctattttttttttttaatttctatgtcctttccttttccttggtggtgtcattgttctgtagctgtatgaagaaactaaacttttctccattttcaggaaagcaatctaagaatcttgagtgcctcttcctttgttaatttctcttaagatgtgacttttttaaactactgcatcaggaaatattgtaaaacagttttgccttgaatatttgtgatgaaatctacgatgatcttcaagattctcttaattttgctaatattcagctgatcagaatttgtttttaaaatgtctggctggtgggtacttcccactgacaactgcttattgcttacagtatgtctgccttgtcaatgaatgaggttcagggtgcttcctagggatcagagtcagtaccatttttctctttcatctacagctgatcagatgtttattttacttacattaaatgaatgatggagatccaaagtgaatattatagaatattattctaggatcaacatcttttgctttgaaaaatcaacatctcttggcttttcctcagccaacccagcaaacagagattatcagactctgttgattttttactttcatttggcattggcctttttcttactgaaattaaaaaggctaatgatttgcctggtttctgtctctgacctttgcaggtctattttcttaatttttagatactatatatctgaaactttttttaatgtgtcaactttttaatggatagaaaatagacacgaatagtgattatgtgttcatttttcaattttccagaataactgaagtgaagtgatggactccgattagaagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttggtttttt

SEQ ID NO: 8217 - DNA, 7474 bp, Homo sapiens
aagctgtagaggaaccccttaatggtatgtggttatttcactcttaatcctttaccagatcataatttgatctggcccgcaaaacagttagaatgccctgtctatgccttaggaagaatctaggtttttttcctctttttttctttccttggcatctctactcttgattattcatcaagaattatgggctgggtgcggtggctcacgcttgcgatcccagcaccttgggaggccaaggcgggcagatcacgaggtcaagagattgagaccatcctggccaacatgttgaaaccctgtctctactgaaaatacaaaaattacctgggcatggtggtgtgtatctgcagtcccagctactcgggaggctgaggcaggagaattgcttgaacccggaaggcagatgttgcagtgagttgagatcatgccaccgcactccagcctggtgacagagtgagactctgtctcaaaaaaaataaaaaagaattatgaatattacttttataatattctcaccactgggaaaaatgcactattctgtgtctaagtagctgcttaccttaaccaagtgatatttgggcaaggggatcgttgccttttgctactggttgagacgaagcatggcaccccctagtagagaaggatcccaattacttccaatttgtgatgtacacattttagaaagatacaggctattgccacagagatagaccaaaacatctcattttctttctttgtaaacctagatctgatttcccaactaagtctgtttcctttgtgaatgctgtgggtatgatccacagaaaggctacataatgaaatgatagctttacaattaatttggctgtagagttgtagactagttagcatatcattgcatatttgtttatttagaaatgatttccaattgtggaacctcactaactgcctgcttggcttgttactaatcctagcattcaaagaatcaaaaggaatgatgaatgatggtaagtataaaatgcacttaataattatagatcagttaaaacatggacattggaaaacaaaaaagcttcttgaaaatgtggctcttttttagtaaaagggacactgtcagatgataaaggttcacatttcttgatgtatacaacttaaatctactttgctaaaaattgcaaaactactactgtaaaaactgtagggtgtcacgaatcagactccagtcatatggctcccagcaaagagaaattaccactttttgtaaaatgtttttcagattccgtgtctggtgactgtaactttaagatgccttttataaggcacataaataatctggcacaaatctttatcattttgacagagtttcttttatgcttgtgttggtgattttgttgcatttaacccatggggacttaacatctctgcttttccaatcaggagcttggttctaaccttttgggagatgattaaagagagaggttgagagagagagagagagagagagagagagagagagagagatgtttcgtcctcagcttttgcttccattttttttttaagaactctgggctaataacttctaatctttatagaatatttcaaagaaatatatttgttcttaaagatacataggtttgagatattgagtgctacaagcatttattttggttttaccttaacatattatgattcctcagttttgttggcatttagtaattatgtttatgtttttatcttatcaaaaaatgtcttcttacctttgatatttataatcactcctcggtcatgtaaatagtttgctttatattttactgttttaaagtctgtgaccttacctgccctcttctgtagcaaagtgcagcatttaactcaggaagctatattccccccaagtgtcattaatatttgcataagattaaaaacactccagtcggccgggcgcggtggctcacgcctgtaatcccagcactttgggaggccgaggcgggcggatcacaaggtcaggagatcgagaccatcctggctaacacggtgaaaccccgtctttactaaaactacaaaaaattagccgggcatggtggcgggcacctgtggtcccagctacttgggaggctgaggcaggagaatggcgtgaacccgggaggcagagcttgcagtgagccaagatcgtgcccctacactccagcctgggtgacagagcaagactccgtctcaagaaaaaaaaaaaaaaaaaaaaaaaaaacactccagtcatgcattggtgaacaaagtttaaaacaacgtgtattcagcatggagtcacagaatgatcctacttttgtatgtttgtgtcacagcctttaaaagcatgtcttgttatataagccattaccctcctaaaaaagactatagttcacaggaataagttaaaagacataacaaaacataaaatgactagtaccaggaattgtgaccatggtttgttctggtaactgtggcatggcatggtttgttccaggaattgtggcatggtttgttcatgtttacattctgatgtcctattttttttttttaatttctatgtcctttccttttccttggtggtgtcattgttctgtagctgtatgaagaaactaaacttttctccattttcaggaaagcaatctaagaatcttgagtgcctcttcctttgttaatttctcttaagatgtgacttttttaaactactgcatcaggaaatattgtaaaacagttttgccttgaatatttgtgatgaaatctacgatgatcttcaagattctcttaattttgctaatattcagctgatcagaatttgtttttaaaatgtctggctggtgggtacttcccactgacaactgcttattgcttacagtatgtctgccttgtcaatgaatgaggttcagggtgcttcctagggatcagagtcagtaccatttttctctttcatctacagctgatcagatgtttattttacttacattaaatgaatgatggagatccaaagtgaatattatagaatattattctaggatcaacatcttttgctttgaaaaatcaacatctcttggcttttcctcagccaacccagcaaacagagattatcagactctgttgattttttactttcatttggcattggcctttttcttactgaaattaaaaaggctaatgatttgcctggtttctgtctctgacctttgcaggtctattttcttaatttttagatactatatatctgaaactttttttaatgtgtcaactttttaatggatagaaaatagacacgaatagtgattatgtgttcatttttcaattttccagaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagctattttgttgggctatttctattgctgctacagcagaccacaagcacatttctgaaaaatttaatttattaatgtatttttaagttgcttatattctaggtaacaatgtaaagaatgatttaaaatattaattatgaattttttgagtataatacccaataagcttttaattagagcagagttttaattaaaagttttaaatcagtccaa

SEQ ID NO: 8218 - DNA, 8389 bp, Homo sapiens
ccacgccagctaatttttgtatttttggtagagacagggttgcatcatgttgcccaggctggtcttgaatgcctgagctcaagcaatctatttgccttggcctcccaaagtgctgggattacaggcatgagccaccacggccagccttctcatttgttttttttataaggaagctatctcttcttccctccccaactagggtattctttttccctttcgtcactttgctcatgtactgtattccttcaacttcattaatgaatccatttggaagcagtgaaaaaggcaactcagaaagctaagaagaaatagatagaggaatactcagagctatctgagtattttctttagtttgttagctctttggagctttgaaactggaaagacccagggagtgatgtggagaaagagactgagcttgtaagacacaggagcagtgagctaagggagatggagtagtggggacaaattctggcacattctgtctacactctgggtagatagaggagggaggatggagcacccatggtgggggtatgttggtgacagcattttcccaccagccagtgtaacaagtggctgatttgggggaaagatggcataaacaaatgagagaatgtgtttactatttgatgtagatgggttatttgcttcatttttcaaatcagtgtatataatcaagaatattcagcatgtttgaatagactgtcagagctggaactctttcattaacatctctggcacctttagttttagccctgaacattttatcttaaaattaaacattaccaaatgccttagtttatttcatttattaaatttatattcttatttgttatttatatcagcttccaatcagaagactatacaacctcctagggtaagttaaagtttattaaatgaattgtgaatgatcatttgagggattagactgaggaacttggtaattgagatattttgctatctgttttgtctcacgtcaaattaagagaatgttgaagtcattgcatgacctttgcatgaatgggtccagttctattttaaaacctgtgtttggtcattttagtgtcaatgggatggaataaatgatttcttaagattgtactgacttctcacacccaaaactggaaagtaggaataatggctatattatctctgcaatcagaaggaagctgattccaatatatcacctcacctgttggattcattggatgtgcatacacagaatgacaatttcaggcttaaaaatgaggagaaatctatactaagttgacatcactgataattataatctataaaataaatgtaaatattgctgaaaacatctgttcggagttatgattcgatcctctcccatacaaatgttttataaacatattttcccttaaaactgtgcttaaggtttcattgtaccttagataccttattaagcctctgaggaaattgcaagaaaaggagtaattttaggagggcataaataaaaagaaaagcatatttataaacatagactttccacagtggcaaggcccaagaggtatgttgtggacataagctctggaaaggattatattgtacttagcttcctatgacggagtgatgatagatgtatctggaatgccaaagagagtcttctgtctgtggccggaggtagaggtcacatatgcttctaagtctgacaagcctcattgtgcctaaagggcaggtggggcgggtatgtgtgtctaccacaggggtatattctagaaagattggtgccatagctatgttggtcacaagaggccagcaacttaactggacctgtgaatcctaacacattttctttcccagttactgagttcaatttgcgatacttaaagatgattctgttttgcttccacctcttcactgtgttatttattctgttgttgctatttatgcttgcactttcatatttttagaagttagaatttcttgagctgagagtggtgaagtgggaaattctgtttagaaaaataatattaagagaataatacagttattattaaactattaacccgacttggcaagctttgctttaacatttacaggcttatttcgttgttttgttttttcttttttttttgactgtaggatttactgcttactacgtaatttaaatattagcatatataagttttactataaaatgacatgacataaattatatttttatggaaatatattttaaatatttttcataatgctggagaggaaccccttaatggcatgtggatatttcactcttaatcctttaccagatcataatttgatctggcccgcaaaacagttagaatgccctgtctatgccttaggaagaatctaggtttttttcctctttttttctttccttggcatctctactcttgattattcatcaagaattatgggctgggtgcggtggctcacgcttgcgatcccggcaccttgggaggccaaggcgggcagatcacgaggtcaagagattgagaccatcctggccaacatgttgaaaccctgtctctactgaaaatacaaaaattacctgggcatggtggtgtgtatctgcagtcccagctactcgggaggctgaggcaggagaattgcttgaacccggaaggcagatgttgcagtgagttgagatcatgccaccgcactccagcctggtgacagagtgagactctgtctcaaaaaaaataaaaaagaattatgaatattacttttataatattctcaccactgggaaaaatgcactattctgtgtctaagtagctgcttaccttaaccaagtgatatttgggcaaggggatcgttgccttttgctactggttgagacgaagcatggcaccccctagtagagaaggatcccaattacttccaatttgtgatgtacacattttagaaagatacaggctattgccacagagatagaccaaaacatctcattttctttctttgtaaacctagatctgatttcccaactaagtctgtttcctttgtgaatgctgtgggtatgatccacagaaaggctacataatgaaatgatagctttacaattaatttggctgtagagttgtagactagttagcatatcattgcatatttgtttatttagaaatgatttccaattgtggaacctcactaactgcctgcttggcttgttactaatcctagcattcaaagaatcaaaaggaatgatgaatgatggtaagtataaaatgcacttaataattatagatcagttaaaacatggacattggaaaacaaaaaagcttcttgaaaatgtggctcttttttagtaaaagggacactgtcagatgataaaggttcacatttcttgatgtatacaacttaaatctactttgctaaaaattgcaaaactactactgtaaaaactgtagggtgtcacgaatcagactccagtcatatggctcccagcaaagagaaattaccactttttgtaaaatgtttttcagattccgtgtctggtgactgtaactttaagatgccttttataaggcacataaataatctggcacaaatctttatcattttgacagagtttcttttatgcttgtgttggtgattttgttgcatttaacccatggggacttaacatctctgcttttccaatcaggagcttggttctaaccttttgggagatgattaaagagagaggttgagagagagagagagagagagagagagagagagagagagagagagagagatgtttcgtcctcagcttttgcttccattttttttttaagaactctgggctaataacttctaatctttatagaatatttcaaagaaatatatttgttcttaaagatacataggtttgagatattgagtgctacaagcatttattttggttttaccttaacatattatgattcctcagttttgttggcatttagtaattatgtttatgtttttatcttatcaaaaaatgtcttcttacctttgatatttataatcactcctcggtcatgtaaatagtttgctttatattttactgttttaaagtctgtgaccttacctgccctcttctgtagcaaagtgcagcatttaactcaggaagctatattccccccaagtgtcattaatatttgcataagattaaaaacactccagtcggccgggcgcggtggctcacgcctgtaatcccagcactttgggaggccgaggcgggcggatcacaaggtcaggagatcgagaccatcctggctaacacggtgaaaccccgtctctactaaaactacaaaaaattagccgggcatggtggcgggcacctgtggtcccagctacttgggaggctgaggcaggagaatggcgtgaacccgggaggcagagcttgcagtgagccaagatcgtgccactacactccagcctgggtgacagagcaagactccgtctcaagaaaaaaaaaaaaaaaaaaaaaaaaaaaccactccagtcatgcattggtgaacaaagtttaaaacaacgtgtattcagcatggagtcacagaatgatcctacttttgtatgtttgtgtcacagcctttaaaagcatgtcttgttatataagccattaccctcctaaaaaagactatagttcacaggaataagttaaaagacataacaaaacataaaatgactagtaccaggaattgtgaccatggtttgttctggtaactgtggcatggcatggtttgttccaggaattgtggcatggtttgttcatgtttacattctgatgtcctattttttttttttaatttctatgtcctttccttttccttggtggtgtcattgttctgtagctgtatgaagaaactaaacttttctccattttcaggaaagcaatctaagaatcttgagtgcctcttcctttgttaatttctcttaagatgtgacttttttaaactactgcatcaggaaatattgtaaaacagttttgccttgaatatttgtgatgaaatctacgatgatcttcaagattctcttaattttgctaatattcagctgatcagaatttgtttttaaaatgtctggctggtgggtacttcccactgacaactgcttattgcttacagtatgtctgccttgtcaatgaatgaggttcagggtgcttcctagggatcagagtcagtaccatttttctctttcatctacagctgatcagatgtttattttacttacattaaatgaatgatggagatccaaagtgaatattatagaatattattctaggatcaacatcttttgctttgaaaaatcaacatctcttggcttttcctcagccaacccagcaaacagagattatcagactctgttgattttttactttcatttggcattggcctttttcttactgaaattaaaaagggctaatgatttgcctggtttctgtctctgacctttgcaggtctattttcttaatttttagatactatatatctgaaactttttttaatgtgtcaactttttaatggatagaaaatagacacgaatagtgattatgtgttcatttttcaattttccagaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaatcagttttgatgaaaggagggaaaagcagatggacttgaaaaagatccaagctcctattagaaaaggtatgaaaatctttatagaaaaatttttttataaaactaaaagttgtacccttttaatatggtagtaaaactcctcatttatttgggggtcgctctttggatctcatccatccaatgtgttctctttaatgctgcctggccttttgaggcattcactgccctagacaatgccacccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtgtttttttttttggttttt

SEQ ID NO: 8219 - DNA, 225 bp, Homo sapiens
attaccctcctaaaaaagactatagttcacaggaataagttaaaagacataacaaaacataaaatgactagtaccaggaattgtgaccatggtttgttctggtaactgtggcatggcatggtttgttccaggaattgtggcatggtttgttcatgtttacattctgatgtcctattttttttttttaatttctatgtcctttccttttccttggtggtgtcattg

SEQ ID NO: 8220 - DNA, 703 bp, Homo sapiens
agaggttggcttcttgtttggatacaaggaccaagtcactcccccaggttcctccacagtaagggaggcctatttaaagccgcccatggcactaacagaaactggactcctatgagctcagatacataactgggcctcacaggggtgggacagtatgtagtctaggaattggaaggatccattccatatcaaagaactgaagcatcgtgttgccctctcagcagcaagagtaaggtgatgcccctgtcagttatagttcctgagttcctctgtctttgattctttgcctattagccagctagctcaccctcttgtttatgccactgttttttatcctattcatgccttctcacagacaacttttcttacctacagctttggactcatccttgtctcctttctgtttctttttcactttcccttcccatcaccaactttctgggtttttttctgtttcttcttagagtccagtggcagggagaaacttgtcagtccagtctgttgccatttttcctgtttgagaaagactcaccagcttttggctggctcacagattggctttccttgggtcaggacccacccttttccctgccagctttggaagcttgacagaattcgagtgtgcagtggtggtaaataaatagtaaggaacacagagcagtcctggaggcgtgcctccatctgctgatgagaaaatccagtg

SEQ ID NO: 8221 - DNA, 2610 bp, Homo sapiens
ctttcatcttttatgttcaaagtacttgatgcacaaagcctggactcttttatctctgtcctatagactgatgtctagtcagtattcattgtgacaaaattgtttcattagagcaagttggatagtgtatggagattattataaaatgatttaacttgtcttctgtcaagtaattttataattggtattaatgttcatttttttccaggtaccagtttcagaagctttcatttgtgtatgcatgtgtgtgttaaataagtgtattagatacttgaaaaatagtaatttaaatttaaacaatttaaaaaatgaaattgtaattttatgtgtaaaggtgtctgatgtgctttattctgcactgaaaacaatattcatttacagctcaacagacaccaaatatattctaaaattactttcctagagttatcagaaaacagcactgtaataatgaaatcaaacccatctttctttatgatttattcttagtctgatacgcatcagcctggtaagccttcctgtctctctgcttacttaccaatcactccaaatgtcatgtctttgggcaggcattaaattcttgggttttgggttttgttggatggactgcagtctgtgtgagcctatatgggtgtgtcaaatccagtctttggggtgtcatggaaacttagcatgatagacttgattttatccccaagttgacttggtaatttcattagatttcatcagtcacaacctgcattttatcttgtatgtgctgtctattggtcacaaaatcagaaaaccttcttgtccattcataacattagctgttttttcaggtggctagagggacatgtcattgcttcatctgcatgaatttgaaagattaaatgcataaaggaattttcttagagtagagtaggccttcaccatctctttaactgggaaagaagttttgggagtaacatactcatcactcacacccccctcccctcaaacacacacactcacccattagaatgtaagggccttgaggcaggccttgtgtttgcttttcgtgttcactgtcagcatttagaatagtgatagtcatatagatggatagtgctcaatcaattattgtcaaataaagtaatctacttgttccttgatttagactagcaaaaggggctggtacattgtaggtacacagtaaatatttgtagaacagatgaatgaaccaacccaacagatttcttagaagtagcctgcttttggttactaattattttatagaacatataaaagaaaattttagaatacctaatttgttcacaaaaatgttatattgtctcccctgatacttggtattcctgtgtcaggctgagcactaaggttatacattttttgttaagcatgtaattactgttatttctcatgtactttattttgtgtattgatttcagtagttgtagctgagggtaatccttaagagcatgcagattttaaaaattacatagattgccttgccaagccgtctgaaagtcatactagaaaatttgataagagcctgctgttaacaacacattgagttatttttatcttaatgctaagtggagaattacttgaatttattttttttgctgcatttaatgttttgatacattcaataaataaggataaatccacttactgaaggacaagaaaagatcaataagagatccttgaggttattgggttctatggcatctattatatcaaattccttgccctttcactatactgagaaatttgacgactgggctagcaacaagatacctaccccacattagctgtggtacctgctgaaatgtgaccatgtgagcaaagaaaatgagccaaaagaaactctttctgaagattcactgaagaaaacctggagatactctttcattagtagaccccacagagacaggtggagtgtccgttatccagaatgcctgggaccagaagtgttttggatttcagattttttcacacttgggatcctcaacatgtgtatttgttggaaatggctacttaatttaaggaaaagtttaaggtggcctggaaaataagtagtagttgaactaatcaacaggaaccaaaactactttcaatatatagtgtacttatactcaaagagagacggaccattttatggtggaaccctgtctatggtagtattttgtgatgttttatttttgttgctattgtttgcactgttttctcctataacagctcttctaagccttaagaggataaattttatatgagattcaaactcttatttttgttaagaaggatgtaagtcaccaggcatggtggctcacacctgtaatcccagcactttgggaggccgtggcaggtggatcatgaggtaaggagctcgagatcagcctggccaacaatgtgaaaccccgtctctactaaaaaaaaaaaaaaaagaattcaaaaattagccaggcctggtggcgcatgcctgtagtcccagctactcgggaggctgaggcaggagaatcattgaacctgggaggcagagtttgcagtgagccgagattgtgccactgcactccagcctgggtaacggagtgagagactctgtctccaaaaaaaaaaaaaaagaaaagaaaa

SEQ ID NO: 8222 - DNA, 696 bp, Homo sapiens
gtaaatattgctgaaaacatctgttcggagttatgattcgatcctctcccatacaaatgttttataaacattttttcccttaaaactgtgcttaaggtttcattgtaccttagataccttattaagccatctgaggaaattgcaagaaaggagtaattttaggagggcataaatgaagagaaaagcatatttataaacatagacttatcacagtgacaggcccaagaggtatgttgtggacataagctctggaaaggattatattgtacttagcttcctataacggagtgatgatagatgtatctggaatgccaaagagagtcttctgtctgtggccggaggtagaggtcacatatgcttctaagtctgacaagcctcattgtgcctaaagggcaggtggggcgggtatgtgtgtctaccacaggggtatattctagaaagattggtgccatagctatgttggtcacaagaggccagcaacttaactggacctgtgaatcctaacacattttctttcccagttactgagttcaatttgcgatacttaaagatgattctgttttgcttccacctcttcactgtgttatttattctgttgttgctatttatgcttgcactttcatatttttagaagttagaatttcttgagctgagagtggtgaagtgggaaattctgtttagaaaaataatattaag

SEQ ID NO: 8223 - DNA, 703 bp, Homo sapiens; identical to SEQ ID NO: 8220

SEQ ID NO: 8224 - DNA, 494 bp, Homo sapiens
ctgcacccagccgaactatgtcttctaattctttttttaggaccttaaacattgtttacttgattaaaatttaaattttatattacatttgtaataaaactagaaagcatagataagctatcaatcaaaatcacccaaatcctgtgactactactcactgcaaacattttaatgtgcaatttgtacttaattctttactttgtaatacatacaaatatgtccagacactgtgacatatgcttgtgaacttttcaaaggtgatatcctgctgtgtattatattctgttcttttcatgtggcacattacaaatgccctgtaatacagataattatcaaatacttcttagcattcttttatgtataaatgtaccatagtagtaaatttcttccttcacattgagactttttttaaaactataaacagtactctgaattgctataaaatatgttctatatcaattcattcaaataaatatatagaagttgaatttctg

SEQ ID NO: 8225 - DNA, 494 bp, Homo sapiens; identical to SEQ ID NO: 8224

SEQ ID NO: 8226 - DNA, 879 bp, Homo sapiens
gcccagctaatttttgtatctttagtagagacggggtttcaccatgttggccaggctggtcttgaactcctgacttaggtcatctgcccaccttggcctcccaaagtgctgggattatggtcatgagccaccatgcccagcctgcataccttttttttattgttgccttttgtttttatgcctgtagcttttacattacattaaacagtttttgaaaattgtcagactgttaataacattagttttatcttgtttgaaaattatttagtaaggagaaagaaaaatacaaattcatgttttaattgatagttgtacgagcctcatagcaatatttccatgtgctatattcagttattgcttaaacaattttgtaattaacacttatatgtcaggatctgttttctcaagtaaacttcggtttttccaccaaaatggtgtgggtttttttttttttaatatattgtaatctgaatttcctactactgccgggtcattggagaaacagtaaattaaacctgaagaactccggaataacttaacttcttcgtttaaaaatgcttgaaaataaagttgcaggccaggtgcaggggctcacgcttgtaatcccagcactttgggaggccgaggtgggcagatcacttcaggccaggagtttaagaccagcctggctaatatagcaaaagtccgtctctactaaaaatagaaaaaaattagctgagcgtggtggcgcacacctaatcacagctaataaagagtctgagactcaagaattgcttgaacccagaaggcagaggttgcatgcagtgagccgagattgtaccactgcactccacacttcgcgacagagccagattctgtctcaaaaaaaattaaaataaa

SEQ ID NO: 8227 - DNA, 879 bp, Homo sapiens
gcccagctaatttttgtatctttagtagagacggggtttcaccatgttggccaggctggtcttgaactcctgacttaggtcatctgcccaccttggcctcccaaagtgctgggattatggtcatgagccaccatgcccagcctgcataccttttttttattgttgccttttgtttttatgcctgtagcttttacattacattaaacagtttttgaaaattgtcagactgttaataacattagttttatcttgtttgaaaattatttagtaaggagaaagaaaaatacaaattcatgttttaattgatagttgtacgagcctcatagcaatatttccatgtgctatattcagttattgcttaaacaattttgtaattaacacttatatgtcaggatctgttttctcaagtaaacttcggtttttccaccaaaatggtgtgggtttttttttttttaatatattgtaatctgtatttcctactactgccgtgtcattggagaaacagtaaattaaacctgaagaactcctgaataacttaacttcttcgtttagaaatgcttgaaaatagagttgcaggccaggtgcagtggctcacgcttgtaatcccagcactttgggaggccgaggtgggcagatcacttcaggccaggagtttaagaccagcctggctaatatagcaaaagtccgtctctactaaaaatagaaaaaaattagctgagcgtggtggcgcacacctaatcacagctaataaagagtctgagacacaagaattgcttgaacccaggaggcagaggttgcatgcagtgagccgagattgtaccactgcactccacacttcgcgacagagccagattctgtctcaaaaaaaattaaaataaa

SEQ ID NO: 8228 - DNA, 336 bp, Homo sapiens
gcagaagaagcattagcaaagaggaggggaagaaacagcccgaatggaaacctcattaggatgctggttcttttctttcttgaaagtgaggtaaaaaatgttttaagataattccttatttcttttattatattacattttaaatgtcaattcattttaatttttttcaatcaaataaaaacaagtctgtttcttataaagttaccttcatgaattgcatgatatagaatcagtcctttaccttttgtggaaaggtgttctgaatatatatgtaggtgtggatcaacactgaatacagactggcaattgttaaacttttacagtattgcaatactg

SEQ ID NO: 8229 - DNA, 1133 bp, Homo sapiens
tttttttttttttagcaatttcagtgtaatgaaagaatttaagctttgaatttataatttgctgtggtggggttaatttctgtcagtatttgagattgtattatcagtcttgcataatgaaatccttttttggctaagtatttaattcgaacatatttgcctttttaaaaagtgcttggcctaaacttattgtaactgcatgaaataagcatttgcttaaaacttaacattgtaaaattgttctctctgaaatgtgtgcagaatttaaatcatggccaaatgtattactattaccctatttacagtaatttgctttgcagaaaatatttcttcatcatggaactgtgaaatcaaattgaagatcttactggtaaaaatgacaaattaacaaaaggactaagacaagtggtgcccaaacaacctttttattctgcagttccatcatcataatagaccagttaacccaggagtcctaatgttttaaaacatcattgtggtgatcttgtttattctatctcactaaggatatccagtttcctaagctcttactggctagcaatttcgtcttaattttattgctaaatgttcaaattttgcttccaaactcactttatttttgcagatgtgtacatctgctaaatactaattttatgtaaatgattttgttgattatctttccacatcttaaaatgtttctaacagctttgagattttatctcaacaggctctctctgaccccaaagtagtacttaccttcgtgactactgacaaagtcacaaaatgcaggcgatgtcatgtatttcggtacaactaaatctaggaaacggttttttcattgcattactgcatattttcattttcatttaaattatgtcccctttttctcttgcttgaaacagtgctcctcgaactttgtcttccagcacattttaaagagaaccaattaaagaacaatcacacattctgcttattaaaggctatttaaaaagaaacattttgtattagaaaatggccaactttaaaacactattttttacactcataaaaatgttttttaaatcgccttgacaatcatcagcttttgaaatgtgaattcctattgccagagtaaaggtctcgtttttataccacca

SEQ ID NO: 8230 - DNA, 1247 bp, Homo sapiens
attttacacttaatttataatatttattgagtatattatgtcctcaacaagtaactataaaatgaaatacttaactcggtgaagactattttatgcaaagtttttttttttttttttttttttttttagcaatttcagtgtaatgaaagaatttaagctttgaatttataatttgctgtggtggggttaatttctgtcagtatttgagattgtattatcagtcttgcataatgaaatccttttttggctaagtatttaattcgaacatatttgcctttttaaaaagtgcttggcctaaacttattgtaactgcatgaaataagcatttgcttaaaacttaacattgtaaaattgttctctctgaaatgtgtgcagaatttaaatcatggccaaatgtattactattaccctatttacagtaatttgctttgcagaaaatatttcttcatcatggaactgtgaaatcaaattgaagatcttactggtaaaaatgacaaattaacaaaaggactaagacaagtggtgcccaaacaacctttttattctgcagttccatcatcataatagaccagttaacccaggagtcctaatgttttaaaacatcattgtggtgatcttgtttattctatctcactaaggatatccagtttcctaagctcttactggctagcaatttcgtcttaattttattgctaaatgttcaaattttgcttccaaactcactttatttttgcagatgtgtacatctgctaagtactaattttatgtaaatgattttgttgattatctttccacatcttaaaatgtttctaacagctttgagattttatctcaacaggctctctctgaccccaaagtagtacttaccttcgtgactactgacaaagtcacaaaatgcaggcgatgtcatgtatttcggtacaactaaatctaggaaacggttttttcattgcattactgcatattttcattttcatttaaattatgtcccctttttctcttgcttgaaacagtgctcctcgaactttgtcttccagcacattttaaagagaaccaattaaagaacaatcacacattctgcttattaaaggctatttaaaaagaaacattttgtattagaaaatggccaactttaaaacactattttttacactcataaaaatgttttttaaatcgccttgacaatcatcagcttttgaaatgtgaattcctattgccagagtaaaggtctcgtttttataccacca

SEQ ID NO: 8231 - DNA, 1708 bp, Homo sapiens
cttattgcccgcgcggtgagggagcgtggtctcgcgcaagccggcgtgcggtccggcggcgctgcagttgtgtccagccggtcacggggcggctatggcggccacgttcttcggagaggtggtgaaggcgccgtgccgagctgggactgaggacgaagaggaggaggaggaggggcggagggagacgcccgaggacagggaggtgcgtctgcagctggcgcggaagaggtgaggcaccgggataacggcagcgcgctcaccgcagctggaaggtgcgcgggcctggcagccgcgacggcgcctaaggccggggctccgcggtcttccgagtggcccccgcggttgccgccgctccttggctctgcttgggccctgggtctccgtgaagccgcggcgtccagcggcgccagccccaggtgtgtgtggttctcgcgtggatctgctggcgtttcgtggagtccagggtgaagccgctgtgggagggctgggttcaaatccgttctttaaaggctttctggagcgtttctggagcatttctggaggcttggtgtcttgcggactcgtgatcttcccgcttgtcacactgtcttgggccgcagcgctcccgcgggccccaccacgtttgtcgtggattgttcacggacacaccaattccctcgaaactttttaaacctgcacccaacacttcaattagcatgatgtgtcagtagccaatgaacacgctttaaaaaaattgtttccaaacacaaaaaagtgggagaaaatagtcaagtgagccctgacccctacacaaccgggtaaattcaacaggaagattttgccacgtttattttctctcccgccactcctaagcgaattccagtcatcatggcctttcacctctacatttttcagaatacatctcaaacgttttagggattttcttacatatgctattatcacccctaacaacactaatactaattttccagtatcattttgtagtccatgctcactcacgtttacctagttttttcaaacatgacattttacagtggtctgcgtgaatgagaatcctaacagggtccacaggttacatttagacgtgtcacttcatttagagcaacctcctcttacccctcctaagagacaggactgattgtcttgtccagtgcccccacactctgaatttgtctgatagcttcgttgtggtgtcacttaacgtttgtatcacctgcatgtcctgtaaaatgaatgttcatttggaggcttggtcagattctcattcaaagttttgtcggcaagaatgcttctactaagtggtgctttctgtttcttattgcaggctatccccagctgtctcacttttagggatgctaagattggttcttgggtcaggtggacagcctgatcactattttagagttctccgtaaacacgtatgcagtagttttatctgttggttatcattgtccgagtccatcgttttctgaggatattagttatattctttataaaactaacgtgcattttatttattgtaaatcatacatatagtgcccttttgccatgatactgtttgtattgaagttgctttagtttcatcttgtttcttgtgttagggaagtgcggctccttcgaagacaaacaaaaacatctttggaagtttctttgctagaaaaatatccgtgctccaagtttataattgctataggaaataatgcagtag

SEQ ID NO: 8232 - DNA, 1708 bp, Homo sapiens
cttattgcccgcgcggtgagggagcgtggtctcgcgcaagccggcgtgcggtcccgcggcgctgcagttgtgtccagccggtcacggggcggctatggcggccacgttcttcggagaggtggtgaaggcgccgtgccgagctgggactgaggacgaagaggaggaggaggaggggcggagggagacgcccgaggacagggaggtgcgtctgcagctggcgcggaagaggtgaggcaccgggataagggcagcgcgctcaccgcagctggaaggtgcgcgggcctggcagccgcgacggcgcctaaggccggggctccgcggtcttccgagtggcccccgcggttgccgccgctccttggctctgcttgggccctgggtctccgtgaagccgcggcgtccagcggcgccagccccaggtgtgtgtggttctcgcgtggatctgctggcgtttcgtggagtccagggtgaagccgctgtgggagggctgggttcaaatccgttctttaaaggctttctggagcgtttctggagcatttctggaggcttggtgtcttgcggactcgtgatcttcccgcttgtcacactgtcttgggccgcagcgctcccgcgggccccaccacgtttgtcgtggattgttcacggacacaccaattccctcgaaactttttaaacctgcacccaacacttcaattagcatgatgtgtcagtagccgatgaacacgctttaaaaaaattgtttccaaacacaaaaaagtgggagaaaatagtcaagtgagccctgacccctacacaaccgggtaaattcaacaggaagattttgccacgtttattttctctcccgccactcctaagcgaattccagtcatcatggcctttcacctctacatttttcagaatacatctcaaacgttttagggattttcttacatatgctattatcacccctaacaacactaatactaattttccagtatcattttgtagtccatgctcactcacgtttacctagttttttcaaacatgacattttacagtggtctgcgtgaatgagaatcctaacagggtccacaggttacatttagacgtgtcacttcatttagagcaacctcctcttacccctcctaagagacaggactgattgtcttgtccagtgcccccacactctgaatttgtctgatagcttcgttgtggtgtcacttaacgtttgtatcacctgcatgtcctgtaaaatgaatgttcatttggaggcttggtcagattctcattcaaagttttgtcggcaagaatgcttctactaagtggtgctttctgtttcttattgcaggctatccccagctgtctcacttttagggatgctaagattggttcttgggtcaggtggacagcctgatcactattttagagttctccgtaaacacgtatgcaatagttttatctgttggttatcattgtccgagtccatcgttttctgaggatattagttatattctttataaaactaacgtgcattttatttattgtaaatcatacatatagtgcccttttgccatgatactgtttatattgaagttgctttagtttcatcttgtttcttgtgttagggaagtgcggctccttcgaagacaaacaaaaacatctttggaagtttctttgctagaaaaatatccgtgctccaagtttataattgctataggaaataatgcagtag

SEQ ID NO: 8233 - DNA, 1240 bp, Homo sapiens
gaatataatgggaagtgtacaggctaggaagaacttgaagtgaacaaatttcaaaatcttaacctgatgctaattttcagggttctccattacagtgtaaaaattcagaccacgacaactatggtgtcatgaggaaaaaaaatcaggcatttttccaaaggaagtgctaatgggcctatttgacttctgagtgaagcaaaaactacccagatccattccctacaattcacatccccaaaggtcaaaaacaaactaggaggacctgggaatttcagctggagatactgattattgagttctgaagtagagtgttggaaataggcaattagagaaagtccattgatgtcattttgtttataatattgcagttcatactgaatgaccacttgatatgactaattcagggaatatatatttttctatgaaagctatgaatgttactatcacggcttttccttatttttacttgtatgtagcagcatttacagaaatgccaaaaatgtgcctcattaagaggcaggtcttaatcagttagataaaaataaaatgtatagcttaagatcaaaacagtcatatttttagatacagtgaaatcttttatgtttctctacagcaccttaaaaattagaacttgaatactttgagtaaacttactacaatctcatcccaacaaactttaatggtagcatgtttggcctatttcattgtggcctgtactaggattagaaaatttggtcgtggtataacaaagaagtgtatttacaataggatttaatttgttgttaatatgtatttgttgaaattaaaattgccagattaaatgaatatactgtcgcatctttttaacatagtaacgtgttactggaaaaattaagttgttgaaagtaagttgttttcccatttaaaaatatctgaatatatgatttgcatgtgtaaatctgaaaaactaaactacagaaacctagggttttctatttcttttttaagtcaaatgcatttttttttttttgttatacagatgaaccaagtgtctaaaatacttgagaaatttgtggttgcatgtctgttttaaaaaaaaggctttttgttttttagcataagccagaatattctaacctactaagtctgtgtcctttgctccttttgtagtatactttcatctaaattactgatccccaatatgttgatacacaggtgagaaagggaagaattcctaataaactgctattacttttaggtg

SEQ ID NO: 8234 - DNA, 1247 bp, Homo sapiens; identical to SEQ ID NO: 8230

SEQ ID NO: 8235 - DNA, 1708 bp, Homo sapiens; identical to SEQ ID NO: 8232

SEQ ID NO: 8236 - DNA, 1240 bp, Homo sapiens; identical to SEQ ID NO: 8233

SEQ ID NO: 8237 - DNA, 2277 bp, Homo sapiens
cacactcctgggctcaagcaatccttgtgccactacacctggctctcttgctttgtttttgagcttactccaataacccttcatgctctttgctataaatagaaacttcttcctatgtttgatgcctttgatcttttgttttgataggcaagaagccatctttcagatttctagatagccttaaggaagttttatctagatagtttgcctacaagaggagcattaatactacccatttatggaggttttacttgccaaatttgggcagtttttatcatttaaaatctagcaaaacattatgtcagtgccctcccaggcctttaaagtcttcatgtaacagcaggctaggggttttgtcagctgtaaagttacatcttctgttcctccaaacagaaacatactttttaatctaaacaagtggatacttttcttgggagcatgttaaaaaaaaaaaaaagtgaagccagccagtcacacggtgtgatgtcgtttttacatagcacctttatacacgatataaaaaagtaggttttttgcatcaactgcaaacatgttttgtactctgtggatcggaatcttggtgaggaagagcattgcatcccgcaaaaggctgatgagtcagttagctggagagacagtgccatcattctgggttgcagttctggtgaagtaagtaggatgttaacactgcagatggaaatggttttcagattgccacatggaataatagtatggaacgtgaaatttcaggaataggaggagattcttttattattttcctccttccactttgtacatttttttaatagcctgcaactagttacatttatctttttttttttttttacatttttatccataatacaagtaacttgactaaagccagtgtctgtttcatgtaaatatattaacaggtccaaaatcaccaactaaaattagctttatactgactttttctaaagtcagtccttgtctcacccaaatattttaacaagtccaaaaatagcacatagctacttggaaccatattaaaatctcattataacatgaatttcaggtattccatgttgtagacttctccttgaaagataatgacattgaaaaatgctcttaagagagttgttaattctgtttcccaaaacttcctggataaaacaattctaccttaatgctattaagactatggtaggtggtttttttcttaaagtaacaagactgacgtataaaatatgaatgcgacatttaagatgaaagtgttcataggcacacctcgctttattgtgctttgctttattgcgcttcgtagatactgtgtttttactagttgaaagtttatggcagccctgtgaaaaataagcctgtccgtgctgtgaagcgaacagcatgtgctcacttcatggctctgtgtcatgtttcggcaattctcgcagaatttcacactttttcattattatctgtgactgtgatctgtggtcagtgatctttgttgtttctaatgtaatcgttttggggcattacaaaccatgcctgtgtaagatggcggattagtacattctcacaccgctataaagattctacctgagactgggcattttatgaagaaaggggggttataaagatactacctgagactgggcattttataaagaaaggagggttaattgactcaaggttctgcatgtctggggaggcctcaggaaacttacagtcatggcagaagatgaaggggaagtgaggcacatcttacatgatggcaggagagagagtgtccaggagaaacagccacttttagaactatcagaactcatgagaactccctcactatcatgagaatagtgtgggagaaactgtgcccacgccaatcacctcctaccaggtccctccctcaacacatggagattacagttcgacatgagatttgggtagggacacagagccaaaccatatcaaatggccaggttaattggtaaatgtcgtatcttctgactgctccactgactgactgttctcctatgtctccctctcctggatctccctattccctgagacacaacaatattgaaattttaggcgaattcacaaccctgcagtggcctttatgtatttaagtgaaagacagagttgaacgcctctcactttcagtcagaagctaggtggctcacgcctgtaatcccagcactttcagaggccaagtggggcggatcacttgaggtcaggagttcaagaccagcgtggtcaacatagtgaaaacacctctctacttaaaaaaaaaaaaaa

SEQ ID NO: 8238 - DNA, 2277 bp, Homo sapiens
cacactcctgggctcaagcaatccttgtgccactacacctggctctcttgctttgtttttgagcttactccaataacccttcatgctctttgctataaatagaaacttcttcctatgtttgacgcctttgatcttttgttttgataggcaagaagccatctttcagatttctagatagccttaaggaagttttatctagatagtttgcctacaagaggagcattaatactacccatttatggaggttttacttgccaaatttgggcagtttttatcatttaaaatctagcaaaacattatgtcagtgccctcccaggcctttaaagtcttcatgtaacagcaggctaggggttttgtcagctgtaaagttacatcttctgttcctccaaacagaaacatactttttaatctaaacaagtggatacttttcttgggagcatgttaaaaaaaaaaaaaagtgaagccagccagtcacacggtgtgatgtcgtttttacatagcacctttatacacgatataaaaaagtaggttttttgcatcaactgcaaacatgttttgtactctgtggatcggaatcttggtgaggaagagcattgcatcccgcaaaaggctgatgagtcagttagctggagagacagtgccatcattctgggttgcagttctggtgaagtaagtaggatgttaacactgcagatggaaatggttttcagattgccacatggaataatagtatggaacgtgaaatttcaggaataggaggagattcttttattattttcctccttccactttgtacatttttttaatagcctgcaactagttacatttatctttttttttttttttacatttttatccataatacaagtaacttgactaaagccagtgtctgtttcatgtaaatatattaacaggtccaaaatcaccaactaaaattagctttatactgactttttctaaagtcagtccttgtctcacccaaatattttaacaagtccaaaaatagcacatagctacttggaaccatattaaaatctcattataacatgaatttcaggtattccatgttgtagacttctccttgaaagataatgacattgaaaaatgctcttaagagagttgttaattctgtttcccaaaacttcctggataaaacaattctaccttaatgctattaagactatggtaggtggtttttttcttaaagtaacaagactgacgtataaaatatgaatgcgacatttaagatgaaagtgttcataggcacacctcgctttattgtgctttgctttattgcgcttcgtagatactgtgtttttactagttgaaagtttatggcagccctgtgaaaaataagcctgtccgtgctgtgaagcgaacagcatgtgctcacttcatggctctgtgtcatgtttcggcaattctcgcagaatttcacactttttcattattatctgtgactgtgatctgtggtcagtgatctttgttgtttctaatgtaatcattttggggcattacaaaccatgcctgtgtaagatggcggattagtacattctcacaccgctataaagattctacctgagactgggcattttatgaagaaaggggggttataaagatactacctgagactgggcattttataaagaaaggagggttaattgactcaaggttctgcatgtctggggaggcctcaggaaacttacagtcatggcagaagatgaaggggaagtgaggcacatcttacatgatggcaggagagagagtgtccaggagaaacagccacttttagaactatcagaactcatgagaactccctcactatcatgagaatagtgtgggagaaactgtgcccacgccaatcacctcctaccaggtccctccctcaacacatggagattacagttcgacatgagatttgggtagggacacagagccaaaccatatcaaatggccaggttaattggtaaatgtcgtatcttctgactgctccactgactgactgttctcctatgtctccctctcctggatctccctattccctgagacacaacaatattgaaattttaggcgaattcacaaccctgcagtggcctttatgtatttaagtgaaagacagagttgcacgcctctcactttcagtcagaagctaggtggctcacgcctgtaatcccagcactttcagaggccaagtggggcggatcacttgaggtcaggagttcaagaccagcgtggtcaacatagtgaaaacacctctctactttaaaaaaaaaaaaa

SEQ ID NO: 8239 - DNA, 287 bp, Homo sapiens
aagccatgttgaaagccagcacaggctgaaagctaagcctcttgtgccaaacagccaaattgtaaatgcaaaggaaatgttcgaaggaaaataaaagtgctgctccagtgaacacaccagtgataaggaaacagccttcttgctgatagggagaaagttttagtgcctggagagatgatcagcccagacattatatttccttaacgcagagcctaatccacagcaaagtcctaactatcttcacttctatgaagactgacagaggtgaggaagttgcagaagaaaag

SEQ ID NO: 8240 - DNA, 287 bp, Homo sapiens
aagccatgttgaaagccagcacaggctgaaagctaagcctcttgtgccaaacagccaaattgtaaatgcaaaggaaatgttcgaaggaaaataaaagtgctgctccagtgaacacaccagtgataaggaaacagccttcttgctgatagggagaaagttttagtgcctggagagatgatcagcccagacattatatttccttaaggcagagcctaatccacagcaaagtcctaactatcttcacttctatgaagactgacagaggtgaggaagttgcagaagaaaag

SEQ ID NO: 8241 - DNA, 1763 bp, Homo sapiens
gttgggtgcctacccaccagtctcatgtgtgagtgtatctgtataagtgtgtgtatgtgtgtgtactcacgtgtggctctccctctgccactgagtttctgtgaccaggcccacctggtcactaagggaggggactgatccctggggtttcctcgttcctgctgtggagtgagctggggcttggtgagcaggccagcagagggaggctgtatggtgcatgtgtgatatgtgtggttgtgtgtgtgcgtgtgtgtgtgacagagaggtgtggtggtgtctgggcagctgtacctggctgatgggtggtgtgagggctatgcgatgggacagtgctggggtaagcctgggagtgtgtggccacggtaggagtgtgtgactggtgggacacagtctatgaaactgccggtgtatgcttggggagtgactgtgattgtggggaaccgagagtgcctgggcgtgggtgttagcggcaggagggggtgtgacaaggtgtgtggtgacagtgctgggagggaaggtgagagcccagtgtgggggtgtgtgtgtgagtgtgtgggagaccatgaggatgtgggtgtgcacatggagagggctagagggcaagtcttggggtttgtagtgttgtgaccaagacctcgggctctgtacccaagaattatttgggctccaatacttgcttgtgcctgttaagagcaagagacccaagctaggcctctcaaggctgagtgtccttatctgcagaatggagagagtgaggacaaaagttcctgtgttaaaggtcctttaacacaatcttggcccatagtgagaacacagcacatgtgaagtcttttgttgtcaccacccccagctatacggttcccattctcctgggagctggggctaaagaaagcccagacagtatccaacccaatttcctgcctgtctgttgccccttcccatctccttgaccaagcagcttgagggaggggggatgcccagacagagcccccagtacccagccctgttcagcctgcatgacagcccctccctcaccagaccttagtgtcagtagtagcgatgggggagacaggggtgggggatgattcagagctgtgactgcagggcgctgacaccatttagctggcacagtttagattaaaattagaaataatttaaagtacagacaaaaagataaagccaaggatgcctctgcccccagggaatggtgatgggggtctccagctgggggaggggttcacatctggggagcagaatctttcttagaggcttgagctggccttcagagaaaatgcttaggcctttcagccaggagacacagagtaccttgctacctttgccatttcttcctcccaggatatctccaggcctcagttttttcagctgtgtaatgggcacaatagtaatgtgagaatcacctgaactgtaaggcacaagagattaaaaaatgtcactcttcagtctgggcacggtggctcacacctgtaatcccagcattttgggaagccgaggcaggtggatcacttggtcaggaatttgagaccagcctggccaacatggtgaaaccctgtctgtaccaaaactacaaaaattagctgggtgtggtggcgcgcacctgtaatctcagctgctcaggaggctgaggcacgagaatcacttgagaccaggaggcagaggttgcagtgagccaagatcgtgccattgcactccagcctgggcgatagagtgagaccctgccacattaaaaaaaaaaaaaagtcact

SEQ ID NO: 8242 - DNA, 8067 bp, Homo sapiens
cagacccctgagtctaacttattatattttatatatgcatggtattttatttatctatatattataggtattaaaatcttttaaacatttttctaaaaagctattttcaaaaaaaattttgtggtttttaactttggttcagtttggtaagtgctatacctttttttaataccagtatctgtatgttattttggtttattttactctttaagttaaatacagattaatgtccctgtaaatctgataatgataaatatagcataaaggtgttatattcaaatggattttaatttttctccaaactaatatttacataaatgtatgtaaactatttgagttatgtggagttccagttagttttcttttgtgtatgtctcaacaaatgtttagtgttaatgcttgtcagctcacattttcttttcctttgttttgtaagattactttcttcccttcctctcttccttacctccattaccttcctttactccccttcctccccttctcttttcctctctctctattccttctcttacccttccttctcccctttgtccttccttcccctgtctctgatctcattccctcctcccatgccctcctcactattccccttcccctgcttctttcctcagcctctctttcttttttaatattgcctccctccctcccttcccttccttccttccttcctttttcctcttctctttccacccacctttttattttttcagactggcttaatgaacagtctagtgatagaaagtggtaaaaataagttatagtagatctatatagctatataatccagtatatccaatataatagaatattatgcaataattacaaactatgctttttgtgcttcttcatatctacctcatgcccctcatatttttcatcttcatattctgtcatttaccaaatcctatgaaaataatctctcaaattcatcctttcctatctccttcatcttcacatcctgtcatttgctaaatcctagaatttttcaaattcattcttttcatttctcctaccatcccccaatttccccttaacagaactattaaaatagctgcctgagttggtcttgtactattcttctatttagccaataggctatggcatattttaatcgtcctaaagcacagttctcatcagattactacctgcttaaacctttctgttactggctgcccatttcctaccaacttaatataataccgtagtcttcagtgacttgcagattatggctctaacctgcttttttagttctctcaagctccattttacccttaacttccagtggaacttgctttctgcttccatgtcttttttcccactatttgctttgcctggagtacttaacttcttagtctgccctttagaacctacctccttcgaggcccaattcagatgccacctttccattttctctattattatctaagtgtctcttctcccccttatctatgttataaattccttaagttcagagactgtgtcttgaaattctctgaatttttaacacagtgccttgctattataaatatttggtagttttaattgtgcagtaaacacttccatttatgaaaatttctgttttcttgtctctagttaaagaagagtgtaagagtcctaaagctgagtgttggtcccaaaaaatgtccaataagcaggtaagcttccttaaaatcaaatttctagttaccaattttttaatgcaattggtggctctgtagcattggactgaatttctcaaccttttcaaccaaatttataaggtgtgtggccagagggtcactgaagttaagctgacagtcacttggatgggaggttgtacacctaaagtcctggatttggaactagaggcacctgaaatcctgattctctcatttaatagttgggtggccttgagcaattcactttacctctcacagcctcaattttctcatctttaagtggagataaaaatattaatcacttgtccaggcgtggtggctcatgcctgtaatcctagcactttgggaggccaaggtgggcggatcacctgaggtcaggagttcgagaccagccttgccaacatggtaaaaccccgtctctactaaaaatacaaaaaaatcagccaggcgtggtggcatgtgcctgctgtagtcccagttactcgggaggctgaggcaggagaatcacttgaacccatgaggcaaaggtcgcagtgagctgaaatcgcaccactgcactccagcctgggcaacagtgagactctgtctcaaaaaaaaaaaaaaattaatcacttgtagttgctcccaatatatatggtcttttgtgtgtgtgtgtgtgtgtgtgtgtgtgtgtgtgtatacatagacatatatatacacacacatagacattatatatggtcttatatatatacacatagacatatatatatggtcttatatatatacacatagacatatatatggtcttatatatatacatagaaatatatatttacatatacaattgaagtacatggaacaaaatagcaaatttaacaggctaacttctgtggaattagattggtgtgggggaagccaagatcatttatgttttactttatatagtctctgctgtttacaaggattatggatgcattttataatgaaagaataacaaatctttgatctaaaaaaatttgacacgtatatttattagatgtgtacttttctgtatgcctatcatattttaatatatatttttttaaattgatctcttatagtaatatattaaatttataaaaggtcttagctgaatatttggcacataacaggtagtaaatggaacccattaatgtttagataccagtaaacggtttaattacttgacttttaaggccctctccatttgaaactcttatactgtaatttcctttcttctagaaaagggattgataaactttttgttcaatagacatctttggtgaagcccatggacttttggtgaagccattattattctcagaatagtatttttaatgctaaaataaaatacatacgattttaaagaaaaccagttatactgatatacaattagaatcaccactgttgtggttttcatagttgatttgggctgctataataacaataccatagactaggtacatttgaacaataaacatttatttctcacagctctggaatctgagaagtccaagatcaaggcactagcagaataatgtctttaatgctaaaaagatttaagagaaaaccagttatattgaaatacagttagaatccggtaaagtgccattgtctggtgggggctccctttctggcttgcagatgatgcgtcttctcatattctaacatgatggagagaaagagctctattctctttctattcatataaggacactaataccatcatggatgttgcaccctaaagacctcatctaaacttaattacctaccaaaggccccacctcctaatatgatcccattaggagttaggattttaacagaagaattttgggggaatacaaacatgcagaccatataagtgttttgttgcctatattcataattgcaggaaatgctaaatctcattgagaggttaatgaagattaaggtgtaattttccccatccaagtttataggccccttttcttatgatacaaaagggaaaatagcacataaaatttttttgcaacaatttatttagaacactattacatattaactataaatatatttgcacaaaaagtttattcttacttttttaatagactttagaagggcctgccaaatataatattaagctattgaagagaaatgaaagtccagaagtctcagaaacccaaaaggttgtgactggttatccaaatgctattgataaggtaaaaaactatttattccaattctcttcccaaactttaacacctgggaagatgattgagtgaaaatcgaatgaccatttttgtacataaaactcagctttttgtgtgttcttgtattatacgttcatcttcatgcccaaaatatttattcttttagcctaactctggaattgagaactttttagcatctttgaatatctccaaagaaaatgaagtacagtcatctcatcatggggagcctccaagtgaagagcatttgtcaccacagtcatttgccatggttcgtattttgtaggaactttcttactgtggtaatttctcgactgttgaccatgcagacatatcccatgcaagtgttcaaacacttccatcatggaggctggtatgttacatcattattgtcatcttgtgaggaaaccaggctgccctgggcaatttagccatactttttctctttagaccacagttcccctgcttttcaaacattgctactaggtaactgggatgaaagttaagcaggaggataagtatcgtttctgtatcagaaatgtgggtgttgggtttttttttttcagtttctatctgaatgtagttaatgtcttaattgttaacaatggaattctttccaagaaagatcaataagttctacagatgtaatgttgactttgttctcttcaccctcaccatctccatgtgaatcattttcaaaaagaagggaacacggatgcttaaagaaattctaaaaattgatggctctaacactgtggaccataagaatgaaatcaaacagattgctaatgaaatccctgtttcctctaacagaagagatgaatatggattaccctctcagcctaaacaaaataagaaattaggtaagtaaactaaatactattaccaataatatcattttaaaaattcaattcatttggttctttttaatcatgtacttttaaagataaaactgcttttattttaatgtatttatttattttagagatggtgtcttgctgtgttggccaggctggtctcaaacttctgacctcaagcaatcctctcacttcagcctcccaaagtgctgggattacaggtatatgccaccacacctggcccaaaactacttttattcttaaaactataatttttatatttgtttcagttatataataatataactggccaggtgtggctcatgcctgtaatctcagaactttgggaagctgaggcaggcggatctcttaagctcaggagttcaagaccagcctgggcaacatggcggaaactctgtctctctaaaaaatacaaaagttagctaggtgtggtggcgtgtgcctgtagtcccagctactggggaggctgacgtggtaggattgcttgagccttggaggcagaggttgcagtgagccaagatcacgccactgcactctaacctgggcaacagagatagaccctgtctcaaaaaacaaaaagaacaataataatacaaccatgtaaccaatagatctacagtcactaaatgtcttcttgtgattacttaattgtagtgttatagataatcattctgtagacatccaaacctttaaaagtttgcacattctagcttttgtcctcagtaatttaaaaattatcatgtaacttaaatacattatttaacttttctgaaatcttgtttcttatttataaaataagaataatacattacagattacttgtggtaattatataacatgtataaatataaaacagcactatgtccaacacattgtaggtgctaataattgatattaatattatgttaaaataacctaactgttgtaaaaatagaaaaatctacaaaatcaattaaaaatcattaatagagttagatataggaaagtgagtcatactcttaagtctgtaaagcctatagcataacatctggcacataactggatttcagtaaatatccgccatatttgttcctaccctgaatgtcctctatactttagcattttatctgtataatgatctactaaaggcagccaggaagaatgactgatacaaaagtggatgtgggcagaagtttctcagagaagtcaaaaacattttggaataagcagatctaagcgtattaaagatcaaaacctggaattggctgggcacgttggcccacatctgtaatgccagcactttgggaggccaaggcgggtggatcacctgaggtcaggagtttgagaccagcctggccaacatggtgaaaccccctttctactaaaaatacaaaaaattagccgggtgtggtggcaggcgccaccaagtagctgtaatcccagctacttcagaggctgaatcaggagaatcgcttgaacccgggaggtggaggttgcagtgagccaagatcacgccatcacactcgagcctgggcaacaagagcgaaactctgtcaaaacaaaaacaaaacctggaataaaagcagaacctaaccccatttatattccagtgataattaattaaaaattccaaaaaatattaggaacctgattatttattatagtgacagacatggtcctgaaatagaaccaaattaattttaagacaaaattagataaagatggtcccattgtcaaaaacaagtaagttttactttatttcagtataggaaaaaaaaaaaaaaaaactcataggctttagagtcttagggtcactagctcagaatccagcccctgttatagaactaactggctctgtgactttgagcaagccacttaactgcttttttaatctatattagtaagaagtttggattaattcttcaatgaggtatgcttttgttctattagtgagtttgttaatcataaagaatgtgaacactcagaattttaaaatcatcttccatataaaaacacttagaagacaatttcaaaaaaaacttttaagaaatattatttcagagccacaaaaatattcatccatgtgtctcagaatgtaaggtggaattgcaagaattgaggtggaagccaaaacttcaaaacttaaggatgaattatatttcagctcaagaaagccatttgtttattcattcttttatttttctcttcttacttctgcaaaacaagaaagccatttgtttgttcaaattttacctgtagcagtaccatgtagtcattagctgctcaaggttttaatttttggcagttaggtacttatattttaaaatctttatcttaataatttatcattaatcaattatactcatccaaaaacctttactgaagtcacaataattttaggaagtactaaatagttgtttatatgtgcttcatggaagactcatctttttaatgcagttggtggctctatagcgtctaactgaatttttcaaggttttcgaccaaatttataaggtgcgtggccagaggaccactgaaggtaagctgacagtcacttggatggcaggttgtactgctagagtccaggatttggaactagagccacctgaaatcctgattctgttatttaataatgggtggccttgagcaattcacttcactttttagcagtttcctgcttgctcttctataaaaccctacaataagtgcataatttgagatagtattttattaataaagatagactcttttctcttttttggtagcatcttatatgaacaagcctcacagtgctaatgagtaccataatgttcagtctatggacaatatgtgttggcctgcccccagccagatccctcctgtatccacaccagtaactgaactttctcgaatttgttcccttgttggaatgccacaacctgatttctcctttcttaggatgccacaggtatagtatactactgttctatttatataaattatttaacattaagcttaaataaattggttgaaaatgtttagctagaaaaaataaaatggggcctatttttcttaactttatgagcagcatagatttatgcttcttaccctagctctaatatttatacataaccaaagccctaagagaagctgacagggaggaactgggcagcaggtatcctggcaagattcctcaaactaatagagccagggatcttggcctacagtagcaattttcaaactttttggtctcagaaacttcacactttttttggaggaccccaaagagattttgtttacttatatccatatttactgtgtttgaaattaaaacaaaaaaaattg

SEQ ID NO: 8243 - DNA, 618 bp, Homo sapiens
ggtgagaaattacttaatggctgcaatgtatgcagtgtacataattcaggtgatgaatataagaaaagcccagactttaccactctgcaataaatccatgtaacaaaactgcactcgcaccccttacgtttatacaaatttttaaaataaataataactagaaaagcaagaggaaaccaaacccaaaattattagaagaaaagaaatgataaagattggggcagaaattaatgaattgatactaaaaatagtacaaaagatggatgaaagaaaaagttgttttttttttttaaaagataagcaaaatcaacaaacctttagccggactgtaaaagagagaatatccatatgaataaaatcagagatgaaaaaggagtcattacatctgataacacagaaattcaaaatattttagagactattatgagcaactatatgcagtaaattggaaaacttagaagaaatggatgaattccgagacacataaaaacataccaagattgaaccatgaagaaatccaaaacttgaatagaacaacattaacaagatggaagcggtagtaaaaagcctcttatcaaagtagaccaggacctggtgttttcgctactgaattctgcc

SEQ ID NO: 8244 - DNA, 9188 bp, Homo sapiens
ctgttttaatgctggtcatttgtgtctgaattccaaagggacgggagtataatgaggtttgtctgacccctccctcccatcatggcctgaactagtttttcaggttttctttggaatgcccttggtcaagaagaggatccgttcagttggttgggggagcttagaattttatttttgtttgctctcctcagtgtcccaagtagttggactataggcacacaccacacagcaccacacctggcttgtttcctttttaaaatggtggctcttgtcctttttgggaagtgtttgggcacagaggtactgatactgttattctggttttagaataagaggctgatggaacctgcaggtaagggaagagctttgacttggacagagaagtggccagcttcttaataaaaagtgggtaagatggaggtgaaacttggacacatgcaatatctgacattgtaaatccttttttcttgtgaggctggattttgttgcttcatatgtgataacagaccaattatatcagtagttcaatggtgatgttcagtttaatctcttttcctctcttgtacagtactcttgttttagctttcgtaaactctgggctttcaccggaccaggttttcttatgagcattgcctacctggatccaggaaatattgaatccgatttgcagtctggagcagtggctggatttaaggtgaacatctagtcctacccctgtccttttaagcacataatacactctcacatccttttctccaccctgcatgttggatagtagcctcaggggctacatgcagatacttcattggcagtggctcttatgtgtaaagtactttccatttggtcttatttttatccacatagtttccttgaacaaaggagaaactacatataggagaaactgaggctcagaaaggtacaaggtgacttagcaggtcatgtgcaaaatctgttatagaactcaagtcatttgattcttgacctgggctcttttctgaatgcagtatttaccactcatgttgccaaacaactaaacaaacaaacagacaaaaactcagttgttcaatgagtgttacaggagattttgttcttcttagttgctctggatccttctgttggccacccttgtggggctgctgctccagcggcttgcagctagactgggagtggttactgggctgcatcttgctgaagtatgtcaccgtcagtatcccaaggtgagcaatgtattgtcctgtttgtctctcacccatgccataggaatctgtgtgtctggcggtatgtgctggcctcattctatagtgagacagtcaaggacttgggggtcagtggccctgaagacagacggtaccaacggaaatactgtagctcctcctgctgccaggccatgttttccccctctttcaaaatctaacttgagactcgcatttcctagaaggttttcttagaaaaactgtgttaccattcactctggcttccagtatctagcaatgcccagcccaaggggaggaggatgctctctctaagcacttttattcatacctccatgttactccatcagtttgcattttatatatgttctttttttgtttgactttgccatcactttgaaaaagtaattttttttctttttagtacaaactatatgtggcaagatctttggatttgctaataattatttttcagtttcccctcccaccgggggctacactgtcctctgcagcttcttctggacattttgggcctttcttaccgttgcctaaggcaagaatgaacactatgtctggaagatatttttaacttagttttgtctcttgttttgtttcttttcctgggtgtgagcaaaaagtatccttatctgcttttcaaaaaaataaaaaaatcttgataatatccccatttactctgatgtgattattacacattttatgcctatatcaaaatatcccatatgccccataatatatacacctactatgtacccataaaatttttaaaaaacaaacaaaaccttggtaatttataatccttctagcttctttttctttctttcttcttattttttgagacggagtctcactctgtcacccatggtggagtgcagtgatgtgatcatggctcactgcagccttgacctcccaggctcaagcgattctcccatctcagcctcccaagtagctgggaccacaggcgagcacgaccacacccagctaattaaaattttttttttttttttttttgtggagatgaggtattgctatgttgtctaggctggtctcaaactcctgggctcaggcagtcctcccaccacagcttctcaaagtgctgggacgacaggcatgagccactgcaccaagcctagcttctctttcttcatacacgttaatagttattttgtaataataattatatatatatatatttgtttgtttgtttgttttgtttttttttttgagacagaatctcactctgttgcccaggctggagttcagagttcagtggtgtgatctcagctcactacagcctctgcttcttgcagtgaggcgattccagggattctcctgcctcagcctcctgactagcttggattacagccacgtgccaccatctggctaatttttgtatttttagtagagatgaggttttaccatgttggtcaggctggtcttgaactcctggccttaggtgatctgccagccttcgcctcccaaagtgctgggattacaggcatgagccaccgtgcccagcctgcttttttgtttgtttgtttgagacggagtttcactctttcacccaggctggagtgcagtggcgtgatctcagctcactgcaacctccgccttcagtttcaagtgattctcctgcctcagcctcccgagtagctgggattacaggtgcctgccaccatgcctggctaatttttgtatttttagtagagacggggtttcaccatgttggccaggctggtctcgaactcctgaccttgtgatctgcccacctcggccttccaaagtgctgggattacagacgtgagccactgcgcctggccttgttttggtatttttgagatggagtctcactctgttgcccagcctggagtacagtggcgtgatctcagctcaccacaacctccgcctcttgggttcaagctattctcctgcctcagcctcctgagtagctgggactacaggcgtgcatcaccacgcctggccaatttttgtatttttagtagagatgaggtttcactatgttggccagactggtctcaaactcctgacctcgtgatctgcccgccttggcctcccaaagtgctgggattacaggcgtgagctactgcgcctggctctgccctttttttttttttttgagaccaagtctcgctttgtcacccaggctcgggtacagtggtgtgatcttggcttactataacctcaacctcccaggttcaagcgattctcctgtctcagcttcccgagtagctgggattacaggtgcgcaccaccacacccagctaatttttgtatttttagtagagacagggtttcaccatgttggccaggctgatctcaaactccagacctcaagtgatccacttgccttagcctctcaaagtgctgggattacagatgtgagatactgtgcctggcctgtttttttgagataggatcttgctctattacccagactagagttcagtggcacaatcatggctcactatacccttgacctcccaggcgcaagcagccttcctacctctgtctcttgaatagttgggaccacaggtgtgcaccatgatacccagctatttttaaaattttttgtagagacagggttttgccatgttgccaaggctgggcttgaactcctgggctcaagtaatcctcccacctctgcctcccaaagttcagggattataggtgtgaactaccatgggtgacctgacaaattttttggatgctagctatctggaggtgtttttttctggcttcagtgagtcagcataactaaatctgattttcagctgtattgtttggccagataagtttctgactttgttatatgccacccagttccaaccatcttcccttgagtccttttgcatacgtgggcattattattacattaaaggtgactccaaccttttctgttgttgtggtggtggtttgttgagacagtcttgctcttgtttgttgcccactctggagtgcagtggcatgatcatagctcactgcagccttgaccactggggcttaggctgtcctcctgcctcagcctcccaagtagttgggactacaggtgtatgccatcatgcctggatacttttgtactttttttttttcctataatttttattttaggtttggagatggatacatgtgaaggttttttctttctttctttctttttttttttttttttgtgaaagcaagtttattaagaacgtaaaggaataaagaaaggctattccgtaggcagagcagtcacatgtgaaggtttgttacatagataaacacgtgtcatgggggtttgttgtacatattattacatcaccccgatattaagcccaatacacaatagttaacttttctgcttctctctctccttccaccctcccccatcaagtagaccccagtgtctgttgtttctgtctgtgtgttcataagttcttatcattttgctcccaatttttatactttttgtagagatggggttttgccatgttgcccaggctggtctcaaactcctgggcttaagggatctacgttggcatcccaaagtgctgagattacaggaatgagccactgtgcctggtccaccccaaccttttttttttttttttgagatggagtctcgctttgttgtccaggctggagtgcagtggcgcaatctcagctcactgcaaccttcgcctcccgggttcaagcaattctcctgcctcagccccctgagtagctgggattacaggcatgtgccaccatgcccagctaatttttgtatttttagtagagacggggtttcgccatgttggccaggctgatcttgaaccctgtcctcaggtgatccacctgcctcagcctcccaaagtgctgggattacaggtgtgagccaccgcgcccagcctgaccccaaccttttcatgtttgttttgtcttcccagctatggtcaggatagatatgttcttctgcaatcatttaatattctttcttgacccatatttggaccgtattagcatccttattctcctctaaactttttaggattgtttttaggaaattaagtggaagttagtaaatggcaattatattcttctcaagtagaaaggaaaaagaaaaaagtaagatcaattactgccttgaccttcgttcacaggttctgccacgtggtagcacacttttccttctccaggtgagagccacagtgcagtgatcggccaagtggaggcacgttctggtatttcttctctagtctggaggcttataaaggactgtttatggtttagtgccaaaatgtgaattccaaattgtggaggaattttttagaaatgattaatcagaaccgtgtctttctactgtttgatgtttaggtcccacgagtcatcctgtggctgatggtggagttggctatcatcggctcagacatgcaagaagtcattggctcagccattgctatcaatcttctgtctgtaggaaggtgaggggttttcctctagaaagtcatcagtgttttgctggatttccaagcagagataaaaacaaaaacccaattcatttttaattttgaagactcaactcaattgttatttcttctgtggaacctttctggaaacaatttcttctcccctggtagatgtagactctacatcttccgtttcccatggtgggttatgcttacctttattagaatgtgtggcgttttgtatcgcaattattgatttgtatgtcattttatcccgctagatactatctttttattttattttatttatttatttttttgagacagagtctttctccgtcacccaggctggagtgcagtggtatgatcttggctcactgcaacctccgcctcccaggttcaagcaattcttgtgcctcagtctcctgagtagctgggattacaggcacctgccaccatgtccagctaatttttgtgtttttagtagagacgggatttcaccatgttggccaggctggtctctaactcctgacctcaggtctaggaatgcccgcctcagcctcccaaagtgctggtattacaggcgtgagccactacacccagcccccactagatactatctatctaatcctataaaattctatctgtctaactccatgagggtaagacccaaacttttcagctttgtatcctaagagtgacatagtagactctcaaagtttaaatgaatgtaattaagttgatgctgttaccctactttacccaaggcctagttttctgccattgtccctcctccctcaagtcctagcttctccaagtgttctttatctggagagctgttgggaagagagtgtttttcaatgtttcctttctttccgtctctctgacttccatatctcatctctgacctagaattcctctgtggggtggcgttctcatcaccattgcagatacttttgtatttctcttcttggacaaatatggtaaggagagcgggaatgggagggtcaaaggagctgctctctgtcatgtggcagatggggaagtctaccttctctgagctcactgctgccttttttcctttaggcttgcggaagctagaagcattttttggctttctcatcactattatggccctcacatttggatatgaggcaagtggtacaggatattcattagcttcttaaaataagtttttgtggtttttttttttagccttttattataaaagacagtaataatgctagtatgattcacttatagtgggtgtatcaacaaaaagccaatttttccctgggccaattttaaaggaatatgatctatagcaaagattagcatgcagaaaggcctgcaggggctcccaggtttaaaatgactagatattttagggctttccagactagattctttggtcccaagttgaccatctgacaacagaacagccatggatagtgttaattaaggagggggttgcagggttattcttgggtgttaacttacaggagttctgcttttgttcatcctggtttatattaattgcagcttgaactttcccaatattaaaacagttaatgaattatatgaaatatactggatatttcctggtttgtgccccaacccagaaactccttagagtcactaatattatttgcagtactagcacctttctttgtacaattcttataaactgatttctgcttactggtctggctgaactttaaaaaatatatgtaatctatgggttgattatgcctcttggcctaaggcttccaagagaaatactgaaccggggaagagtatatatgagagtgtttaaggatgagtctctcattacacacgtactagtggcaaacagcaaatgatttttaaatgaacatgggtgaacagaagtatgctcagtatggataataaaaattgattctatattcttttttaatttttagatttttatttatttatttatttttgagccagagcgttgctctgtcatgtaggctagagtgcagtgggtgtgatcttggctcacttgcagcctccgcctcccaggttcaagtggttcttgtgcctcagcctcccaagtagctgggattattggcgtgtaccaccatgcctggctaactttttgtatttttagtagagatggggtttctctatgttggccaggctggtcttgaactgctgacctcaagtaatctgcccatcttggcctcccaaagtgctaggatttcagctgtgagccactgtgcctggccctggttgtatatttttgagccttgtggaattactaataaccacaagtcccttagcagctttttcttttttcttttctttttttttttttgagatggagtctccctctttcgcccaggctggagtgcagtggtgcgatctctgctcactgcaacttccacccccaggttcaagcgattctcctgcctcagcctcccacgtagctgggattacgggtgcccgccaccgtgcctggttaatttttgtatttttcgtagagacggggtttcactatgtttgccaggctggtcttgaactcctgacctcaggtgatccacccgccttgacctgctaaagtgctaggattacaggcgtgagccaccatgcctggccttttttttttttttttttttttttttgagacagagtctcacactattgcctatgctggagttcagtggcacgatctcagctcacctcctgggctcaagtgatccttccacctcagcctccctagtagctagtactataggtatgcaccaccacaccgaggtaatttttgtagagataaggttttgttgtgttgtcaggctgctcttgaactcctgggctcaagcaatgcgcctgccttggtctcctaaagtgctgggattataggcgtgagccaccgcacccagccctttctttagaaattaattatgtatcatacacatctgtttcatatatctaagatgtgttgtaaactatccggatactcagtcttgaattctctggcccctaatagtaagccccttatgttgcttggtcctatgatgattctgtattcctcattatcttaggtagttgcagaagaaaagattttggccaggtgtggtggcctgtaatcccagcactttgggtggctgaggtgggaagattgcttgttcttgggagattgaggtttcagtgagctgtgatcatgccactgcattccagcctgggtgacagagcaagatcctatctcaaaaaatataaaaataaggaagaaggcattgtaagggataaaggatgctaactgttccctggtactatgttactcccgtttcacgttcctgtaaaggctaatcattgttatgttggtatgtagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaag

SEQ ID NO: 8245 - DNA, 100 bp, Homo sapiens
caccaccatgcctggctaatttttctatttttagtagagatgtggtttcaccatgttggccaggctggtctcgaactcctgagctcaagcaatccacccg

SEQ ID NO: 8246 - DNA, 9437 bp, Homo sapiens
aagtagaagacagcggcgttgccatggcggcgtctctgggtaggtagccggccccgcccttccatggatttcccgaccctcgcctcgaattcatttcctgctccacatccaccctctaaccccgacccctgctacaaccccagaggccggactcctggattcatctccctagcttccctgggcctgccttagccgccagtcgcagccgaggcgaagagagcgaaggagggaagtgggggcggctagctggggctagaaggccaggagagggcggggtgggcggccgtttggggtgggggtcagggtgactcactcgtctgcattcagggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgaggtgcgtctctgtgaaaggcccctctctcggtggagttgccgccaagaatttggtctttggagtcaaacaggtctgggtcagccccaccacttactcactagaaattctcggaaaagtcagttgtccttgagcctcagtttcatcatctgtaaatggcgattataataataaccatctgataggtcagttgcaggaattaggtgagatacgtagagcacttagcattaggcctagaacatagtaagtgctcaatctatggctgccattattcacattttattgtgattccttcagttacataaggcaacatttgtgagcctttccagagggagggcttggggctcaaattggccctgcaggggaggagttcagaggaggaaggctggagctggaggacttggggaaggcttcctggaggggctgacattggcttcaaggccttgcaggatgggaactagcagaggtgagggagagggtagtttgagcaaaggcacagacttcagtctgtttccctctttgccctggaaggatcctccttagagggattagtgttctctgggtccttataaccctgcctccctccaaggaaagacattcgctaggagctcaaagaaggcagtgctgctcagtcaggccatcacactgactgcaggtttctcctctttccagtacctgatgccctttctcctcaaccagtgtggatcccttctctattacctcaccttggcatcgacaggtgggtcctggcttggaactgttctgcttagtgtttgaggccacctggaagagtgattggggggggcggggtggagcttgaaacacctcattcccatcagtgagagagggctgactagctctagttccctcttactatcctcttctctgaacaagaggggcacagtgtgctggttatgagtatgttgctaggcactggagttggtttgaagcctggcagtcatgtgtgaccagcggaggaagaaggaaggttcattttgctgtgccaagtgctggctttcacattcttgcttccactgtgtgctacctacctgaccatgagcaagtcacccatttgagccttggttttatatagttggcttcatagcattgtgaggattaaatttaatgaatgggaaacatctaggagagtgcctggcacacagtcagagctccatatacataaatttcctttctcttgacatttgtgactgccctctactacgtcagatactgcactagtcttacacattatttaattccaatcatgactctgtaaagcagatatgattatcttagaaaatgaagttgcaaaactttgtgcaatttcacctctcaagtcccacaggatgtcagtgcagaaggatttgaagccatatattaaaagtttatgctcgactgggcatggtgactcacgcctgtaatcccagcactttgggaggccaaggagggcagatcatttgaggtcaggagttcgagaccagtctggccaacatgctgaaaccccgtctctactaaaaataacaaaattagttgggtgtggtggtgtgtgcctgtagtcccagctacttgggaggctgaggcgcgagaatggcttgaacctgggaggcggaggttgcagtgagctgagatcatgccactgcactccagtccctgggcaacagagcgagactctgtctcaaaaacagaaagaaagaaataatatgcacttatttaaagagtttgaaaacctctggcctcatgcattcactgctgtggaagaatgctgaacccttgaccagctgactacaggtagccattcaccaagttttaatcaaattgcagttttaggttctttttatctcattaccctttctgcctgtatcctttaatatccatcctttctaataaccagaacagtaataactatttatgaagcatccacttcagccagggactatccatgcattatcacagttcatcttacgacaacccaacaaaagaaatggtatactgtgacccctattttacatgcggggaaacaggttgagtgtttgaatatcctaaccaagattgcaagggaaactcagatctgcctcactccaatgccctcactttccactgcaccgtgctgcatccttcttccatctactgttgcaaaccagaccttagcagccatgacactccttgtaaggtatgtaaacttaagaaggcagctctgggcagggcacagtggctcaggcctataattccagcacttttggaggctgaggtgggcagataacctgagcctagagatcaccctaggcaacaacaacaacaaaaatacgaaaattaactgggcttggtggtgtgtgcctgtagtcctagctgctcaggaggctgaggtgggaggatcgcttgagctcaggaggttgaggctgcagtgagccttgacctcaccactgcactccagcctgagcaacagagagagaccctgtctcaaaacaacaacaacaaaaacgaaaaacaaccaaaaaagaaagcagctctttgtaagtggggttgtatcaatttcttagatgggtaatgcctccatgctggggcctcccaggggatgaggagcaggacagtttgctcctttgcctcacacaggcgagccctgggagtgctgggaaagaatttgctgaggagccagtgtgaacatctggtctgcagttgagtcttgttaccatggataactcagctgattcgtccattggtcttttttatgtgtatgtggtgctttttttttttttttttgagacggcatttcgctcttgttgcccaagctggagtgcaatggtgcgatcttggctcactgcaacctccgcctcccaggttcaagtgactctccttccttagcctccccactagctgggattatgggcatgtgccaccacgcctggctaattttgttcttttgtttttgttttttgagatggagccttgctgtgtcacccaggctggagtgcagtggtgcaatctctggtcactgcaacctctgcctaccaggttcaagcaattctcctgcctcggcctcccaagtagctgggactacaggcatgcaccaccatgcctggctaatttttgtatttttagtagagacggggtttcacaatgttggccaggctggtcttgaactcctgacctcaaatgatccacccgcctcggcctcccaaagtgctgggattacaggcgtgagccaccacacccagcctaattttgtattttcagtagagacggggtttctccatgttggtcacgctggtctctaactcccaacctcaggtgatccgcccgtctcagccttccaaaatgttgggattacaggcatgagccactgcgcctggctgtggctctttttttgatgtgataagaacacttaacaggagatctaccctcaacaaattttaagttaactccattagtctttttcttttttttttgagacagagtttcactcttgtttctcaggctggagtacagtggtgtgatcttggctcagtgcaacctctgcctcctgggttcaagcgattctcctgtctcagcctcctgagtagctgggattacaggcgtccgccactatgcctggctaatttttggtatttttagtagagacggggtttcaccatgttggccaagctggtcttgaactcctgacctcaggtgatccgcccgcctcagcctcccaaagtgctgggattacaggcgtgagccaccctgcacccagccaactccattactctttttcaagtttgcttattggcagtcagccccttggaacttcaaaattaaggaacagatcctgggctatgatgccctctacccacaccacaggtccagcccaatgtcctgaacaggtcctgctccttccttctgacactttttatttttaactccataaggcctgagcttgggctgaaacagaaacaaaatgtgcttcatctgatgttctgctctgtctatatccacagtttaataacggcgcaggctttggagtcaggcaagccttggtttaaatcctcaacttgccttagtttatgtgacttctttgagcctttgtttcttttacgcaaaatggtgataatccccttcttgcagtgttgtgaaaactgagatatgtacacaaagcacctaggccatggtatgtgcttaataaatggtggctgtgcttggtgttacctgactctctactcatcctttgggatttgggtgcctgcctgtccgtccagatgtccttgagatctcacgagttctctttgagtgcaaagacctcattctcattatcaaaccaggctggtcccagacctcagagttcaggtcttcatgctggaatcctgggaagcactgaacgtggagtcaggagatgtgggtttgagtcctgagatttgctgtgacttcatctggaagatggggttttgataccttttttaaaggtatgaaatgatgatgatggaagtgttttgtgcctagaaaggcatttgttgcatctcaggcattcttttcattctgaccacccagatctgaccctggctgtgcccatctgtaactctctggctatcatcttcacactgattgttgggaaggcccttggagaagatattggtggaaaacgtaagttagactactgcgagtgcgggacgcagctctgtggatctcgacatacctgtgttagttccttcccagaacccatctccccagagtgggtgaggacacggccttttcccatcctgccctttcctctgcagctgttttgcttccttgtggccatcagagttcccttcccctggacagtctggagaaagacagaggctggggtttgggattgaagaccagaccccatctgagcccttcctccagccctgtaccagctcctactggcatggctgagctcagaccctcctgatttctgcctattatcccaggagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcggatggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccccagcagctctcttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatggtaaacagacaagaggttagtaagtattcttttattgtgacaaaccctctcccaggcttagtcagctactcctttctctggccagagaatcccataaggaaatagcccccacagccagggctgctctgctcagaggaagggaaggctgggctgtgggtttaggagcaggagaacggggagggctgaggaggccgcagtgtaccctgtgagcccagcggaggtgctggctcctgaggaacaagctgctggaggctaaggacaaaaggtggccagagtagtggtccccagttgccctctggagctgctggctctcaagatggcagagctggggctgaggctgagatagcagccccagccccaggctggttttccagggacaaggcctcttccactatctgtgctgccctctgcaggaggtggaaggccatacagaatggagccgtgagtatggccagcctccagctctcagccaggaggtccccaaccccaaggaaggaagaaactggaaattaggaactgcttcctcatttaacaaggtaggaagttaggagatcatttactttcaatcacaagggaggagaactgttcctggggcccaaggctgccagtttccagctcagagctcctcccaccccaacatactgtttcctgatccaacagcttacctgatccaagggctcctctgtctgagtgtcttcatcatctgctacttccagggcccccgctgtctccttccttcggtggggagctccatatactcctataactcctaaagaggggaggcagcactgggtgatgcccaggctgaagagccctcagcattcctgccctggaccttcatgctagcccctttccctcccctgaacctggttctgcattccccaccacctcccaggatggcaaggaagtgagaggtgggcctttggtcccacccccatcccctctatatcccacccctgaagtcttatcgctttaagcactgccctttccaggtgcttcttttcatgtgatgaggccctgtgaagaagggacaggatatacagacgggggcagctggagacagttatgatgaggtcagtaccagctttttttttttttacgggcagtctcctgagccacagtaggttcagactcctttatcttttttttttttttccagtgccggctttgtgtctgagcattctgctcccatggacatccccaacaacagcagggaccaacctatgtcactgtcaaagggcagctgagaagggcctgagccccagggacccctcacctgatgggaatgagagtgtggggagcttgcttcttggctgaatggtctgctggggtctggcatagaaagcagatggcttaattcggtctggttcctttggagagggctgggttacctgggccctgtggccttgggcctagagaagggacactgggcttggaccctgattgctggccattcttacctttcctactccccagttcaggcttcagagagcccctgacgcctgcaggaacatggcagaggagacaccgtctgtcttcacaaagtacgtcctccctccttgctgcctcttcccaccagcctgacttatccagggacagagcagtagatgcctggcactcctcgatgcccagtgaaaccagactgtgcttccccacccccaccaccatgccccatgctcactggctcatttcttgggagggcttagagctggataatataagttcccttggaccctgctgtgccaaatataccaattctctctcccagcgtccaacctagcaagaaggtattaagtcctgcaaatcagatgagaattctggtctggcccctgccactcaataactctgtcaccctgaacaaatcacttcactttttttttttttttttttttttttgagacttgagtcttactctctcacccaggctggagtgcagtggtgtgatctcagctcaccacaacctccgcctcccaggttcaagtgattctcctgcctcagcctcccaagtagctgggactacaagcacccaccaccatgcccagctaatttttttgtacttttagtagagatggggttttaccatgttggccaggctggtcttgaactcctgacctcaggtaattcactctcctcagcctcccaaagtgctgggattacacgtgtgagccatcgtgcccaaggcccacttcacttttcagcttcagtttccacctctggaaaatggggataatctttctttcacaagattattaagagtggccaggcgaggtggctcacgactgtaatcccagcactttgggaggctgaggtgggcagatcacctgagggagtttgagaccagcctgaccaacatggagaaaccctgtctctactaaaaattaaaaaaattagccgggtgtggctgagcgcggtggctcacgcctgtaatcccagcactttgggaggctgaggtgggctgatcacgaggtcaggagatcgagaccatcctggctaacacggtgaaaccccgtctctactaaaaatacaaaaaaaattaaccgggcatggtggtgggtgcctgtagtcccagctgctcgggaggctgaggcaggagaatggcatgaacccgggaggcggagctggcagtgagccaagattgcgccactgcattccagcctgggcaacagagcgagactccatctcaaaaaaaaaaaaaaaaaaaaaaattagccgggtgtggtggcacatacctgtaatcccagctactcgggaggctgaggcaggagaatcacttgaacccagaaggtggaggttgcagtgagctgagattgtgctattgcactccagcctgagcaacaagagtgaaactccgtctcaaaaaaaaaaaaaaaaattattaagaggatgcaggctgggcatagtgtaatcacagcactttgggaggccaaggtgggaggattgcttgagcccaggagttcaagaccagccttcgcaatatcgtgagactcatctctatatttaaaagaaaaaaggaggccgggcacggtggctcacgcctgtaatcccagcactttgggaggctgaggcgggcagatcacaaggtcaggagttcaagaccagcctggccaacatggtgaaaccccatctctactaaaaatatacaaaattagctggatatggtggagcgtgcccataatcccagctactcaggaggctgaggcaggagaattgcttgaaccgggacctgggaggcggaggttgcagtgagccaagatcctgccactgcactccagcctggactacagagcaagactctgtctc

SEQ ID NO: 8247 - DNA, 4601 bp, Homo sapiens
ggagatgtgggtttgagtcctgagatttgctgtgacttcatctggaagatggggttttgataccttttttaaaggtatgaaatgatgatgatggaagtgttttgtgcctagaaaggcatttgttgcatctcaggcattcttttcattctgaccacccagatctgaccctggctgtgcccatctgtaactctctggctatcatcttcacactgattgttgggaaggcccttggagaagatattggtggaaaacgtaagttagactactgcgagtgcgggacgcagctctgtggatctcgacatacctgtgttagttccttcccagaacccatctccccagagtgggtgaggacacggccttttcccatcctgccctttcctctgcagctgttttgcttccttgtggccatcagagttcccttcccctggacagtctggagaaagacagaggctggggtttgggattgaagaccagaccccatctgagcccttcctccagccctgtaccagctcctactggcatggctgagctcagaccctcctgatttctgcctattatcccaggagcagttgctggcatggtgctcaccgtgataggaatttcactctgcatcacaagctcagtgagtaagacccaggggcaacagtctaccctttgagtgggccgaacccacttccagctctgctgcctccaggaagcccctgtgccatgaagtgctggcagtgagcggatggacctagcacttcccctctctggccttagcttcctcctctcttatggggataacagctacctcatggatcacaataagagaacaagagtgaaagagttttgtaaccttcaagtgctgttcagctgcggggatttagcacaggagacttacgctcacctcaagcaacctttctgcccagcagctctctttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatggtaaacagacaagaggttagtaagtattcttttattgtgacaaaccctctcccaggcttagtcagctactcctttctctggccagagaatcccataaggaaatagcccccacagccagggctgctctgctcagaggaagggaaggctgggctgtgggtttaggagcaggagaacggggagggctgaggaggccgcagtgtaccctgtgagcccagcggaggtgctggctcctgaggaacaagctgctggaggctaaggacaaaaggtggccagagtagtggtccccagttgccctctggagctgctggctctcaagatggcagagctggggctgaggctgagatagcagccccagccccaggctggttttccagggacaaggcctcttccactatctgtgctgccctctgcaggaggtggaaggccatacagaatggagccgtgagtatggccagcctccagctctcagccaggaggtccccaaccccaaggaaggaagaaactggaaattaggaactgcttcctcatttaacaaggtaggaagttaggagatcatttactttcaatcacaagggaggagaactgttcctggggcccaaggctgccagtttccagctcagagctcctcccaccccaacatactgtttcctgatccaacagcttacctgatccaagggctcctctgtctgagtgtcttcatcatctgctacttccagggcccccgctgtctccttccttcggtggggagctccatatactcctataactcctaaagaggggaggcagcactgggtgatgcccaggctgaagagccctcagcattcctgccctggaccttcatgctagcccctttccctcccctgaacctggttctgcattccccaccacctcccaggatggcaaggaagtgagaggtgggcctttggtcccacccccatcccctctatatcccacccctgaagtcttatcgctttaagcactgccctttccaggtgcttcttttcatgtgatgaggccctgtgaagaagggacaggatatacagacgggggcagctggagacagttatgatgaggtcagtaccagctttttttttttttacgggcagtctcctgagccacagtaggttcagactcctttatcttttttttttttttccagtgccggctttgtgtctgagcattctgctcccatggacatccccaacaacagcagggaccaacctatgtcactgtcaaagggcagctgagaagggcctgagccccagggacccctcacctgatgggaatgagagtgtggggagcttgcttcttggctgaatggtctgctggggtctggcatagaaagcagatggcttaattcggtctggttcctttggagagggctgggttacctgggccctgtggccttgggcctagagaagggacactgggcttggaccctgattgctggccattcttacctttcctactccccagttcaggcttcagagagcccctgacgcctgcaggaacatggcagaggagacaccgtctgtcttcacaaagtacgtcctccctccttgctgcctcttcccaccagcctgacttatccagggacagagcagtagatgcctggcactcctcgatgcccagtgaaaccagactgtgcttccccacccccaccaccatgccccatgctcactggctcatttcttgggagggcttagagctggataatataagttcccttggaccctgctgtgccaaatataccaattctctctcccagcgtccaacctagcaagaaggtattaagtcctgcaaatcagatgagaattctggtctggcccctgccactcaataactctgtcaccctgaacaaatcacttcactttttttttttttttttttttttttgagacttgagtcttactctctcacccaggctggagtgcagtggtgtgatctcagctcaccacaacctccgcctcccaggttcaagtgattctcctgcctcagcctcccaagtagctgggactacaagcacccaccaccatgcccagctaatttttttgtacttttagtagagatggggttttaccatgttggccaggctggccttgaactcctgacctcaggtaattcactctcctcagcctcccaaagtgctgggattacacgtgtgagccatcgtgcccaaggcccacttcacttttcagcttcagtttccacctctggaaaatggggataatctttctttcacaagattattaagagtggccaggcgaggtggctcacgactgtaatcccagcactttgggaggctgaggtgggcagatcacctgagggagtttgagaccagcctgaccaacatggagaaaccctgtctctactaaaaattaaaaaaattagccgggtgtggctgagcgcggtggctcacgcctgtaatcccagcactttgggaggctgaggtgggctgatcacgaggtcaggagatcgagaccatcctggctaacacggtgaaaccccgtctctactaaaaatacaaaaaaaattaaccgggcatggtggtgggtgcctgtagtcccagctgctcgggaggctgaggcaggagaatggcatgaacccgggaggcggagctggcagtgagccaagattgcgccactgcattccagcctgggcaacagagcgagactccatctcaaaaaaaaaaaaaaaaaaaaaaattagccgggtgtggtggcacatacctgtaatcccagctactcgggaggctgaggcaggagaatcacttgaacccagaaggtggaggttgcagtgagctgagattgtgctattgcactccagcctgagcaacaagagtgaaactccgtctcaaaaaaaaaaaaaaaaattattaagaggatgcaggctgggcatagtgtaatcacagcactttgggaggccaaggtgggaggattgcttgagcccaggagttcaagaccagccttcgcaatatcgtgagactcatctctatatttaaaagaaaaaaggaggccgggcacggtggctcacgcctgtaatcccagcactttgggaggctgaggcgggcagatcacaaggtcaggagttcaagaccagcctggccaacatggtgaaaccccatctctactaaaaatatacaaaattagctggatatggtggagcgtgcccataatcccagctactcaggaggctgaggcaggagaattgcttgaaccgggacctgggaggcggaggttgcagtgagccaagatcctgccactgcactccagcctggactacagagcaagactctgtctc

SEQ ID NO: 8248 - DNA, 9435 bp, Homo sapiens
aagtagaagacagcggcgttgccatggcggcgtctctgggtaggtagccggccccgcccttccatggatttcccgaccctcgcctcgaattcatttcctgctccacatccaccctctaaccccgacccctgctacaaccccagaggccggactcctggattcatctccctagcttccctgggcctgccttagccgccagtcgcagccgaggcgaagagagcgaaggagggaagtgggggcggctagctggggctagaaggccaggagagggcggggtgggcggccgtttggggtgggggtcagggtgactcactcgtctgcattcagggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgaggtgcgtctctgtgaaaggcccctctctcggtggagttgccgccaagaatttggtctttggagtcaaacaggtctgggtcagccccaccacttactcactagaaattctcggaaaagtcagttgtccttgagcctcagtttcatcatctgtaaatggcgattataataataaccatctgataggtcagttgcaggaattaggtgagatacgtagagcacttagcattaggcctagaacatagtaagtgctcaatctatggctgccattattcacattttattgtgattccttcagttacataaggcaacatttgtgagcctttccagagggagggcttggggctcaaattggccctgcaggggaggagttcagaggaggaaggctggagctggaggacttggggaaggcttcctggaggggctgacattggcttcaaggccttgcaggatgggaactagcagaggtgagggagagggtagtttgagcaaaggcacagacttcagtctgtttccctctttgccctggaaggatcctccttagagggattagtgttctctgggtccttataaccctgcctccctccaaggaaagacattcgctaggagctcaaagaaggcagtgctgctcagtcaggccatcacactgactgcaggtttctcctctttccagtacctgatgccctttctcctcaaccagtgtggatcccttctctattacctcaccttggcatcgacaggtgggtcctggcttggaactgttctgcttagtgtttgaggccacctggaagagtgattggggggggcggggtggagcttgaaacacctcattcccatcagtgagagagggctgactagctctagttccctcttactatcctcttctctgaacaagaggggcacagtgtgctggttatgagtatgttgctaggcactggagttggtttgaagcctggcagtcatgtgtgaccagcggaggaagaaggaaggttcattttgctgtgccaagtgctggctttcacattcttgcttccactgtgtgctacctacctgaccatgagcaagtcacccatttgagccttggttttatatagttggcttcatagcattgtgaggattaaatttaatgaatgggaaacatctaggagagtgcctggcacacagtcagagctccatatacataaatttcctttctcttgacatttgtgactgccctctactacgtcagatactgcactagtcttacacattatttaattccaatcatgactctgtaaagcagatatgattatcttagaaaatgaagttgcaaaactttgtgcaatttcacctctcaagtcccacaggatgtcagtgcagaaggatttgaagccatatattaaaagtttatgctcgactgggcatggtgactcacgcctgtaatcccagcactttgggaggccaaggagggcagatcatttgaggtcaggagttcgagaccagtctggccaacatgctgaaaccccgtctctactaaaaataacaaaattagttgggtgtggtggtgtgtgcctgtagtcccagctacttgggaggctgaggcgcgagaatggcttgaacctgggaggcggaggttgcagtgagctgagatcatgccactgcactccagtccctgggcaacagagcgagactctgtctcaaaaacagaaagaaagaaataatatgcacttatttaaagagtttgaaaacctctggcctcatgcattcactgctgtggaagaatgctgaacccttgaccagctgactacaggtagccattcaccaagttttaatcaaattgcagttttaggttctttttatctcattaccctttctgcctgtatcctttaatatccatcctttctaataaccagaacagtaataactatttatgaagcatccacttcagccagggactatccatgcattatcacagttcatcttacgacaacccaacaaaagaaatggtatactgtgacccctattttacatgcggggaaacaggttgagtgtttgaatatcctaaccaagattgcaagggaaactcagatctgcctcactccaatgccctcactttccactgcaccgtgctgcatccttcttccatctactgttgcaaaccagaccttagcagccatgacactccttgtaaggtatgtaaacttaagaaggcagctctgggcagggcacagtggctcaggcctataattccagcacttttggaggctgaggtgggcagataacctgagcctagagatcaccctaggcaacaacaacaacaaaaatacgaaaattaactgggcttggtggtgtgtgcctgtagtcctagctgctcaggaggctgaggtgggaggatcgcttgagctcaggaggttgaggctgcagtgagccttgacctcaccactgcactccagcctgagcaacagagagagaccctgtctcaaaacaacaacaacaaaaacgaaaaacaaccaaaaaagaaagcagctctttgtaagtggggttgtatcaatttcttagatgggtaatgcctccatgctggggcctcccaggggatgaggagcaggacagtttgctcctttgcctcacacaggcgagccctgggagtgctgggaaagaatttgctgaggagccagtgtgaacatggtctgcagttgagtcttgttaccatggataactcagctgattcgtccattggtcttttttatgtgtatgtggtgctttttttttttttttttgagacggcatttcgctcttgttgcccaagctggagtgcaatggtgcgatcttggctcactgcaacctccgcctcccaggttcaagtgactctccttccttagcctccccactagctgggattatgggcatgtgccaccacgcctggctaattttgttcttttgtttttgttttttgagatggagccttgctgtgtcacccaggctggagtgcagtggtgcaatctctggtcactgcaacctctgcctaccaggttcaagcaattctcctgcctcggcctcccaagtagctgggactacaggcatgcaccaccatgcctggctaatttttgtatttttagtagagacggggtttcacaatgttggccaggctggtcttgaactcctgacctcaaatgatccacccgcctcggcctcccaaagtgctgggattacaggcgtgagccaccacacccagcctaattttgtattttcagtagagacggggtttctccatgttggtcacgctggtctctaactcccaacctcaggtgatccgcccgtctcagccttccaaaatgttgggattacaggcatgagccactgcgcctggctgtggctctttttttgatgtgataagaacacttaacaggagatctaccctcaacaaattttaagttaactccattagtctttttcttttttttttgagacagagtttcactcttgtttctcaggctggagtacagtggtgtgatcttggctcagtgcaacctctgcctcctgggttcaagcgattctcctgtctcagcctcctgagtagctgggattacaggcgtccgccactatgcctggctaatttttggtatttttagtagagacggggtttcaccatgttggccaagctggtcttgaactcctgacctcaggtgatccgcccgcctcagcctcccaaagtgctgggattacaggcgtgagccaccctgcacccagccaactccattactctttttcaagtttgcttattggcagtcagccccttggaacttcaaaattaaggaacagatcctgggctatgatgccctctacccacaccacaggtccagcccaatgtcctgaacaggtcctgctccttccttctgacactttttatttttaactccataaggcctgagcttgggctgaaacagaaacaaaatgtgcttcatctgatgttctgctctgtctatatccacagtttaataacggcgcaggctttggagtcaggcaagccttggtttaaatcctcaacttgccttagtttatgtgacttctttgagcctttgtttcttttacgcaaaatggtgataatccccttcttgcagtgttgtgaaaactgagatatgtacacaaagcacctaggccatggtatgtgcttaataaatggtggctgtgcttggtgttacctgactctctactcatcctttgggatttgggtgcctgcctgtccgtccagatgtccttgagatctcacgagttctctttgagtgcaaagacctcattctcattatcaaaccaggctggtcccagacctcagagttcaggtcttcatgctggaatcctgggaagcactgaacgtggagtcaggagatgtgggtttgagtcctgagatttgctgtgacttcatctggaagatggggttttgataccttttttaaaggtatgaaatgatgatgatggaagtgttttgtgcctagaaaggcatttgttgcatctcaggcattcttttcattctgaccacccagatctgaccctggctgtgcccatctgtaactctctggctatcatcttcacactgattgttgggaaggcccttggagaagatattggtggaaaacgtaagttagactactgcgagtgcgggacgcagctctgtggatctcgacatacctgtgttagttccttcccagaacccatctccccagagtgggtgaggacacggccttttcccatcctgccctttcctctgcagctgttttgcttccttgtggccatcagagttcccttcccctggacagtctggagaaagacagaggctggggtttgggattgaagaccagaccccatctgagcccttcctccagccctgtaccagctcctactggcatggctgagctcagaccctcctgatttctgcctattatcccaggagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagtggatggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccccagcagctctcttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatggtaaacagacaagaggttagtaagtattcttttattgtgacaaaccctctcccaggcttagtcagctactcctttctctggccagagaatcccataaggaaatagcccccacagccagggctgctctgctcagaggaagggaaggctgggctgtgggtttaggagcaggagaacggggagggctgaggaggccgcagtgtaccctgtgagcccagcggaggtgctggctcctgaggaacaagctgctggaggctaaggacaaaaggtggccagagtagtggtccccagttgccctctggagctgctggctctcaagatggcagagctggggctgaggctgagatagcagccccagccccaggctggttttccagggacaaggcctcttccactatctgtgctgccctctgcaggaggtggaaggccatacagaatggagccgtgagtatggccagcctccagctctcagccaggaggtccccaaccccaaggaaggaagaaactggaaattaggaactgcttcctcatttaacaaggtaggaagttaggagatcatttactttcaatcacaagggaggagaactgttcctggggcccaaggctgccagtttccagctcagagctcctcccaccccaacatactgtttcctgatccaacagcttacctgatccaagggctcctctgtctgagtgtcttcatcatctgctacttccagggcccccgctgtctccttccttcggtggggagctccatatactcctataactcctaaagaggggaggcagcactgggtgatgcccaggctgaagagccctcagcattcctgccctggaccttcatgctagcccctttccctcccctgaacctggttctgcattccccaccacctcccaggatggcaaggaagtgagaggtgggcctttggtcccacccccatcccctctatatcccacccctgaagtcttatcgctttaagcactgccctttccaggtgcttcttttcatgtgatgaggccctgtgaagaagggacaggatatacagacgggggcagctggagacagttatgatgaggtcagtaccagctttttttttttttacgggcagtctcctgagccacagtaggttcagactcctttatcttttttttttttttccagtgccggctttgtgtctgagcattctgctcccatggacatccccaacaacagcagggaccaacctatgtcactgtcaaagggcagctgagaagggcctgagccccagggacccctcacctgatgggaatgagagtgtggggagcttgcttcttggctgaatggtctgctggggtctggcatagaaagcagatggcttaattcggtctggttcctttggagagggctgggttacctgggccctgtggccttgggcctagagaagggacactgggcttggaccctgattgctggccattcttacctttcctactccccagttcaggcttcagagagcccctgacgcctgcaggaacatggcagaggagacaccgtctgtcttcacaaagtacgtcctccctccttgctgcctcttcccaccagcctgacttatccagggacagagcagtagatgcctggcactcctcgatgcccagtgaaaccagactgtgcttccccacccccaccaccatgccccatgctcactggctcatttcttgggagggcttagagctggataatataagttcccttggaccctgctgtgccaaatataccaattctctctcccagcgtccaacctagcaagaaggtattaagtcctgcaaatcagatgagaattctggtctggcccctgccactcaataactctgtcaccctgaacaaatcacttcactttttttttttttttttttttttttgagacttgagtcttactctctcacccaggctggagtgcagtggtgtgatctcagctcaccacaacctccgcctcccaggttcaagtgattctcctgcctcagcctcccaagtagctgggactacaagcacccaccaccatgcccagctaatttttttgtacttttagtagagatggggttttaccatgttggccaggctggtcttgaactcctgacctcaggtaattcactctcctcagcctcccaaagtgctgggattacacgtgtgagccatcgtgcccaaggcccacttcacttttcagcttcagtttccacctctggaaaatggggataatctttctttcacaagattattaagagtggccaggcgaggtggctcacgactgtaatcccagcactttgggaggctgaggtgggcagatcacctgagggagtttgagaccagcctgaccaacatggagaaaccctgtctctactaaaaattaaaaaaattagccgggtgtggctgagcgcggtggctcacgcctgtaatcccagcactttgggaggctgaggtgggctgatcacgaggtcaggagatcgagaccatcctggctaacacggtgaaaccccgtctctactaaaaatacaaaaaaaattaaccgggcatggtggtgggtgcctgtagtcccagctgctcgggaggctgaggcaggagaatggcatgaacccgggaggcggagctggcagtgagccaagattgcgccactgcattccagcctgggcaacagagcgagactccatctcaaaaaaaaaaaaaaaaaaaaaaattagccgggtgtggtggcacatacctgtaatcccagctactcgggaggctgaggcaggagaatcacttgaacccagaaggtggaggttgcagtgagctgagattgtgctattgcactccagcctgagcaacaagagtgaaactccgtctcaaaaaaaaaaaaaaaaattattaagaggatgcaggctgggcatagtgtaatcacagcactttgggaggccaaggtgggaggattgcttgagcccaggagttcaagaccagccttcgcaatatcgtgagactcatctctatatttaaaagaaaaaaggaggccgggcacggtggctcacgcctgtaatcccagcactttgggaggctgaggcgggcagatcacaaggtcaggagttcaagaccagcctggccaacatggtgaaaccccatctctactaaaaatatacaaaattagctggatatggtggagcgtgcccataatcccagctactcaggaggctgaggcaggagaattgcttgaaccgggacctgggaggcggaggttgcagtgagccaagatcctgccactgcactccagcctggactacagagcaagactctgtctc

SEQ ID NO: 8249 - DNA, 3929 bp, Homo sapiens
accaatctggctcggatcccgcaggtcaaaaaagctcacaaagcactggtagcccatctgcttgtccgtggagaacatgatgatgttgcccccaaagtcaaaaccgcaggtccggacagccgaattggtcttgagaagggccagctgctttcctggagtcaggcaaagtctgggctacaccatccattgcaattgcagggaggacattctagagaatgctaccatcacatctcactgtttgtcttgctccagtgacccaaacttaaaaagtattttaacttttctttttttttttcttttttgagacagtttcactctgttgcccaggctggagtgcagtggtgcaatctcggctctcactgcaagctccgcctcccgggttcacgccattctcctgcctcagcctcccaagtagctgggactacaggcgcctgccaccatgccccgctaattttttgtatttttagtagagacgggatttcaccgtgttagccaggatggtcttgatctcctgacccgtgatccgcccgcctcagcctcccaaagtgctgggattacaggtgtgagccaccgcgcccggcctttttttttttgagatggagtttcgctcttgtcctgcaggctgctgtgcgatggtgtgatctcggctcactgcaacctttcaagcgattcttctgcctcagcctcctgagtcgatgggattacaggtgcccaccaccatgcctggctcatttttgtatttttaatagacggggtttcaccatgttggccaggctggtcttgcactcctgacctcaggtgatccacctgcctcaacctcccaaagtgctgggattacaggcgtgagccaccacacctggccaagtattttaacttcttacctagactctttcctcagacatcctgctaatgtggcactactcatacgtagactgcaatatatctgtctctccctcagactgtgcttctccacagcaaagacctgatctgatttccctccatgtccccagtacccagcatagacctggcactaaacagaacagcttaggctgggcacagtggcttgtgcctgtaatctcagcactttgggaggccaaggcgggtggatcacttgagctgaggagttcgagaccagcctggccaacatggtgaaaccctgtctctactaaaaatacaaaaattagctggtggccaggtgcagtggctcatgcctgtaatcccagcactttggaaggccgaggtgggtggattacctgaggtctggagtttgagaccagtctggccaacatggtgaaaccctgtctctactaaaaatacaaaaattagccaggtgtgatggcgcatgtctgtaatcccagctatttgggaggctgaggcaggagaatcacttgaacctgggaggcggaggttgcagtaagccaagattgtgccactgcactccagcctgggtgacacagcgagagaatctgtctcaaaaaaaaaaatcagccaagcatggtggcgtgcgcctataatcccagctactggggctggctgagacaggagaatcccttgaacccgggagacagaggttgcagtgagccgagatagtgccattgctctccagcctgggtgacagtgagactctgtctccaaaataagaaaaagaaaaaaaaaaaaaaaaagaaaacttaatctatgcttcctctaccatggcgtgtattttctcatctatctttcttgtctcttattccctagactggaaactatctatggatttcatctctattttcctaggacctgtttactcaaacaggtacactgtaggtcctcaatatttgctaaaaaggtgaatgaacccagcttacctgtttcacagtcccagagacgacagctgttgtcagctgagccagtgaggacatgcttggtgtcccctgaagagttgttaagaaatatgacgaagttcacccgagcccttgtcctcttgggatgccaagtgaatcatctccctgttcagccccaaagagcctttctacccctcttacctccttatccagaactggaatttgtcctgaatgtttcctcagtcagtgaagagaccagggagtaggaggtatcgttctctaggccctcaacagcacccccaactcccaactcccaactcagcctctccatcgctgacagaccctagcaacacggactcagacccaaaataaggatacagtcagcgtccacacaccacacagctccggtatggcccatgtaggtgcccagcctctcaccattcacagagtaccatacattgacgatctggaaaagtcaaaccacaggatagtacacatcccagtaagagcaatggcttcctattttgccccaggaaccctcagcagcctgtagcaaggctgattctgccctcttctgtttatttcttgggaaacagcagggagctggtaaaaagaccaactcctggattctcctcccttcctgaagggaagcaacagaggagtcaggcggcttgtaaaggcatcctcatttgttagctccagctctcctgggactcccaacggctccaaagaataaaaggccaagttgagctccagtccagaaaaacagtatctctgatgtcttatccaagtgggagcagctggtagtaaggaagtctgggttctggtgcctgctctgccactgtctcactatatgatctcaaatacagtgcttctctcctctgaacttcagttttctcatcttgaaaatggccaggccgggtgtggtgactcatgcctgtaatcctagcactttgggaggccgaggcaggcggatcacctgaggtcaggagttcaagacaagcctgtccaacatggtgaaaccccatctctactaaagatacaaaaaattagctgggcatggtggcacgagcctgtagtcccagctactagggaggttgaggcaggagaatcgcttgaacctgggaggcagaggttgcagtgagtcgagatcgcgccactgcactccagcctaggcgacagagcgagactccgtctcaagaaaaaataaaataaaatggccaggtgcctcaaaaggcagtatcatgagggattgtttggcattgagtagcaggatgggattgacttaaaatgagactagagacaccctcattaagttccctgtgtctgaataacacagcctgcacctatcctggtagaaagattagattatccctaaaggtcgcatcccgttctctgggcaagctgaccctcatctttatcccctttccacagtggtctcttgcttttcttggagtgcagtggcacgatctcagctcaccgcgctcaagcgatcctctcgtttcagactccgaagtagctgagaccacaggcgcgaggccaccatgtcaggctaatttttttgtgtgtagagatgggtcttactacgttgctcaggctggtctccaactcctgggctcaagcgaccctcccacctcggcctctcaaagtgctgggattacaggcgtgagccaccgcactcggccaatagagttcttccccacctttcccggtagaatactttcgccaacctacccccggcatggcctctccctacttctcacaatgggctgctctttggttccccgctaacggcaaaactggcgtgtccacccatcgtcctggcagaaggatcccgcccctcccggaccccctccagccaacactcacagggtccttggccacagtaaagaggaggtctccttcgcggttatacttaatctgcgtaatggaccgctcatggccctgcagtaggatcggcttctgtggggacaagacagtaacgtcagtgctcggaattgggccccagcctcagcccaggacccccactgcaatacccctaactctgaaactcaccatcccggctgtgacgcgaggaaggccgcaacgtgagtaagaccggaaaag

SEQ ID NO: 8250 - DNA, 421 bp, Homo sapiens
attactctttttcaagtttgcttattggcagtcagccccttggaacttcaaaattaaggaacagatcctgggctatgatgccctctacccacaccacaggtccagcccaatgtcctgaacaggtcctgctccttccttctgacactttttatttttaactccataaggcctgagcttgggctgaaacagaaacaaaatgtgcttcatctgatgttctgctctgtctatatccacagtttaatacggcgcaggctttggagtcaggcaagccttggtttaaatcctcaacttgccttagtttatgtgacttctttgagcctttgtttcttttacgcaaaatggtgataatccccttcttgcagtgttgtgaaaactgagatatgtacacaaagcacctaggccatggtatgtgcttaataaa

SEQ ID NO: 8251 - DNA, 6817 bp, Homo sapiens
acctggcctcaaacttgccaatcctggtggaggttgtggttacatccatggcttcctgaccaccgcccaggaccacctgaatggaagaagaaactctagatgggaccaatggacaccaagtccattttgtgtttttctgctgccatatacatttttaacatctcacacggctcaatgggaggataccaaaggtaggggatgatcagacacttctgccacctcctgctggctgccctggggctattcaatccttccagctttgtcactcctctgggcatctcctctctgcctgacatcatttcccccacaatgttgtagcccaacttctggacaagcatctagaacttggaagcttcctgaggcttcagcaggaaggcaggtggggttctcttacatggtcatagttgggggagagggcagctgagttgacaggacgttctgtccggaaagtcttctgatgttcaagagttgtggagtcaaaaagctggagagagaaggcaggggggaaatctgtaaagagctttcctgggggaagtcgggcagggtgagctgtgcagccggagggagggagcagccctgccagaccgctgcccaggctcaccttggctgtgttgtccttggacgcggtcacaaacatggtcatgtccctggataactggatgtcgttgatctgccgggagtgctccttaacattcaccaacacctctccagactagggaaggaagaagagtgacactgaatgggcccaatccctactaatctcagctccccagaaacccaagcacccaaatgaaagctgagacagcatggactttgtgttttcctcaccccctctatcctatcagtcacccctaaatatcccttgactctgtccagtaatgtacatcctatgcctattggctagttcaggttcactctccaaacataaactgcaaaagctgttggaaggaaaatctggccattgataaccctttaaagattccctactgcctggaggaaagtcaaaactctttacctcctcacactgaaggacgtttaaaatctattccccgtcctctgtccccaagaccacaccccaagggtttctgaagactccatactttcttaactctgtgcctttgcctttgctgttccttttgcctgtgggatgttctttccttcctgcttgaagctccatttattctccagggtttaatgtacacgccacctccctgggagagtgcaccttccacacttggctgagacctctatggtggcacaattcacaatctgactcaggtgctagctgtttgcaagtctgtctccccatgggggaagggactgcatctgatttacttctttgttctaggagttcagcattatactcagcattatacagggcattatactcagtggtggcaaggaaatgctcatttgtgatccttaattatttttttgagacagggtcttgttctatcacccaggctggagtacagtggcacaatcatggctcactgcagcctcaatctcccagactcaagcaatctttcagcctcaacatcctgagtacctgggaccaaaggcacactccaccacacccagctaatttttaatttttttttgtagagacagggtcttcctatattgcccaggctgatctcaatctccgggtctcaagcaatcctgccacagcctcccaaagtgttgggattacaagtgtgagtcaccacacccggcctgtgatccttattaacatgtcctgagtactttgtgacaagtttttcaaacatgtgatatcatttgatccttgaaacattttacagataaacagggtcagagaagtcatgtaaattgcccaagatcacacagctagaaagtggtgaaatctacatttgaatctcacctctgctctttttaaaattttttattaacttttttttttttttttttttttttagagacagggtctcactgtcacccaggctggagtgcagtggtgcaatcatagctcactgcagccccaacccctgggctcaagagatcctcctgccttggcccccaaaggcactgggattacagatgtgagccacagcatacagccctgcccttgttctgaactagtgtgctatcaccaggacccgaggcaggtggatcatctgaggtcaggaggtcaggattcaagaccagcctggccaacatggagaaaccccatctctactaaaaatacaaaaattacccaggcatggtggcaggtgcctatagtcccagctactcaagaggctgaggcaggagaatggcttgaacccaggaggtggaggttgcagtgagccgagatcgtaccactgcactccagcctgggtgacagggtgatactctgtctcaaaaaaaaaaaaaaaaaaaaaaaaaggccacgagcggtggactgcctgaggtcaggagttcgtgaccagactgaccaacatggtgaaaccctgtctctactaaaaatacaaaaaaaattagccaggtgcggtggcatgcacctgtaatcccagctactcgggaggctaaggcaggggaattgcttgaaccagggaggtggaggtcgcagtgagccgagatggcgccactgcactccagcctgggcaacagagagagactctatcttaaaaaaaaaaaaaaaaattattctggtaggctcaggccccatgtggcctcttaccttggcactatactggttgagctctccactctcatggccagcgatgatgcactcccccaggggtccccaaacagcactggtgattttagagtcattgcaagggatcttcatgtagggctcattgttgtctgtgtggggcagtagatgttaggccctgggctctagaactgtaccctttacctcaaccccagccctattcccagccctcaccaatctggctcggatcccgcaggtcaaaaaagctcacaaagcactggtagcccatctgcttgtccgtggagaacatgatgatgttgcccccaaagtcaaaaccgcaggtccggacagccgaattggtcttgagaagggccagctgctttcctggagtcaggcaaagtctgggctacaccatccattgcaattgcagggaggacattctagagaatgctaccatcacatctcactgtttgtcttgctccagtgacccaaacttaaaaagtattttaacttttctttttttttttcttttttgagacagtttcactctgttgcccaggctggagtgcagtggtgcaatctcggctctcactgcaagctccgcctcccgggttcacgccattctcctgcctcagcctcccaagtagctgggactacaggcgcctgccaccatgccccgctaattttttgtatttttagtagagacgggatttcaccgtgttagccaggatggtcttgatctcctgacccgtgatccgcccgcctcagcctcccaaagtgctgggattacaggtgtgagccaccgcgcccggcctttttttttttgagatggagtttcgctcttgtcctgcaggctgctgtgcgatggtgtgatctcggctcactgcaacctttcaagcgattcttctgcctcagcctcctgagtcgatgggattacaggtgcccaccaccatgcctggctcatttttgtatttttaatagacggggtttcaccatgttggccaggctggtcttgcactcctgacctcaggtgatccacctgcctcaacctcccaaagtgctgggattacaggcgtgagccaccacacctggccaagtattttaacttcttacctagactctttcctcagacatcctgctaatgtggcactactcatacgtagactgcaatatatctgtctctccctcagactgtgcttctccacagcaaagacctgatctgatttccctccatgtccccagtacccagcatagacctggcactaaacagaacagcttaggctgggcacagtggcttgtgcctgtaatctcagcactttgggaggccaaggcgggtggatcacttgagctgaggagttcgagaccagcctggccaacatggtgaaaccctgtctctactaaaaatacaaaaattagctggtggccaggtgcagtggctcatgcctgtaatcccagcactttggaaggccgaggtgggtggattacctgaggtctggagtttgagaccagcctggccaacatggtgaaaccctgtctctactaaaaatacaaaaattagccaggtgtgatggcgcatgtctgtaatcccagctatttgggaggctgaggcaggagaatcacttgaacctgggaggcggaggttgcagtaagccaagattgtgccactgcactccagcctgggtgacacagcgagagaatctgtctcaaaaaaaaaaatcagccaagcatggtggcgtgcgcctataatcccagctactggggctggctgagacaggagaatcccttgaacccgggagacagaggttgcagtgagccgagatagtgccattgctctccagcctgggtgacagtgagactctgtctcaaaaataagaaaaagaaaaaaaaaaaaaaaaagaaaacttaatctatgcttcctctaccatggcgtgtattttctcatctatctttcttgtctcttattccctagactggaaactatctatggatttcatctctattttcctaggacctgtttactcaaacaggtacactgtaggtcctcaatatttgctaaaaaggtgaatgaacccagcttacctgtttcacagtcccagagacgacagctgttgtcagctgagccagtgaggacatgcttggtgtcccctgaagagttgttaagaaatatgacgaagttcacccgagcccttgtcctcttgggatgccaagtgaatcatctccctgttcagccccaaagagcctttctacccctcttacctccttatccagaactggaatttgtcctgaatgtttcctcagccagtgaagagaccagggagtaggaggtatcgttctctaggccctcaacagcacccccaactcccaactcccaactcagcctctccatcgctgacagaccctagcaacacggactcagacccaaaataaggatacagtcagcgtccacacaccacacagctccggtatggcccatgtaggtgcccagcctctcaccattcacagagtgccatacattgacgatctggaaaagtcaaaccacaggatagtacacatcccagtaagagcaatggcttcctattttgccccaggaaccctcagcagcctgtagcaaggctgattctgccctcttctgtttatttcttgggaaacagcagggagctggtaaaaagaccaactcctggattctcctcccttcctgaagggaagcaacagaggagtcaggcggcttgtaaaggcatcctcatttgttagctccagctctcctgggactcccaacggctccaaagaataaaaggccaagttgagctccagtccagaaaaacagtatctctgatgtcttatccaagtgggagcagctggtagtaaggaagtctgggttctggtgcctgctctgccactgtctcactatatgatctcaaatacagtgcttctctcctctgaacttcagttttctcatcttgaaaatggccaggccgggtgtggtgactcatgcctgtaatcctagcactttgggaggccgaggcaggcggatcacctgaggtcaggagttcaagacaagcctgtccaacatggtgaaaccccatctctactaaagatacaaaaaattagctgggcatggtggcacgagcctgtagtcccagctactagggaggttgaggcaggagaatcgcttgaacctgggaggcagaggttgcagtgagtcgagatcgcgccactgcactccagcctaggcgacagagcgagactccgtctcaagaaaaaataaaataaaatggccaggtgcctcaaaaggcagtatcatgagggattgtttggcattgagtagcaggatgggattgacttaaaatgagactagagacaccctcattaagttccctgtgtctgaataacacagcctgcacctatcctggtagaaagattagattatccctaaaggtcgcatcccgttctctgggcaagctgaccctcatctttatcccctttccacagtggtctcttgcttttcttggagtgcagtggcacgatctcagctcaccgcgctcaagcgatcctctcgtttcagactccgaagtagctgagaccacaggcgcgaggccaccatgtcaggctaatttttttgtgtgtagagatgggtcttactacgttgctcaggctggtctccaactcctgggctcaagcgaccctcccacctcggcctctcaaagtgctgggattacaggcgtgagccaccgcactcggccaatagagttcttccccacctttcccggtagaatactttcgccaacctacccccggcatggcctctccctacttctcacaatgggctgctctttggttccccgctaacggcaaaactggcgtgtccacccatcgtcctggcagaaggatcccgcccctcccggaccccctccagccaacactcacagggtccttggccacagtaaagaggaggtctccttcgcggttatacttaatctgcgtaatggaccgctcatggccctgcagtaggatcggcttctgtggggacaagacagtaacgtcagtgctcggaattgggccccagcctcagcccaggacccccactgcaatacccctaactctgaaactcaccatcccggctgtgacgcgaggaaggccgcaacgtgagtaagaccggaaaag

SEQ ID NO: 8252 - DNA, 1597 bp, Homo sapiens
tgcctggatgttttttcctctagagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaacccccaccctgtgagaaactgcagcccccttctccagtgctttcggggagggtgcaccaggcccgccccaccttgtgagaagccgtggcccccttctcccgtgctctcagggagggtgcaaccaggcctgcccccgccttgagaaactgcagcccccttctccagtgctctgggggagggtgcaccaggcctgccaaccctgtgagaaactgcacccccttctccagtgctctcggggagggtgcaccaggcccgccccaccctgtgagaagccgcagcccgttctccattgccatttggtcctgccttccccagagctgctagcagctcggtcgaggcaagagtgactggctcagagagcgagctttgtggtattgataaatgaataaattagtatgttcatgttggaagtggctggctctgcagagtgatggacagcaggtggcatcttacattgtgatttgtggtgcacagttaaaacacttcccttcgtttcagaaggagacaatgtgaatacttggaaattatagtgaataagatgcctcccaaacttgaggaaaaggtcagattctaagagctaaacgttaagatgtaatgttccagaacaaagaggcccagagtcactgaacggggccccagggctcctagcttgagtgtaatctgagtcagcttatgaaaaggccccaaagaagaaagtggaatgtgtgctgggcacatgggacagccatggcactgagactttggaagtggccttgccagcgctgtcctgtctttctggcccacagatgagggctcctgattgtggaaggccacggaagggacctgaacacgatggcacgagacaagttatctcctgtgactgctcctctccagcaaccctcagctcaggctagactttccccctgtgttgagaatgccctgccctgtgtggaagcctgatgcatttagtgacagtgtgttagctttgttagtttctagtctggccagcaggctttccatgtgatctgccattggcttgcttcagtggccagtggagccaggggtgtccaccagagtcttggacacagacttctgaggtggcagcgggagggagcctgctccctgccacacacgtacaatttctaatccatacaggcctatgtagtatatacacacatacgcagagccttaggaattgtgaaaggccaatcaaaacttggggccctaatttcactctgccaaaagaaaaaaaaaaaaagct

SEQ ID NO: 8253 - DNA, 2028 bp, Homo sapiens
tgcctggatgttttttcctctagagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctgtgagaaactgcagcccccttctccagtgctttcggggagggtgcaccaggcccgccccaccttgtgagaagccgtggcccccttctccagtgctctcagggagggtgcaccatgcctgcccccgccgtgagaaactgcagtccccttctccagtgctctcggggagggtgcaccaggcccaccccaccctgtgagaacctgcagcccccttctccaatgctctcggggagggtacaccagggttgccccaccctgtgagaagccgccgcccccttctccagtgctctcggggagggtgcaccagggctgccccaccctgtaagaagccgccgcccccttctccagtgctctccagcccgccccaccctgtgagaagccatggccccttctccagtgcttttggggagggtgcaccagggccaccccaccctgtgagaagccgtggcccccttctccagtgctttcggggagggtacaccaggcccgccccaccctgtgagaagccgtggcccccttctcccgtgctctcagggagggtgcaccaggcctgcccccgccttgagaaactgcagcccccttctccagtgctctgggggagggtgcaccaggcctgcccaccctgtgagaaactgcacccccttctccagtgctctcggggagggtgcaccaggcccgccccaccctgtgagaagccgcagcccgttctccattgccatttggtcctgccttccccagagctgctagcagctcggtcgaggcaagagtgactggctcagagagcgagctttgtggtattgataaatgaataaattagtatgttcatgttggaagtggctggctctgcagagtgatggacagcaggtggcatcttacattgtgatttgtggtgcacagttaaaacacttcccttcgtttcagaaggagacaatgtgaatacttggaaattatagtgaataagatgcctcccaaacttgaggaaaaggtcagattctaagagctaaacgttaagatgtaatgttccagaacaaagaggcccagagtcactgaacggggccccagggctcctagcttgagtgtaatctgagtcagcttatgaaaaggccccaaagaagaaagtggaatgtgtgctgggcacatgggacagccatggcactgagactttggaagtggccttgccagcgctgtcctgtctttctggcccacagatgagggctcctgattgtggaaggccacggaagggacctgaacacgatggcacgagacaagttatctcctgtgactgctcctctccagcaaccctcagctcaggctagactttccccctgtgttgagaatgccctgccctgtgtggaagcctgatgcatttagtgacagtgtgttagctttgttagtttctagtctggccagcaggctttccatgtgatctgccattggcttgcttcagtggccagtggagccaggggtgtccaccagagtcttggacacagacttctgaggtggcagcgggagggagcctgctccctgccacacacgttccaatttctaatccatacaggcctatgtagtatatacacacatacgcagaacctttaggaattgtgaaaggccaatcaaaacttggggccctaatttcactctgccaaaagaaaaaaaaaaaaagct

SEQ ID NO: 8254 - DNA, 767 bp, Homo sapiens
ttaaaacacttcccttcgtttcagagggagacaatgtgaatacttggaaattatagtgaataagatgcctcccaaacttgaggaaaaggtcagattctaagagctaaacgttaagatgtaatgttccagaacaaagaggcccagagtcactgaacggggccccagggctcctagcttgagtgtaatctgagtcagcttatgaaaaggccccaaagaagaaagtggaatgtgtgctgggcacatgggacagccatggcactgagactttggaagtggcccttgccagcgctgtcctgtctttctggcccacagatgagggctcctgattgtggaaggccacggaagggacctgaacacgatggcacgagacaagttatctcctgtgactgctcctctccagcaaccctcagctcaggctagactttccccctgtgttgagaatgccctgccctgtgtggaagcctgatgcatttagtgacagtgtgttagctttgttagtttctagtctggccagcaggctttccatgtgatctgccattggcttgcttcagtggccagtggagccaggggtgtccaccagagtcttggacacagacttctgaggtggcagcgggagggagcctgctccctgccacacacgtacaatttctaatccatacaggcctatgtagtatatacacacatacgcagagccttaggaattgtgaaaggccaatcaaaacttggggccctaatttcactctgccaaaagaaaaaaaaaaaaagct

SEQ ID NO: 8255 - DNA, 1381 bp, Homo sapiens
ttttttttttattattatactttaagttttagggtacatgtgcacaacgtgcaggtttgttacatatgcatacatacgccatgttggtgtgctgcacccattaactcgtcatttacattaggtatttctcctaatgctttccctccccccctccccctaccccacgacaggccccagtgtgtgattttccccttcctgtgtccaagtgttctcattgttcagttcccacctatgagtgagaacatgcggtgtttggtttattttacttgcgatagtttgctgagaatgatggtttccagcttcacccatgtccctgcaaaggacatgaactcatccttttttatggctgcatagtattccatggtgtatatgtgccacatttgcttaatccagtctatcactgatgggcatttgggttggttctaagtctttgctattgtgaatagtgccgcattaaacataggtgtgcatgtgtctttatagcagcatgatttataatcctttgggtatatacccagtaatgggatggctgagtcaaatggtatttctagttctagatccctgaggaatcgccacactgtcttccacagtggttgaactagtttacagtcccaccaacagtgtaaaagtgttcctatttctccccatcctctccagcacctgtttcctgactttttaatgatcgccattctaactggtgtgagatggtatctcattgtggttttgatttgcatttctctgatggccagtgatgatgagcattttttcatgtgtctgtaggctgcataaatgtcttcctttgagaagtgtctgttcatatccttcacccactccatcaaaaagtgggtgaagtgccaatttactgagcacgagacaaatacatcattgacttcttttgtcttgtggattcaaggatgtgtccacgcccgccctccttcccctccagctcctccccttgaaatactgaagccctcaacatcatctttggaggaaggtacagagttggctctcacgcgcacatccttaaccttggcttaataaacctttaaggtggctgagacctgtctcagatacttgttggcttacaaattgaccaccatgcagggactcagagtggaggtggccctgccctttggcaggtttcctcctggtgcttaggaccagtttgggccttctttattgctcaggacagtaggacaatttgctgagatccgggagccctaccaccctccagagaatctctgatctcccgaaacttggttgaggtcgaaagtttattttgcgcacaatgccttttccttttccggtgttttacttgcttccaacaaagaaggcgagttttcctgcttccgtgatgatggggagcaggagacttccctgg

SEQ ID NO: 8256 - DNA, 579 bp, Homo sapiens
  misc_feature (213)..(213): n equals a,t,g, or c
ttttttttttattattatactttaagttttagggtacatgtgcacaacgtgcaggtttgttacatatgcatacatacgccatgttggtgtgctgcacccattaactcgtcatttacattaggtatttctcctaatgctttccctccccccctccccctaccccacgacaggccccagtgtgtgattttccccttcctgtgtccaagtgttctncattgttcagttcccacctatgagtgagaacatgcggtgtttggtttattttacttgcgatagtttgctgagaatgatggtttccagcttcacccatgtccctgcaaaggacatgaactcatccttttttatggctgcatagtattccatggtgtatatgtgccacatttgcttaatccagtctatcactgatgggcatttgggttggttctaagtctttgctattgtgaatagtgccgcattaaacataggtgtgcatgtgtctttatagcagcatgatttataatcctttgggtatatacccagtaatgggatggctgagtcaaatggtatttctagttctagatccctgaggaatcgccacac

SEQ ID NO: 8257 - DNA, 6609 bp, Homo sapiens
cgtgaccaggatccaattgtagttgtgaactgcttgaggtctctagaggaaattctgaaacaggaaggaggcgttgtcatcaataagcccattgctcaccatctcttaaatcggtttggatgcctcagcactctttttattatgagatctgctaccttgtgggatcttgttgatgtattaaagtattgaacaacttatgtggggtagaaaagaaagttaaccattattattattattatttgagacggagttttgctcttgttgtctaagctggagtgcaatggcgctatctcggcttaccgcaacctccgcctcctgggttcaagcaattctcctgcctcagcctcccgagtagctgggattataggcatgcgccaccatgcccggctaattttgtatttttagtagagacagggtttcaccatgttggtcaggctggtcccaaacttctgacctcaggtgatccgcccgcctcagcctcccaaagtgctgggattacagacgtgagccactgcgcccggccagttaaccactattaactccctcacattccactgagagaatttcttttatttgccttactttcccttattgatatagggaaatagaaatatactgtgggaataggttctacccttctctagtcatgtcccccaaactaagccatttatagtgtcttaaaatgtaaggaacctggacccagtgtatgctgatcatgtctttggtcttagaggagtgtgcatttgtattaacaactcatcttggaattttaagccttttttgtgtaaactttaaatagtacatgaaaagtgacttaattatggcacagcctatttttaagaattctccctttgctatgatgaacaaccacctggtcatatggcagtggcatggaaatggtcctaattttgttgctaaaatagctcttttgttttgttttttggatagaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtaggtgtctgctccttttccttcttgagaacctagaccagccagcaagaaaactgtggttagaggaaccatagagagcaaagggcatgaatcttgcttcagaagcaaagtactatgcactaaataattgggtcagtgactacaaacacgggggaagagagtttttttttgttttttgtttttttttggtcaagattggtgttgctgtatcttccaggatggagaatacaggtaacacaaactacaatacttaaaattgttgttgtcttctatccaaaatgctttcctatacatcatcttaccacagtatcgtgagacagtcaggaaaagtagacaaatgtcattaacttcattttaaagatgaagaaactcaggcacaaaaacagttatcaaattgccaaaagggcacatagttttagaaatgggactgaaatccagctttcctgactcaaagtcctatgttaatccaccagtcatttattgagcttctgctatgggctatgtattgtgctgaatgtagaccaacacagaataattcctaaatcttacagactttttcatagtaccctgtctggaatttgaaaggctggagtgactcaaaaactgaaaacagctgttgagccaagttttgaaggatttcaagtacaggaggaggagcaaccctcatatttggaataaagcatggttattttaggggcagagaagagggagcaaagaggagacaagaaatccttaggagactgctgtcaagtgtcccccacaaaaatactccattgcaggtgtgctgcaacaaaaagggtacctcatatctggctgccatgtaaatacctttgttactataagttttcaaccttgtttaatggggaattgttttgctatgagctttcagttttctagtagtcagtgagaaaaaatgatttttaccaaagttccctttatagtaaacttatattcttagttcatcaagtaaggagtgaatttttttcttttttttttttttagataattctgtttcttttgtctttcactggtgggagatgattttagattgaggtgctaatatttcacttagcagttttctctgctttcccttcttttgtaggtggcattgccaggacttacacagatcaatgtgttcagattttaacagagttgctgggtcttcgacaagagcacattaccacaggtaatgcctgcctttttaggatttttgttttttttgtcaggtgcctggcctatagtagttgctcaaaacatgtttgttgttgaatgagtaatatagagatttgaacttttccttgcatcatcatctgttgctgttagagaagcataaagtctatagatctaataggatattgagtcttcaggctgccatgatctataaggctgtactatagataatgaaggctactaggatgaccttgcttgatatttcaccatctttacttctctttttgttttatggcagtatgccataggcagtggcttccagggttgggacaagggtaagtcaagcaagatgcctaggatgcaaaatttaagaaggcactcactcttaggttcctgcaagagccaatcctgcatgtcttcttcaattttgaaccctaggcacctcacttgtgttatcattttcccaggcctggtggttctatttatactgtctttagtgtttcattcaacagcaatactaccccacatttgcatacagctttatgttttacaaagtgctttttcatacattagttcatttatcctcatgtcaatctgataagagcaatatgcattcaagaaattattgcttatttcattacatttcttagataaccattgaccacacctccaaaacccattttacagaaatccagccagaatcatgagtctgaatacatgactgttcttaagattcctgcctacctggaggctctaatcctgtgctcttgtaccctggcctgtattgtagtggtggtgcagactttccgagacctggtttggttgtgtcctcagtgtactgaagctgtatgtcaggccctgcccggctgtgaagagaacattcaagatagtgaggtagactgtaattctcctttacttctaggtagggggagaatgcttgaaaccctgccctttgaaatggaatctaattattctctctaccctgtgtttgaagtgggcactcttcgaattgattgccaccttagattctcttttggatatagatggcatataaattataaaaacaagatttatccgacgggttttattacaaaactctgataccattgttctcttgaacagttctgttttgttttgttttgctttgcttgagatagagttgcccaggctggagtgcagtggcgtgatctcggcccactgcaacctctacctcccaaactcaagtgattctcttgcctcagcctcctgagtagagtagctgtgattacaggtgtgcaccaccacgcccagctaatttttgtatttttagtagagagggttttgctatgttgtctaggctggtctagaattcctagcctcaagtgatcacccacctcagcatcccagagagctaggattacaggcataagccactgtgccccgcttctcttgaacagttttgagtcagagatttagaccatggagtttttagctagaatgaaaattataatcatttgtgaaatttttacaaagatttggacgtaatcacaggtctactgacttaaatattcaggggtgttggacctagacagataactttttttttttttttttttttttgaaacagagtctagctctgttgcccaggctggagtgcagtaatgccatcttagctcactgcaacttccgcctcctggtttcaagcaattctcctgcctcaggctcccgagtagctggaactacaggtgtgcaccaccacgcctggctaatttttgtatttttaatagagacgggtttcaccatattggccaggctggtctcgaactcctgacctcaggtgatccaccctcctcggcctcccagagtgctgggattacagacgtaagccaccgtgcccggctgacagatacatttttaagaagcttcacagatgactctgatgtgcactctaggttagtaaccatttttgtgaaaaatttagagaaattctttgagcagcttccactgaaacactaaaacccaatagggccaaaggccccaaacctgaggaaaccttatttattgcttaatccaacataggctatgaaagttttgagtttcctcttgtgtattagaatttcattcctatttgttgtagagagtatagtacggggaatcagtaaattaaatgaagtaaactaaagattacaccttttctgctggcactaagcgaaaagcaaaaccagtggctgtctattatctcctgtgttttagacagtcaagtgttgagcacttgctcttattcctttattctctaggggaagcaagcacttatttggctacttggtgtccatggggaaagaattcctaatgctccttatgtgttagaggactttgttgagaatgtgaagtcggaaacatttccagctgttaagatggagctgctcactgcttcgctgcgccttttcctctcccgacctgctgagtgccaggacatgctaggacgtttgttgtattactgcataggtgggtttttcagaaggaaatagtatttgccatgacccatagtaaaaattcttaatagctttcattgtttggtgagtcacgtctgggacccgagaagaaaatgtgaatgcttcctaggttttcctctctccttcatttttttctcctattatggttggcacaagagtaggaggaaagtggttttgtttttaatgaagtcaatctgttgtcttacctcagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggtaaaaacagtccttaccttaaatcttgtcatgataaatctttaccttttcaatgattggtggaaagtagagtatcttagcactaaacctcagactgttgcctgaatttgaagcatttgtgagcaagaaagaggttcgtcactggttatttcagccatttgtccaaaaataaaagtcacattgtgtacatttgggaatttggataaaaaacttagctcctacagattaagaacatctttcacacaagttttctgtctcttttaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagagtcttgttgcttgtctagagtaagatgaataactattacactttcttagtctttcctattagagctgccagtaagtccagataatatcagatacaaaggagagtggaaaatctagaaatcaggattcttaagtttttggccaaagaacattgattcattcctttcattcctattggcaattgaccccatttttcagtgatgatgttgtagaggttaatgttggtaaggagatgcgttgaggatgggatttggattatttcctaatcaattttaggaattgtgttagtaattaaagatggctgatgtgtggaaa

SEQ ID NO: 8258 - DNA, 10049 bp, Homo sapiens
caggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtatcacctacctcccttcgcgtgctaactgctccctttgcaatccccatcagggctcactagccccagtctctctgaaagggtgaattagctttcacacgtggcagttatatggttcggtcttcgtcctgctgctttggagtaccatgtcagtctcccctctgcagcatcttttactcagctgggtagtttcctccatatcacgggcttgagcaattactggtgactcttggatctataatatagctagtacagacttccttttttagcttcagacccacgtatcccactgcctgcttggcatttccacgtgcgtggtttatcaaaagtatgtccgaaatagcccggacattcttccgtcttcctcaaacctgttcagcttacatttgtgttgatgaatgccaccagcagccgactatgcgtgggagccaaccttgaggacacctgatctctcacttcttatgtcagatggtttgaattcataattctaaatatccatcctctcttgtttattagcattgttgttctggtccaggccttcatcaataaagcaattgcagcagcttactagtaggccactttgcctcatttgagacagaatttttccattatacatacctgaacacataactcttgcctacagctatggttcacaaactttactatgcataaaaatcccttggggtgctttttgtcatccagtccagggactgattctgatttcagtagggtgggagggaacccaggaatctgtatttttaataaacatttcagttggttccagtaggagaccagtctgagaaacaataaagtccaaacttatcacagcacccaaggaacaagctgttaattcaactacctacagactcttaaaaaaatgtgtgctgctcctgctcatgtctacttacctcatagcatgtatctttaccttgctattacatctgcctagtgagctcctgctcattcagctaaagtattacttcctctgtgaagaaacattttctgacttcctgccagtgtcagacctctgaatcccctctacaccttgtacaatacttctgtttaagtacttatctatcatactgtaattaacggtattctcatctggctcattaatagatttgaagttcctagaggtttgagaccacaccttcttcaagattatgtcccaagagcatgtccctggatgtaaaagttgaatttcaccaaagtactagggattcaataagtgtttgttgaggctgggtgcggtggctcacgctggtaatcccagcactttgggaggccaaggcgggtggatcacctgcagtcaggagttcgagaccagcctggccaacatggagaaaccccgtctctactaaaaatacaaaaattagctgggcgtggtggcacgcacctgtagtcccagctactcgggaggctgaggcaggagaatcgcttgaacctgggaagcggagcttataatgagccgagattgtgccactgcactctagcctgggtaacagagcaagactctgtctcaaaaataataataagtgtttgttgaatgaatagaagaataatgtttattgtaggcctatggtatgaagtactgtgtgatataatagacaaggtaatcctggctgctaccctctaagagatcacaatctagttgggtaatcaggagatatgtaagtaaaactccctccattgtaagttggggattttgcattttacttccttctgtcatgtgcgttgttcaggtacatgactcaaggcttggacatgtctggtgtttttatggaaatggtgaaggccagtgccactgtagatattgtccagaagaagttggtttatctgtacatgtgcacatatgctcccctgaaaccagatctggctctcctggccatcaatacgctgtgcaaagactgctcagaccccaatccaatggtgcgagggctggcgttacggagcatgtgtagcctcaggtgagtaccctcttctctgtctggtcctaaatggctgatgaattcaagtgatcacagggtaggtttttaaagaggataatttatttgagctccttaatactggggaaaacattattgtaccctgaactcagattttcagccactgctttggcttaataacctgtatcatataattttattagagggagtttttgattctcactctaagtaaaatagtcctcagttttggttaaatatctctaaacaattatgtgtatatctttttttgctgcctgtgcatcattattccaaatgaaaagtcaaattaggctgggcacagtggctcatgcctgtagacccagcactttgggaggcttagacaggaagattgcttgagcccaggaatttgagaccagctgggcaagatggtgagagcctatatctacaaaaaattaaatgggcatggtgacacgcacctgtagtctcagctactaggaaggctgaggcaggaggatggcttgggcccgggaattcaaggcagcagtgagctatgatcgggccactgggtgacaaagtgagaccccatcttgaaaaaaacaagaaaaaaacagaaaagtcaaattatggctttttaagcttgatagaggctttctgcaattcttcatgatctgatgggtgcagcatctactaaaccatctgttaggtgaacaggggctgaggtatgtcaaaattagtatttcagaatctggctaactccaggatgtgttgcttaggatgcctggtgtgcaggagtatatacaacagcctattctcaatggtctgcgggataaggcttcatatgtcaggagagtggcagtccttggatgtgccaagatgcataatcttcatggagactctgaagtaggtaagttcagtgtaatccatcatggtcaatgtgcctccattatgtataactttaaaaaagattgtgtggctttggtagaaaataataatgtggccccagttctgtacatatctctttaagtaggatgcagggcttggtatcttctggagatgagaagtcctttctctggggccccaatgagatcctttgtattagctgcttagaacagtctggacatggcagttttttttttgccttgcactttagtgtggcctttgtcatttttgtagcagagaagttcaactttgtctacctggagctattactctggctacatccttgttactctgaagctttccttctttatctaagaactttgttcttttttatagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcggtttggatgcctcagcactctttttattatgagatctgctaccttgtgggatcttgttgatgtattaaagtattgaacaacttatgtggggtagaaaagaaagttaaccattattattattattatttgagacggagttttgctcttgttgtctaagctggagtgcaatggcgctatctcggcttaccgcaacctccgcctcctgggttcaagcaattctcctgcctcagcctcccgagtagctgggattataggcatgcgccaccatgcccggctaattttgtatttttagtagagacagggtttcaccatgttggtcaggctggtcccaaacttctgacctcaggtgatccgcccgcctcagcctcccaaagtgctgggattacagacgtgagccactgcgcccggccagttaaccactattaactccctcacattccactgagagaatttcttttatttgccttactttcccttattgatatagggaaatagaaatatactgtgggaataggttctacccttctctagtcatgtcccccaaactaagccatttatagtgtcttaaaatgtaaggaacctggacccagtgtatgctgatcatgtctttggtcttagaggagtgtgcatttgtattaacaactcatcttggaattttaagccttttttgtgtaaactttaaatagtacatgaaaagtgacttaattatggcacagcctatttttaagaattctccctttgctatgatgaacaaccacctggtcatatggcagtggcatggaaatggtcctaattttgttgctaaaatagctcttttgttttgttttttggatagaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtaggtgtctgctccttttccttcttgagaacctagaccagccagcaagaaaactgtggttagaggaaccatagagagcaaagggcatgaatcttgcttcagaagcaaagtactatgcactaaataattgggtcagtgactacaaacacgggggaagagagtttttttttgttttttgtttttttttggtcaagattggtgttgctgtatcttccaggatggagaatacaggtaacacaaactacaatacttaaaattgttgttgtcttctatccaaaatgctttcctatacatcatcttaccacagtatcgtgagacagtcaggaaaagtagacaaatgtcattaacttcattttaaagatgaagaaactcaggcacaaaaacagttatcaaattgccaaaagggcacatagttttagaaatgggactgaaatccagctttcctgactcaaagtcctatgttaatccaccagtcatttattgagcttctgctatgggctatgtattgtgctgaatgtagaccaacacagaataattcctaaatcttacagactttttcatagtaccctgtctggaatttgaaaggctggagtgactcaaaaactgaaaacagctgttgagccaagttttgaaggatttcaagtacaggaggaggagcaaccctcatatttggaataaagcatggttattttaggggcagagaagagggagcaaagaggagacaagaaatccttaggagactgctgtcaagtgtcccccacaaaaatactccattgcaggtgtgctgcaacaaaaagggtacctcatatctggctgccatgtaaatacctttgttactataagttttcaaccttgtttaatggggaattgttttgctatgagctttcagttttctagtagtcagtgagaaaaaatgatttttaccaaagttccctttatagtaaacttatattcttagttcatcaagtaaggagtgaatttttttcttttttttttttttagataattctgtttcttttgtctttcactggtgggagatgattttagattgaggtgctaatatttcacttagcagttttctctgctttcccttcttttgtaggtggcattgccaggacttacacagatcaatgtgttcagattttaacagagttgctgggtcttcgacaagagcacattaccacaggtaatgcctgcctttttaggatttttgttttttttgtcaggtgcctggcctatagtagttgctcaaaacatgtttgttgttgaatgagtaatatagagatttgaacttttccttgcatcatcatctgttgctgttagagaagcataaagtctatagatctaataggatattgagtcttcaggctgccatgatctataaggctgtactatagataatgaaggctactaggatgaccttgcttgatatttcaccatctttacttctctttttgttttatggcagtatgccataggcagtggcttccagggttgggacaagggtaagtcaagcaagatgcctaggatgcaaaatttaagaaggcactcactcttaggttcctgcaagagccaatcctgcatgtcttcttcaattttgaaccctaggcacctcacttgtgttatcattttcccaggcctggtggttctatttatactgtctttagtgtttcattcaacagcaatactaccccacatttgcatacagctttatgttttacaaagtgctttttcatacattagttcatttatcctcatgtcaatctgataagagcaatatgcattcaagaaattattgcttatttcattacatttcttagataaccattgaccacacctccaaaacccattttacagaaatccagccagaatcatgagtctgaatacatgactgttcttaagattcctgcctacctggaggctctaatcctgtgctcttgtaccctggcctgtattgtagtggtggtgcagactttccgagacctggtttggttgtgtcctcagtgtactgaagctgtatgtcaggccctgcccggctgtgaagagaacattcaagatagtgaggtagactgtaattctcctttacttctaggtagggggagaatgcttgaaaccctgccctttgaaatggaatctaattattctctctaccctgtgtttgaagtgggcactcttcgaattgattgccaccttagattctcttttggatatagatggcatataaattataaaaacaagatttatccgacgggttttattacaaaactgtgataccattgttctcttgaacagttctgttttgttttgttttgctttgcttgagatagagttgcccaggctggagtgcagtggcgtgatctcggcccactgcaacctctacctcccaaactcaagtgattctcttgcctcagcctcctgagtagagtagctgtgattacaggtgtgcaccaccacgcccagctaatttttgtatttttagtagagagggttttgctatgttgtctaggctggtctagaattcctagcctcaagtgatcacccacctcagcatcccagagagctaggattacaggcataagccactgtgccccgcttctcttgaacagttttgagtcagagatttagaccatggagtttttagctagaatgaaaattataatcatttgtgaaatttttacaaagatttggacgtaatcacaggtctactgacttaaatattcaggggtgttggacctagacagataactttttttttttttttgaaacagagtctagctctgttgcccaggctggagtgcagtaatgccatcttagctcactgcaacttccgcctcctggtttcaagcaattctcctgcctcaggctcccgagtagctggaactacaggtgtgcaccaccacgcctggctaatttttgtatttttaatagagacgggtttcaccatattggccaggctggtctcgaactcctgacctcaggtgatccaccctcctcggcctcccaaagtgctgggattacagacgtaagccaccgtgcccggctgacagatacatttttaagaagcttcacagatgactctgatgtgcactctaggttagtaaccatttttgtgaaaaatttagagaaattctttgagcagcttccactgaaacactaaaacccaatagggccaaaggccccaaacctgaggaaaccttatttattgcttaatccaacataggctatgaaagttttgagtttcctcttgtgtattagaatttcattcctatttgttgtagagagtatagtacggggaatcagtaaattaaatgaagtaaactaaagattacaccttttctgctggcactaagcgaaaagcaaaaccagtggctgtctattatctcctgtgttttagacagtcaagtgttgagcacttgctcttattcctttattctctaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcataggtgggtttttcagaaggaaatagtatttgccatgacccatagtaaaaattcttaatagctttcattgtttggtgagtcacgtctgggacccgagaagaaaatgtgaatgcttcctaggttttcctctctccttcatttttttctcctattatggttggcacaagagtaggaggaaagtggttttgtttttaatgaagtcaatctgttgtcttacctcagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggtaaaaacagtccttaccttaaatcttgtcatgataaatctttaccttttcaatgattggtggaaagtagagtatcttagcactaaacctcagactgttgcctgaatttgaagcatttgtgagcaagaaagaggttcgtcactggttatttcagccatttgtccaaaaataaaagtcacattgtgtacatttgggaatttggataaaaaacttagctcctacagattaagaacatctttcacacaagttttctgtctcttttaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagagtcttgttgcttgtctagagtaagatgaataactattacactttcttagtctttcctattagagctgccagtaagtccagataatatcagatacaaaggagagtggaaaatctagaaatcaggattcttaagtttttggccaaagaacattgattcattcctttcattcctattggcaattgaccccatttttcagtgatgatgttgtagaggttaatgttggtaaggagatgcgttgaggatgggatttggattatttcctaatcaattttaggaattgtgttagtaattaaagatggctgatgtgtggaaa

SEQ ID NO: 8259 - DNA, 2780 bp, Homo sapiens
cagcttcttgtcggaaggaaagaccagggctggattgcaattggtgttgtctaggtataaagtatggatctgtttccccagtgtcagggctggctcctttagcatggatggtgtgtatcgaaaatcacctggaggaatatgtacatgggggcagaaggtcagagacaaaagaatagaagacaagcctctcctacctccaacaatagacaggcgtttgcttactagtctgtgaaaaaactattatgtagcctggcactgaactaggcagtatagctgcatggtttctttgttgtaatgtctccatcctactcctatttttcaattactcttcacaaggttcggacccttaaagagtgggaaatcggccaggcgcagtggctcacacctgtaatcccagcactttggggggccgagccaggtggatcacctgaggtcaggagttcgagaccagcctggccaacatggtgaaaccccgtctctactaatagtaaatacgaaaattagctgggcgtggtggcaggcgcctgtcatcccagctacttgggaggctgaggcaagagaatcacttgaacccagaaggcggaggttgcagtgagccacaatcacgccactgcactccagcctgggtgacaagagtgaaactccgtctcaaaaagaagaaggaaaaaaaaacagtgggaaatcagttgagatggggtcactatgctcatatgtgatgaagttagaaggcctccagcgcctccagacttctattgagttaaggctgctcaagaaaagtctgccaggtgtggtggcttgtgccaataatcctagctactgtggaggctgaagcgggaggattgcttgaggtcaggagtttgagaccagcctcggcaacactgcgaggccccagtctatacattaaaaaaaaaaaaaaaaaaaaaaaaaaaaaacatctagtctggagaagtcactgggattccttgagaggcccacctgtgtagaggatggttccaaaatatccttcaaagagaaacatgacagaaccaggacagtgattggcatcgaggagggttacggtcatggtctcttgtccaatttcatctaggggtaatacatggctctcaccaacctccagggcttggatccattgcttagatacctgagaaaacagttagtcatcccagtgaccactgactcctctccgttacctccccgggtcagggactatcccttacatgaatcaggaaagctgaccaaatcctgagccaccgggagcagaagctgtaatggggattcccaagcaatctgcccttcctccttccacttcccatcccaccctttgtacaatttaagagttcagctggccgggcgtggtggctcacgcctgtaatcccagcactttgggaggctgaggcgggtggatcacgaggtcaggagatcgagaccatcctggctaacacggtgaaaccccgtctctactaaaaaatacaaaaaaaattagccaggcgtggtggcgggcgcctgtagtcccagctactcgggaggctgaggcaggagaatggcgtgaacccgggaggcggagcttgcagtgagccgagtttgcgccactgcactccagcctgggcgacagagcgagactccatctcaaaaaaaaaaaaagagttcagcaaacagtctagtcagcaattcccaaacttactcctgatcttaatctcttggagacttaagggtggggtggggagagagctggagaaccacccagcacattaggtggattcttaagatgaggcaagtttaggcggggcgtggtggctcacgcttgtaatcccagcacttggggaggctgaggcgggcggatcacttaaggtcaggagttagagaacagcctggccaacatggtgaaaccccgtctccacaaaaaatacaaaaaattagctgggcgtggtggcgtgcgcctgtaatctcagctactcaggaggccgagacaggagaatcgcttgaacccgggaggcggaggctgcagtgagccgagattgcgccactgcactccagcctgggcaacagagcgagactccgtctcaaaaaaaaaaaaaaaaaaaaaaaaaaaaggcaagtttgggaaacatcggcctagcttacttataaaggtaggaatagtttccttggctggattaaaatatctcctcaacttatggctaactatctcaagttggtcacttcgaaaacacgttcctattctgggttaaagatgcatttttgggttcaaacaacttccaaatcagttttcgtggcccccattctatgactccaagaatgacaggttgaagtcccaacccagatgcctggaccagctctcggagaccgactccagccccatacctgtaggtgacgatgcaagaggtgggctgtaattggggagcagtagaggggccgggcccaggtgctagacaggcccacggtgtggtccgagtgcatgtgagacaagaagaagagacgtgcggtgccagcccggcgcaggctccagaagtccactgcgatgggcgtatgggggatcaggaccccattcatggtggtagggttggagtcaccagtgggatcttctccacgggggcagggctcctgcgtgaggcttccacaacggcgtcccgataaaagtcatgctggggcaagaacagggccagagaccctaagggaaagagcccagcagagcaataagttaccagagtgggcagaaaaaggaagtcaccctgcccgctggagcccaaatcgcggagggcgctggacactcccaaccgcgc

SEQ ID NO: 8260 - DNA, 179 bp, Homo sapiens
ctcatgagtgttgatgctcagtacattttaaaagagctagtgcaagcttgcatttaacgtctatcatgatgttcctcttgatatttgtgtggtacctccagccttatccttaacattcctttacacagccctcatggaataaacagcacaaaacagcaacgacaacagcaaaaaaaaaa

SEQ ID NO: 8261 - DNA, 179 bp, Homo sapiens; identical to SEQ ID NO: 8260

SEQ ID NO: 8262 - DNA, 179 bp, Homo sapiens; identical to SEQ ID NO: 8260

SEQ ID NO: 8263 - DNA, 365 bp, Homo sapiens
tttgtaatttcaattaggggacttacaggtttgggaagactattttagacagacagatggacatgagtaaagccatagaggtaaaaagcccaatgcatatgtgcatgatatgtgataaataatttggatttcagaaaccatagattttggctaaaatctataaaaccatagattttggataaaatctataaaaccatagattttggctaaaatctataaaaccatagattttggctaaaatctataaaaccatagattttggctaaaatctataaaaccatagattttggctaaaatctataaaaccatagattttggctaaaatctataaaaccatagattttggctaaaatctataaaaccat

SEQ ID NO: 8264 - DNA, 365 bp, Homo sapiens
tttgtaatttcaattaggggacttacaggtttgggaagactattttagacagacagatggacatgagtaaagccatagaggtaaaaagcccaatgcatatgtgcatgatatgtgataaataatttggatttcagaaaccatagattttggctaaaatctataaaaccatagattttggataaaatctataaaaccatagattttggataaaatctataaaaccatagattttggctaaaatctataaaaccatagattttggctaaaatctataaaaccatagattttggctaaaatctataaaaccatagattttggataaaatctataaaaccatagattttggataaaatctataaaaccat

SEQ ID NO: 8265 - DNA, 1254 bp, Homo sapiens
ggaaaaaaacagaaattgaagatctgccaactgccatgcctagcataataaaaatgggcttccttccccccacaccccccatagggtctcgctctgtcacccgggctggagggcagtgatgcagctgtggcttaaaagcgggcttctcttgtccttcatcctcattcttccttgagcttgctcagggcttcctgctccacgtggggcctcacaacacgctgtgtgtggtgcccagtgagtactgtgcactcagaacaaccatgtagtgtctagcaactcagagttgtgtgctgtttttgatcctttactaaggatcattttattaaaatgatcatctttgagtttacaaagtatttaaatatagtgaatgtacaaagttggtaccaagttacctttatttcagaaagaagcatagactttctttaatatggaaaaatctgcctctttaaaatatttggtgctagggcaaacaccattgtcatcagtggaataaaggaggaggcccacgtatgtctcgggtcaggcagtgccccaggaggacgctccgcccccaggaggacgctccgcccccaggaggactctccccactgggctgataccaggcttcgtgagggtcggagccttgtgctgttgtccagtgtccccagcaccgagcgagtttgagtccatcagtcagtggatgccattttgaaggtgcagtctggtttcatggttagctgccataacatatgccaagtatcctgctcacatttacgtctctgaacaaatacgcatcagtctggtttcatggttagctgccgtaacatatgccaagtatcctgctcagatttatgtctctgaacaaatatgcattctgctttgttgtgagttccagacaagcactttaaccaaattggcaggcagtagagatagggaaggagtaattgaaaagtattagaaaataaaatgatccaggccaggtgcggtggctcatgcctgttaattccagcagtttgaaaggcccaggtgggtggatcccttgaggttaggatttcaagaccaccttggccaacatggtgaaaccccatctctactaaaaatacaaaaattaattagcgtagtggcacacacctgtaatcccagctactcggaaggctgaggcaggagaatcacctgaacccagatagcggccgttgcagtgagtcatcattgcaccactgtactccagcctcggcaacagagcgagactccatctcaaaaaaaaagaaaagaaaa

SEQ ID NO: 8266 - DNA, 1250 bp, Homo sapiens
ggaaaaaaacagaaattgaagatctgccaactgccatgcctagcataataaaaatgggcttccttccccccacatcccccatagggtctcgctctgtcacccgggctggagggcagtgatgcagctgtggcttaaaagtgggcttctcttttcatcctcattcttccttgagcttgctcagggcttcctgctccacgtggggcctcacaacacgctgtgtgtggtgcccagtgagtactgtgcactcagaacaaccatgtagtgtctagcaactcagagttgtgtgctgtttttgatcctttactaaggatcattttattaaaatgatcatctttgagtttacaaagtatttaaatatagtgaatgtacaaagttggtaccaagttacctttatttcagaaagaagcatagactttctttaatatggaaaaatctgcctctttaaaatatttggtgctagggcaaacaccattgtcatcagtggaataaaggaggaggcccacgtatgtctcgggtcaggcagtgccccaggaggacgctccgcccccaggaggacgctccgcccccaggaggactctccccactgggctgataccaggcttcgtgagggtcggagccttgtgctgttgtccagtgtccccagcaccgagcgagtttgagtccatcagtcagtggatgccattttgaaggtgcagtctggtttcatggttagctgccataacatatgccaagtatcctgctcacatttacgtctctgaacaaatacgcatcagtctggtttcatggttagctgccgtaacatatgccaagtatcctgctcagatttatgtctctgaacaaatatgcattctgctttgttgtgagttccagacaagcactttaaccaaattggcaggcagtagagatagggaaggagtaattgaaaagtattagaaaataaaatgatccaggccaggtgcggtggctcatgcctgttaattccagcagtttgaaaggcccaggtgggtggatcccttgaggttaggatttcaagaccaccttggccaacatggtgaaaccccatctctactaaaaatacaaaaattaattcgcgtagtggcacacacctgtaatcccagctactcggaaggctgaggcaggagaatcacctgaacccagatagcggccgttgcagtgagtcatcattgcaccactgtactccagcctcggcaacagagcgagactccatctcaaaaaaaaagaaaagaaaa

SEQ ID NO: 8267 - DNA, 371 bp, Homo sapiens
gtagagagtaattctcaatgagaggaatctgtaggtattggctttaacaccaggacaataaatattggaagaaacttatcccagattccttttgttactattttgcttatctgcttagacattccctttctagcatttatcaaacttaccaacaaacattgtcaggtaggagtgtgacatcctacctccaagagccaagggttgggttcaggtcctacactaacccatggaaaaagtatttgacatttcatgtttatattaaaaacaggtgcaaatcttgcctttagcattatgtttgtttcatattaatatttgaaatgacttaatcattgagtaaaattgaggccccaaacagatacactgtttctagt

SEQ ID NO: 8268 - DNA, 816 bp, Homo sapiens
agaagatacaaataaatagaaaaacattctaccttaatggattagaagacttaatattgttaagatgttactactacctaaagcaatcccagatttaatgcagtccctataatcatgaatccgataagcagtcatcatccaggatatatagagaactcctgaaattcaacaacagaacaaccaaacagccctattcaaaaatgtggaaagaacttgaacagacatttctccagggatgatacagaaatggctaggaagcacatggaaagatactgaccatcactaaccattaggaaaatgcaaatctagaccgtaatgaaataccacctaacacctattagaaaggctactgtcaaaagaaacccagaaaataacaggtgttggtgagatgtggagaaattggaacctttgtgcactgttggtagaaatgtgaaatggtacagctgctgtggaaacagttcctcaaaaccttaaacataaaattaccatgtgatccagaaatcccgcctctgtgtacatacccgaaagaattgaaagccgggacttgagcagatatttgcacacccacattcttagcagcattttttacaatagctacaaggcggaagcagcccaaggatgcgtgggccgatgaatggataagcagaatgtggcctgtacaccttagaaacacgggactcctgctccaggccgccacatgctggaccttgaggaccttatgctgaaggaaacaagccagacacaaagggacagcgtctgcataattgcacttgtgtgaggtttctgggggagtcaaactcatagacagaagcggaa

SEQ ID NO: 8269 - DNA, 371 bp, Homo sapiens; identical to SEQ ID NO: 8267

SEQ ID NO: 8270 - DNA, 1325 bp, Homo sapiens
cagtgctaagtccactgctaataacagaaacagttaaagctgattgtgtgcttctacgtgccaggtccttactaggcatgtcaccttcactcactctaacttcacaacgtctctataagatagccagttattttgtgcacatttagcaacaagaacactgaggttctgggagattacgcaatttactctcatgataaaacttatatgtggcatagctaggatttgaacccaggtctctctgacattagcacttgtttggggttttgtttgtaccatgctgcttctcttggtttccttctgctaacttaagaatgcaaggaacctataatccaaaaccatactctaaacattaaatctcataacttgtaacttatgtcaccgatttggtgagcaaacagaattaagtagtccagggccaacagcagaatcttcagggacagaaaccagataactccaattaggtgggctaaacggataaattccacatcaaaggaacctttactaggaaaatatccggtgaccttcagcctctgataagacttcatctcatcatttctcctgtcccaacacccctacacttcaactagcttcaaatattctgtatccacaccaaagactgattcaacactttgcaatcacaaacccaaaggcaagttctctgggattgcatcagtatgaagattttattttgcaaagttacttccctgaccagcctccctgctgcagacctcttcaaatttcccagattaagaagacattcgaagtgacaattccaggccttatcatgttcaacaaactggtcacaatgtgtcagatgaagggcaagatcaattctctgggcctcttgcttctacatctcttatagaaagttaccatcatcaaaatctttcgcatcactcaaatcatcaacaatagttagaagaacaataacacacacaaaaaaattagtagcaaagataagccagtacaagtaagtgtgacacagtccaaaccaacctgggcacattctcacaatcccttggaaatgactttacctgaaggctacgtgactcatttaactcggcactaagatggaaaggtctagggctctacagaagttcctagtaggaaaacttcattcttttccaagccaggtctccagggcctggctctgacatggttaccacttccacggagaagctgacaacagctggtcacattcttttctctaccctattcctccccatcaggtgaagatagctaactgccatgtatcttatctaaggaggctaacttgcagcaatgatgtggcatgacaagtgaaaagtaatggggatcttgaacag

SEQ ID NO: 8271 - DNA, 1325 bp, Homo sapiens; identical to SEQ ID NO: 8270

SEQ ID NO: 8272 - DNA, 1325 bp, Homo sapiens
cagtgctaagtccactgctaataacagaaacagttaaagctgattgtgtgcttctacgtgccaggtccttactaggcatgtcaccttcactcactctaacttcacaacgtctctataagatagccagttattttgtgcacatttagcaacaagaacactgaggttctgggagattacgcaatttactctcatgataaaacttatatgtggcatagctaggatttgaacccaggtctctctgacattagcacttgtttggggttttgtttgtaccatgctgcttctcttggtttccttctgctaacttaagaatgcaaggagcctataatccaaaaccatactctaaacattaaatctcataacttgtaacttatgtcaccgatttggtgagcaaacagaattaagtagtccagggccaacagcagaatcttcagggacagaaaccagataactccaattaggtgggctaaacggataaattccacatcaaaggaacctttactaggaaaatatccggtgaccttcagcctctgataagacttcatctcatcatttctcctgtcccaacacccctacacttcaactagcttcaaatattctgtatccacaccaaagactgattcaacactttgcaatcacaaacccaaaggcaagttctctgggattgcatcagtatgaagattttattttgcaaagttacttccctgaccagcctccctgctgcagacctcttcaaatttcccagattaagaagacattcgaagtgacaattccaggccttatcatgttcaacaaactggtcacaatgtgtcagatgaagggcaagatcaattctctgggcctcttgcttctacatctcttatagaaagttaccatcatcaaaatctttcgcatcactcaaatcatcaacaatagttagaagaacaataacacacacaaaaaaattagtagcaaagataagccagtacaagtaagtgtgacacagtccaaaccaacctgggcacattctcacaatcccttggaaatgactttacctgaagtctacgtgactcatttaactcggcactaagatggaaaggtctagggctctacagaagttcctagtaggaaaacttcattcttttccaagccaggtctccagggcctggctctgacatggttaccacttccacggagaagctgacaacagctggtcacattcttttctctaccctattcctccccatcaggtgaagatagctaactgccatgtatcttatctaaggaggctaacttgcagcaatgatgtggcatgacaagtgaaaagtaatggggatcttgaacag

SEQ ID NO: 8273 - DNA, 397 bp, Homo sapiens
ccctagatgtgaatccattctcacatatataattactatattcaagtgtttaataaacatttagtaatgcttttaagtcaccagtatcttcacagaaatgaccatattgttgcccatctattagaagagatggtgttcaaggtatgaagtagtagaaggttcgtgatcatgaacccctgggcaagtcaagatcctcaattgccacctctataggtggaagtataggcctaacaatactaaggattaaaagtgaaatgctgctggcgcagccctgggctcacagaagcagcaaaacaagcactaaagccctcctcccgcccacggttctgctcaataaataacaagtgctgttaattctttaattgtggatccgaggaaaatgaaacagggttcaccc

SEQ ID NO: 8274 - DNA, 205 bp, Homo sapiens
ccagcactttgggaggccgaggcagttggatcacctgaggtcagaagtttgagaccagcctggccaacctggtgaaaccccgtctctactaaaaatacaaaaattagctgggcgtggtggcgggcgcctgtaatcccagctactcgggaggctgaggcaggagaatcacttgaacctgggaggcagaggttgcagtgagctgaga

SEQ ID NO: 8275 - DNA, 217 bp, Homo sapiens
acacctgtaatcccagcactttgggaggccgaggcagttggatcacctgaggtcagaagtttgagaccagcctggccaacctggtgaaaccccgtctctactaaaaatacaaaaattagctgggcgtggtggcgggcgcctgtaatcccagctactcgggaggctgaggcaggagaatcacttgaacctgggaggcagaggttgcagtgagctgaga

SEQ ID NO: 8276 - DNA, 397 bp, Homo sapiens; identical to SEQ ID NO: 8273

SEQ ID NO: 8277 - DNA, 397 bp, Homo sapiens; identical to SEQ ID NO: 8273

SEQ ID NO: 8278 - DNA, 183 bp, Homo sapiens
cagttggatcacctgaggtcagaagtttgagaccagcctggccaacctggtgaaaccccgtctctactaaaaatacaaaaattagctgggcgtggtggcgggcgcctgtaatcccagctactcgggaggctgaggcaggagaatcacttgaacctgggaggcagaggttgcagtgagctgaga

SEQ ID NO: 8279 - DNA, 984 bp, Homo sapiens
gcaggaagaaaaagagcataaaatttacttaaatagatgtctattcagttacagttatgagaggactccattaagttacacattttttgaaaaaacctaactcttaaatgagccaagcatacatcactaagtattctatttaagaggattcaacgtttagagaatcaagaagtaccagtggctgcattctcacaatttcctgcaagaatgagtctctcacttatctactttagtgtctcatttaccacttttggtgtgaaaagttcccatgatttatacatacctagactcttactgctaaagattctttacatactttgatgataatgattataatgataacccatacatagtgtttaatgcatgccagacactgctctaaggtttttgcatttaacgctcacagggatgcaattgtcctcatgttttcattttacagatgaggaaactgactcatagagagttaagtaatttttttcaagggcatgtagcttacaaatgatagaacaaagattggaccctggacaatctggttccagggtcctgttcttaaacattaccttttcctgcttcttacagaaattattaaatgtttactgtttacaaggctaatatttatgaagtcattagaaatgatgttggaaaactgctttgaatcacataagtagctattaacaaatgaggttctagtagaatttgacaataatgacatggtaggtaccatttggctaataaaggaaataaaatgaagccctgaaatagattttttaaattactttcattatggttttgctatgcacatcttgtgttaagtaaagaatgttgcatggtgcttttgggcaggggtttttttgtgctttttaaaactttatttcaacataactatgcttacagaaatacagtcatattggttaatagaatgcaacttaggtttaacttataatacacaatttggaccaaaaagttggtacatggtttaagatt

SEQ ID NO: 8280 - DNA, 152 bp, Homo sapiens
aaaaaaataaaaaaaaaaaaaaaaaaaaaaaaaataaaacaaaaaaaaaatataaaaaaaaaaaaaaaaaaaaaaaaaaaaaaaaaaaaaaaaaaaaaaacaaaaaaaaaaaaaaaaaatataaaaaaaaaaaaaaaaaaaaaattaaagag

SEQ ID NO: 8281 - DNA, 165 bp, Homo sapiens; identical to SEQ ID NO: 7989

SEQ ID NO: 8282 - DNA, 143 bp, Homo sapiens; identical to SEQ ID NO: 7217

SEQ ID NO: 8283 - DNA, 151 bp, Homo sapiens; identical to SEQ ID NO: 7218

SEQ ID NO: 8284 - DNA, 125 bp, Homo sapiens; identical to SEQ ID NO: 7993
  misc_feature (33)..(33): n equals a,t,g, or c
  misc_feature (49)..(49): n equals a,t,g, or c
  misc_feature (61)..(61): n equals a,t,g, or c
  misc_feature (90)..(91): n equals a,t,g, or c
  misc_feature (116)..(117): n equals a,t,g, or c

SEQ ID NO: 8285 - DNA, 126 bp, Homo sapiens; identical to SEQ ID NO: 7221
  misc_feature (9)..(10): n equals a,t,g, or c
  misc_feature (14)..(14): n equals a,t,g, or c
  misc_feature (20)..(20): n equals a,t,g, or c
  misc_feature (95)..(95): n equals a,t,g, or c
  misc_feature (107)..(108): n equals a,t,g, or c
  misc_feature (110)..(110): n equals a,t,g, or c
  misc_feature (118)..(118): n equals a,t,g, or c

SEQ ID NO: 8286 - DNA, 195 bp, Homo sapiens; identical to SEQ ID NO: 7996
  misc_feature (3)..(3): n equals a,t,g, or c
  misc_feature (30)..(30): n equals a,t,g, or c
  misc_feature (32)..(32): n equals a,t,g, or c
  misc_feature (37)..(37): n equals a,t,g, or c

SEQ ID NO: 8287 - DNA, 10706 bp, Homo sapiens
aaaaaaaccacaaacgaaaaagcaagagtctagagagaggcattttcttggagggcagcttccttcctttcagctccgtgccagggccgggcctctccaagatgcctctgtgtctgccatgatcttccctggccttgtcacctgtaccgctctttctcttctcttcccagcttctgtgaggccaggcagggcttccctgttgtcgggtgcccgagtggccgctgccccagctctcaccgtggactcctgcctcaccgggctgtccagccctgcctccccagtcttgctgtggggtgctggggcaggcagtgtgtttgctgggaagctgctgcagcttagagcctctgactttttttttttttttctcccccctcgcccccaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttgggatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagtgaagcagtgtcctctggatcctgcctccctgcccagtgccggcccctggcctcactctctgggctcccaccggtaatggtagggcgtcggtaccgaagctgaggacactctctccagggcctcctgcttctctcttctctgaaagccaaaggcccctggctccttggctctgtgctgccgtgaggtccggtgcagcttcgacctcaccaccctgtggcacgcagaggaaagagctggcattagttggccctttaactcgctggctgagggcgagcgagcaacctcagcagtcctgccccttgtcacggcagtaggcttgactggggatgggtttcagtggagtttaagaaatatttaacgccgggtacagtggctcatggctgtcatcccagcactttgggaggctgaggcgggtggatcacttgaggctaggagtttgaaaccagcctggccaacatggtgagaccccatttctactaaaaatacaaaattagcggggtgggggcggtgtggtgcatgcctgtaatcctagctactcaggaggctgaagcagaagtcacttgaacccgggaggcagaggttgcagtgagactagatcgcgccactgcaccccagcttgggtgataaagtgagaccctgtctcaaaaaagaaaaaattacatatatatacatacacacacatactcttagacgttaatgggaccctttaaatttagggaagaaaaggtgtgtgtttgtgtgtaaatccttagcttggccacccctttctcttgggggcttctgaaacatctctgtgccaccttaggagtcctcacggtagttacagaccactggtctgggaagtggatgattagaaaggatgggcagagggagccagggggctgtaagccagggatttgcagagtgtaggtttgggactcattcagctttgggatcatctggaatttctggactccatcccaagttgatagagttagactctctggagcttggtaatttgcatcgtcagtaggctttcctgtgattctgaggacaccaggatttgagaaccatgtctcttatgggctgtgcatcattgtgggcctacagagctcatcacgcagcctgagcttttttttttttttttttttaagatggtctcattctgtcagtcactcagacgggagtgcagtggcacgatcatggctcactgcagcctcaacctcctgggttcaagtgatctacctcgggtctcccaagtagctgggactacaggtgcaagctaccatgcctggctaaggttattttgtagagatagggtcctactatgtttcccagggtggtcctgaactcctgggctcaagcagttggcccaccttggcctcccaaagtgctgggattacaggcaatgagccactgcatcctggagcagcttcggggctggaatgcctagtcttggcctcagctctgcaggggtttgggaggcagttcctgtaatgatccgttctgggtagggatgagcccaaggaaatgtgtatgcctagtagtggtgacatccaccttcagaggaggcagtcctgttctgcttgggcttctgggtgggttttgctttctgggggaccccgccccttcagccctcaatccaaagaagttgaagacactcgtccttacctgcctccagtcttggctgggatgtgtctgccccaggctgtgtctgtctgtctttcacagctgcatcccactgttctaaccccaagcaggtgcttggcaaatgttgactgaaaccctggctggaaggctgtgcagtattaaccctttatggccacggtctttaaagttatgggaacctggccttgaaccctctgaacctgtttcctgaaggccgttccagctgtgagcacttttcctctggaaggttgctcttgtgcgaagctaggcccctctgctcgttgtctgaggcaggtccccaggtctgagtgggccactggcctacctcctagtcctaccagaaaagcaccgaaaacccaaactccccctctcccttctcccctcagcctaggagctttagactcaccagttaccagacatgagggactttttattcgtttcacatgtttgtttagctattagacacaaaggggtcaagacttgaagcagtttttgcaagtgaaatcatcttctggcccacccttcatattaccaaggctactggctgttctccaacaggccacagcggttatgtcctcctggtacttgcgtcgcaggtgtcacccttgatggtgcaaggccctgcgtggctattcgggttctcccccttaatggagttgctgtgaggagatgaaccttattgggggaccgcagaggctggctcagaagagactgctcttaagaggttaggaggactaacaggctacggcgtgacaaggtggcctcagcacagtctgtcagcttggggcctaagtgaagttcacaggctgatagggccagggagagcaggccattcaccttccggggccactggctgggctgatcatcagagcccctctggctggtcttggggctgttattcaccttgtcagcagcagagggcagcacagcaaggtgctggagaggaggctgggtgggcacaccaagggctgggtgggagcaggtacagggcgctgtgggcaggaccctttggactcctcaagtctccgactcgtctgtctcttcagtggagccatcactctctccatccacttttcgggaatgatggagaggtctccagggagagccaacccggggaggggtccgggaaggcaggcaactggcctctggactggctgtgaccgagttgaccaggcctgggacctgggccagcctgaagaagggaagaagcctggagggcagcgagaggcctcctgtacagagagcagggcctccatgcccactcttaacactagggtaaacccgctggctgcagcccccaaaggactcagagggagggacacctcagcctccactggcccccagacccttccctggcagatgtgggatgttacagacaagtggtgttggccccagatggggcacagccgtgtccgacccgtctggcccccacaagggggcagtatcctcccacttgacacttacagccgttccagctcttcatccattgctgggtcgtgcatcagatcccccttgtcaggcaaagctcctaggagatcattgggggcacagtagttaatctgagggcccttcagccaggcaacagattcctccatgcccctcaccttcacggctgcctgttctgctgaccctgcgagggccgatctaaagatctgaggactgctagaggggccaagaacagtcacggagcaggaaggtgctcgctgttgcttgatacatttattgaatcccactgcctactttccctgcctggggcagacaccacagccaaggagtgtggtgatccccttccaacaccaggtggtggttgtgacctggtgctgggagttgagttccttcttgaggcctcaggtactgggctgaaaaggatatggtccaggctaagcccaaaggtcagacattacctaattttgtgtccctaaatcaggatgaccccactttggagacagatggttaaaaaaaaaatgctgcctctgcttctccaaggaggatcccaggggcaagaggagaaggctgggtcagggccagaattaacccggcacaggcagatttcccctttttccaaatctttttcagatgatgcctcctggcccctcttgccctaagttagtggttttcaaagtacatctcatagaaccctctcatttgtggggtgccctggggactaagggaacagggctgacctccgtgacgcgtcaaccagtgtatctccggatttctatttcatacgctggagatgcaggtgaggcctgagaccacatgcttctttctgtctcccattccatccaaccacccaatgttagtgtgcagtaaaagtggttgaatgagagtgactttttttttttttttttttttgagacagagttttgctttgtcacccaggctggagtgcagtgatcatggctcactgcagcctcgacctcccatgcccaagcgatcttcccacctcagcctcctgcgtagctgagaccaatggtacatgccaccacacccagctaatttttgttttttttctaaagagacggggttctccctatattgcccaggctggtcattaactcctgggctcaagcaatcctcttgctttagcctccccaaatgctgggattacaggtggagccaccatgtctggctattagtgtttatttatttgatggagtttcgctcttgttgtccaggctgaaatgcaatgatgcgatcttggctcactgcaacctccgcctccctggttcaagtgattcttctgtctcagcctccccagtagcaggaattacaggcatgtgccaccacaactggctaattttgtattttcagtagagacggggtttctccatgttggccaggctggtctcgaactcctgacctcaggtgatccgccgcctcggcctcccaaagtgttgggattacaggcgtgagccaccacacccagccagtgtcctttttaaaggcccttagaaaagggggatgaggttacttcaggctgtgacccagttgctaattggcttctccttcctagtggctgctactggtgggaagaaagagtggtcataacgaggagtatgaaagaacaccagggcagatcccacccgcctcccccttactcttgattcctgactctcgcctgtttttgttttttttttcttttttgagactgtcttgctctgtcgcacaggctggcgtgcaatggcgtgatctcggctcaccgcaacctccgccttctgggctcaaccgattctcatgcctcagcctcccgagtagctgggattacaggtgcgggccactatacccagctaatttttgtattttcagtagtgatggggtttcaccatgttggtcaggctggtcttgaactcctgaccttaggtgatccacctgcctcagcctcccaaagtgctgggattacaggcgtgaggcaccacgcctggcctgtcaattgcctcctttctagtcttagtccagtgggtaaccttggctaccaacttcagttgagggctccccagacctgtgcatgccccaagcactgactcagaataaccaggctgtgggtggcatgcagttcagcctgctggggtttgtgcttgtgtatcccagagcatccctggctaactgtatattgtgtaagataaaaaatataaagcatccagcacagtacttagcctgctgtggttggcatttagtgaatgttaactttccttcccttaatcccattccctcaactggcaaaaggaagggggatgctgtgtgtcttttccttgagactcaggcacctgggatcccaagcacagcaggaggatctctcgagacacaaaaaagaactccttgctgggcgtagtggctcacaactgtaatcccagtactttgggagagcaaggtgaggggatcccttgagcccaggagtttgaaaccagcctgggcaacatggtgaaacccagtctgtacaaaaaacacaaaaattttccaggatggtggcgcatgcctgtagtcccagctactagggaggctgaggtgagagcatcacttgagcccgggaggtcgaggctgcagtgagctgagattgtacacagcactccagcctgggcaacagagcgagactctgtcccaaaataaaacaaaaaacaaaaaaccttaaactgtagtagaatggaggcttactggctcttctcttaggagagcagtggctgtgggaggaggaacagtggggtgggtggagaaggctcagtgaaaaaaaacagcaggcaggaaaaactgggccactgcagacttcccctacttttgtttttctccctttcagattaatcagattttttttttcagcttggaaaaaaggtctccgcagacacacctgtgccttgtttataaatgggattcaggtctctttgatatataatctctagcgtcactgagtaaatagtcctgtgtctgcccgacctgcaggctgctccccaaagcagagctggggttctctgaggaggggctgggcgcttctgctatggggaggtggtttcatgttggggcagggctgcaggcagggagggctgtcccctaccatgggaatgtgtaagagccatgttttgtcgccatattcctgctccctgggattgagtccgcccctgggaagtcaaggcagagatggtgatgccccttcccctctggagccgtgttgctaacagaggccagctgctccctgtgttgtgcggcaggagaggctgacggctgcttagctctgacttaccgagggcttggttgattccacggtgctttgagagagccatgaggaatccatagaaggtcagtctctgaacattgctgagggcctctttgacaagtgctgggggtgggcagctaagaaggagagatgccacattcagagcctagccagcctcagggccacctctgcatccatactttcaggttcatgaggatacccacagccaagccagggacctgccttgggagccccaaggccctgggggatcaggccttcactatggtcaggaggggctggcatgttcactaactggtgctttcaccggggtggggagtgggggtgggaaatggctacgggaaaccaaacctgttgctcagtccctaagggtacttgtgccacacaggacagcttacccctctctttgtgtagaaaagttttatacaaggagtactctttccttctctctaaaatgttaaggccagtctgtcacccagtaaattggtcaactacagtggtcttgcctgagtgaaagcagtccttttgaagtgagctaattgagagcctttcagtcaacaactggtttgggggcaaatggcactgttacattatgaccagcaagggccctagaatgcctgggccgcgcagaacatcctgcggagctctgttccgcagccagcagtccgacccctggggctggggggctggggctgcatgcccgttcctcacctgtacttgtgccgatcacacaggttttccagacactggtagaacagcgacgcctccacgccctccagcgtgccggcccccccaaggcaggtcgttggcggtgctgcccactggacgacgtcggcacaatcactgtgttggggttcttgcctgacagcaggtcctcatagatggcagccacactgtccaggaattctggaaccgtgggggtgggggtgtgggtgtggacggctcaggcagggaggacatgttttgtctgttcactatgtcttcccttctctgtcagcccagttccacaccagcctcagtgctcagggcatggtgtcctgagagcagaagttctcaaccttgtttgacaacacattgatgagagatgacactaatctgtgtttttgctcaaatgtcccatccttggctcagttgttcctggaccaggtgagacctgccattgcacactttcatagcaccataggcttttttttttctggcacttagccagtgaggagctttctgtgtcattaattgtctaatctgtctccttgctggaatgcacaaaggcggggtcatgccttgttggcctctcctgcctagcactgtgcttggcacatattaaggccataaatattttttggaggagtgaacatgagtatgctcccactggtaagccccatggtgtgtggccacctgcctctctacctcaagaaagcgtgttggaataccagcgaggaacagagaaagcctgaaagctgctgatgagtcagtcatttgaaatggttttcaaatttcgtagttgagccattgttagaactgctgacttatggcccatctcgtctctacacacaccgctgggcagtgtcagtaatgctcccagcccaatgtggtggctgtcccatccctctgggggtgctgtgagaagagggctggggagacagtgagggaaaaatgttctcccagacatggctgctccttctctagggcccaagagcttcagagaaatgggaaatgactggtgctgctaagagcaggtggcgagaccccaggctccagcccctaactgtacagcccttgggctgccatcaagtaaacagaatgtggcgcccaaatgaggccagggctggctggggacaccagttggcaggaaggccacctctaggatctaaggacagccttctatttactggaagagcctgttttaagcaagtttgtttatgaacacagtcagcaatttgtaaacccggcactccatttgatgtctctgtgcgtgagctggtgtatatttatatttatttgtctatatttattccatctgattccagagagacttaagggtgcagctgtgtgaattggggagcagagtgggagtgtgacaaaggactggtgtatgcttttttaaagctgtggggtggaggagaatgtgcacccaaacgcacgatcagttgccaagggagagacccttgaaggcagtaaaatagcagcgaggttgggaacgctggctttggagtcagccttcaggtctggtctccaccacttatgagctgcatgactggctactacttctgtgagcttgtctctgaaaggactctctctcaaggctgttgtcaagattaaagtcagtgctgtgcctgggacatagtaagttttcagtaagcagtgaatgctgtggatgctatggatgttgttattgtcattatcacttaaactgatttgttgcgttgctgactgaaaacactgcggtgttcagtgtcttcaggaggctgaggaagtcggctctgcagactgaatcttgtgaccaccactgaacactagacatcctgttagcgacccgcagtgaagcacacccccaaaggaagtggggaagagaaacgtgtgtgccaggcacacagatgggcagggcagcagggcaggacagggagacagggtcctgtgcggagcagatggagccccggaacactcacctgagtagtaaaactggatctggaaggcaaagaggaaatctgaaaaagacatcaagcagtccatggcatcgtccatgagcacaatcctg

SEQ ID NO: 8288 - DNA, 14427 bp, Homo sapiens
agtcccgtaggctgtctttcccttgctttgcagatgccagccccagagtcccacctccaccgttggtaaggaagcccctcacccctgcctctttcaattgtgggaaagtgaactccagcctctctctccttcctcatcccagatcaacagcagatgttagtatgacccccctcctggctccctccgtgactccagctctgccccccacctccacctccacctccaccacttgcttgttcatctctcacctgggccaatgtccagccttctaagtgtttcccttctccaaactctcccttcccatttgtcaccctataagtaacctgccagattattttaaagcacagtgctgaggtcacacatgtactggcaacttctaatgcaagaccgactagggctagatctctttgaggctccctgaccacacgtccaacaactcctccctcagttcacaatttcacttctccttattttctctttctcttcctgatctgttctgtaaatttagtttctgctgtggaatttgcttgctcccttctttagttcaaatcaggcatttgctacccctcatgtctgtgacaccgtgtttatagtttataaaccactctcaaagctatttgtggagtactgaggttagccctggacatgctgtggtgagtaaaaacagatgtggctgtgtttcatgaataaagtcaacaaaatctgttgaggaccctgaccaaaagtcatctgtcccaaaatcctaagtggatttgtgaggaaagatattttcccattgtctctcttaacactcttccccctgactcccaaactatggcctccctggggtcataggaacaaagtacagaagacagagaagaagactgtggcttgcagattcttaaagaactttattaaccttgtgagtgtcatagaagcagctactgggatgttgcaagcccagtgcaaactggtatatcttgctatattgcaacatcttgaatttccttccctttatattaactacccacacataataagccacatctattatttgtgtgagcctatgctttttacttttattttagagcctctcgtttcctcatttgtaatatgtgatcagaaatctgtcattctcggcctgccgcggtggctcactgctataatcccagcattttgggaggccaaggcaggcagatcacttgaggtcaggagttcaagaccagtgtggctaacatggtaaaaccctgtctctactaaaaatacaaaaattagctgggcgtggtggcacatgcctgtagtcccagttacttgggaggctgaggcaggagaatcacttgaaccaaggaggcataggttgcagtgagccgagatcccaccactgcactccagcctgggccacagagtgaaactctgtctcaaaaaaaaaaaatctgtcattctcataaggttgttaggatgatcaaacaagataaaggtacataaaagagctctatagaattataatgtacaaggccgggcacagtggctcatgcctgtaatcccagcactttgggaggccgaggtacgcggatcaaaaggtcaggagatcgagatcatcctggctaacacggtgaaaccccgtatctactaaaaatacaaaaaattagccaggcgtagcagcgtgcacctgtagtcccagctgctggggaggctgaggcaagagaatggcgtgaacccgggaagcggagcttgcagtgagctgagatcacgccacactgtactccagcctgggcgacagagcaagactctgtctcaaaacaaacaaacaaacaaacaaacaaaaagaattataatgtacaacataaacgtattttatttattctttttttttttttttttttgagacggagtttcactcttgtcacccaagctggagtgcaatggcacaatcttggctcaccacaacctccacctcctgggttcaagtgattctcctgcctcagcctcccaagtagctgggattacaggcgcctgtcaccacgcccaactaacttttgtatttttagtagagacagggtctcgccctgttggccaggctggtcttgaactcctgatcttgggtgatccaccccctcggcctcccaaagtgctgggattacaggaatgagccaccacgcccggctactttcttctttaaatcaattatatggccattatttatttcataaataggcattcagtgactttgaaatattatggtccagatagagacaacagggttgtacaacagaaatatgtaggtcaaaattttaaatattctagtagtgacactaaaaaatataatagattggcaaaatttagtaatctataatcttgatctactacatccagaatgttatttcaacatgtgattcatataatagtgactaatgaggtatcttacactctttttttgtagtaagtctttgaaatcctgtgtgtattctacattgacgggacatctcattttggactaaccacatttcaagtgctcagtattcacatatggatactgtgcaggacagcacacactaattggtaatgtaaatacaagttagttaagatctgtgaagtactttatggtttccaaaactcttttggcatttaaatcttgcgtcagccccagcaggtagatgtttatcatttccattttgtagaggagaggctgcagcaattacctgtaagtcacccaagctcatccagctagtaaatggtgaactcaattcttgtcttaaacctgggcactttcccttttgcttgcttgcctaaacaagcaatacaaagacaaacttaatatttatacacatacgtcccatggctcattgcagtagtacaggacagaaacaattatttcaaaatccacctacaatctagtctccaaaaatcctgcccagtttaattgcaccacaatctactaactgtaattctaaaaatgtgtatgttggataatcttccagctctaaagtgctgtgaattaaaaaaatgccataggcaggcataaaaaaatcctaccctctattatattctccatctgatatagaatatatgatatatattctataaatgaatacatgatacagagtctatcatgtagtgatttactttttacttttgtgaattacaacgtggtagggtaggaaatgagaaagcttaaaaagcctaattttctcactaaagcataaccagacacagcagcctattaggggtttctccagaagatggcaggcagtcaagggggacagagttcgacccgcgacaggccaactgatttccccaaaaagatgccaagggcagctaaccgccctcctggcccgcgaagctgctccttgagggcccaaaacttcccggaggagccagaggaggccctcaggagccacagctctccctgacttggcctgtatttgcacccctagggatcccattccctttcccgacgcagcgcaaggaaggggagcggaatgggggctgaaaggcaataaaaaacttgtaaagccgtatctgctagttctcccagtgggctatgtccctgcaaatatcctccacaagaagtaaactgggtgggtaggaagaggtgaaggctccctcctcagggctgccgggaccgcctcgagggcttgtctgtttaggtcccaattcctcccggatccgtacattcacacgagcgcagggcaacaatctgagcgagtgttcgtgtgtgcccgtgtgactcgccatcgcgtggcagatgttcagtagaacattacagtaatttctgttacaggtccatgggcgcaggtccctgagcccacagcttcgcgggggtctggccgagcatgcgtcacaacctacgcggccaagagcagtgcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggtgagtgcggcccggcggagggagcctgggcccgaagcggggcggaagccgtggcagcctggcaagctggtggccttgatcctcggcgtccgggcactttgggcggcgggaccttgcggtgaagaggtgtgtgcacgcgcagggggccctggagccacagctgtatgccttacggggactctgcctgtgcaacagccacaccccgggttggggatcctttgtgtttcttggcggaaccacgcccctttcttccacgaaacacccactccgctgtcttcagctggagaagcagctcctttttcctattcctgacctcggacagagttttgcagaacaggtgtcaggtgtgaaattgctgagcgcgggcagggtggggagtgggagtggggagaagcgggacaaagatcttggctgaggttatccgggagctggagcagctgcgagccagagtactaggttgtcctgatgtctgaaaaccgctccatccctgttggccttccatgctgctttcactagattgcatttttctgctcagaagcttgtttactgaactttttgtaatagctctgcccctgggtatgaccatggacaagatatttaccctccctgggctacagttaccgtatgtgcaaagtgaggatagggataaataagatcgctatgtccctgccagtggcaacattctgtgaatctgagtttgtcaaatcagggaataatgggggtcgctggcctctcagccagggcactgtactttcgaatctgtgattgttttcacttctctggcagccacaccccactgctgattcacagaccccaaagtcttttcacatgaattgttaggaatgatctttcccatcctgtatttgtagcacttaaaaaaaacagtataggagtctgcattcatccttgttatagtcatctgtaagatatgacccgtttcttccagttcgtcaagacatgcttttggatgtggaatctgccacctcatgtattaactacccccttgaaatttcatgtcctctttgagtttgatgagcggtcttcagtgtcttcttctgccattcctaaaagtaatgatcaataaagaaacatatatcccatcaccacagatctccctgtgaactactgtgacccccagtaatcaacatttgaaggtttagttgcttaagtatgtatgaagtcaccctgccatctggtcagcatttctagcaaaggtgtcttgaagaccttggcagctggatcttgaaatgcagtctttagctattgtgagggaagcagagagatgtgccatttttcttaggagtgtttgctgagcattgcctgtgccagctcctgtgctcgttctgagagggtaagtaagtgatcaggagcttgacccagtggagcttgaagtctagtgagaggcggacacaaagcgtctgaacacacacttcatacagaggagactttaataactttggaggcactatgaaggtttaactaacggagacttaactaattcgttggggtgggccacacctcagaaaaggtttcgaggactaggtgaagcgtaagtagagtcttgcaggataaggaggacatccccaagggaagaggagtgagaattatgtttcagttaaagagcactcaaacactgaaccacagaggcgggtttgggagtggtgattgagtttgtcgaagctgtctcctccatcatactgggctctgccagtgtggacagcacaagcttagctctctctgtgggtttttccgagcaagatcaagtgccctcttgtgttctgtaggggaggcacacgatccgaggtccttttagtctcagaggatgggaagatcctggcagaagcagatggactgagcacaaaccactgggtaaaaaccacactgaggggatcagagggcttggttctgattttattctctgtaattcctgttgaggtggtggctgggactcacagagcagcctgtgggggcaacatagcttctgtaagcctttgtaactccttcttcccttgattggggccagctgatcgggacagacaagtgtgtggagaggatcaatgagatggtgaacagggccaaacggaaagcaggggtggatcctctggtaccgctgcgaagcttggtgagtctggggcggagcctgggaattcagccatctgtgacactgagacagctagcaagtttggactagatgagtttgatgactgcagagggaaagacctccaagacttagtccctggtgtcaaaactgtcataatctcacccagtctcatggcttcagttgccacctacaaactacaaatgtgttggaagagcacagggctttggagagctgctgagaccttggtttgaatcccagctttgctgctcagtatctgcgtaaccctgtgtaggttactcaccttctctaagcctcagtttcctcatttggaaaatgtgaatagtagctacctcagagttgttgggaaagtaaaatggcatgatacattgcaaagtggttagtatagagcctgacccataagcactcattaaatgttagctattatttactcctggttcagatctttctcccaagttgcggtagctccagctactccctggacatatatgtgagatgttctgcagacacaggcaaacctcgtgtataccaaaccaagcttacctctctccatctcccctcaccttgccccgctgcctgatctttctgttaagagcactactgcccttccaagctccaaagctggcattgttgaatcccctctttcttctgtccatccccagtccaggttgttcttataaccacagccttctgaggggtcattgtgtggggagaaaggaggactggggctgggtgaacagggtatggccagatggggagaacaggaatcaggcatcaggagggggcgggggttgagaaaagagctggggctggggctctgcacactcgctcacctcccgcgtggcctagggcctatctctgagcggtggggaccaggaggacgcggggaggatcctgatcgaggagctgagggaccgatttccctacctgagtgaaagctacttaatcaccaccgatgccgccggctccatcgccacagctacaccggatggtgaggaagtggagggaggggtgagagtgagaactggtttttttgggaaagccccttagatatagctgacaaaacttgttctgcaaatatccagaaggcagccactcttatattcccctcaactctttaagtagtttaagtctctgccagagcaaggaccaggcagcaggaggaagggcaagaaaggtctcttgatgggaatccaggagtggggtcaaacataactcccctgcagatgagggaccacctgggggcggtgtagtgaggaaggcaggctggggaagctgtcagtgctgaggaggaagtggggtggccttgtgatagtgtaaagagttttggtgtcatgggattggtgtttgaatcccagttcctgttttgcctgctataccatgttggcgaagttccaaaactctgagtttcagttttctcatctataaaatagaggaagttgtattcataagatggtttagggtatgagtgaatatcactgtgagaacgggtctagcacaatcccagtaaagcaggtagagtcactggaagaccggctgggcaaggagccacattccctctaagaggtgcaggcttgcatttctctttgtccccctagacgagggcgttatgggattagagtttttctgagacccaggctctcaccctcaggcaggaaactagctgggctcagttttctcctctacaggactgggtggtgattcccttgcctggggctgttttctgtcctgtctttccacagtggcaagctgttgctctgtgccaggcctcggccacactgagcctcctattccctttccccaggtggagttgtgctcatatctggaacaggctccaactgcaggctcatcaaccctgatggctccgagagtggctgcggcggctggggccatatgatgggtgatgagggttcaggtgagctcactgactggcccagctccaggtcctggatctgctccttccttcactccctgtctttctctccttagccttggctcactgagcccttggggcttcctggggacaactcctgaacctggccattccatgtgcaggatcatgactgagatcatagaggtgcaaatgctggacgagctgctgaccctgctctccagcagtgacttgcacccaggactcagattcatccctcagcacaggggcctgcctgtgttgacttgctgtccttagggaggagttgaaactgagggtaaggccatagatgccaggagatgccataccagtctgctaggggaaagggtgtagaagcccttccaacatcacctctctctaggtagtgtgtgtttattttcataggggcccttgaggtccagttcatggcagtgactccggtggtatttgtgacaacagactgaccttgccttatccttgggtaggagctggtgtgacacagcctcacctattctgttttccccctccaactttcccttatcttggtcagtcagatacagtttgatagagaccctcccacccccctctcccaccccctgccacccctggctgggaatcaggaaacctaatttgtataaaattcaagcagatcactaacctgtctggatctgagtttccctcctcgtgagctcaggatgactgctcccatcttcttagccctctctgctccctgcagcctactggatcgcacaccaagcagtgaaaatagtgtttgactccattgacaacctagaggcggctcctcatgatatcggctacgtcaaacaggccatgttccactatttccaggtactcctcctgctcccagtaaacatgcgcacctggggtagggcagtgaaacactccaagtaagagtggatgcaggggagggcctgggcggaccggcaggaaatagggtgagttgtgggtctgagttgcagggtgaagtcataggtgaggacagggtgcattctaggaggtgcattctaggacagggcagtgcattctaggagggtgtcagtcatgaggaagcgatggtttggggacaggtgattagccagacttcattcttgggcagctagaacctgctgggaggtgaaagagatggcattctaggctagaatgaaaagtgcaggatgagatcacagggcagagacagcaggtagagtatgaatgtgtgcactgggctgtgagctgcttctggcctggatgggtcaagagagcccttaaagaggtggacagggagagttctgggggatatgcatcttcctcctctgggcgttggggattgactcctccttgtctgtgctgtgttcatttgtggtaagttaggaaacatctgcctttagcggaaccagaggtaaaaggcgggagagaaggtgaaagggagaggacaaggttgatgagtttgatagttacctgtgaggcccagttagtcttcctgtccagacatttaggtgggctggggctggggctgggaccaggaccaaggaaggaaaatagagatgctgggaagtagggcctggattatcagggctgagggattgatgattaaagaggggcccggctaggccaaggtgaggaataggaggggaccaggaagagaaatcacttgatgagcagttgtcataggaagtgcagttagtaactgttaagctatccggactcagccaattggttccaaactctactgataggtctactgctccctcttctatcctttagtcattcttacagggttgtttcaaagatcagatgagatagtatataacgtgcttactacattgctgtaggtgctcaagttttaccacccaccccctcagacatttacttaaaatatattctgggggctgggcacggtggctcacacctgtaatcccagcactttgagaggccaaggtgggcggatcacttgaggtcaggtgttcaagaccagcctggccaacatggtgaaaccccgtctgtactaaaaatacaaaaattagccaggcgtggtggcgggtgcctgtaatcccaggtactcaggaggctgaggcagagagaattgcttgaacctgggaggcggaggttgcagtgaggtgagagcacaccactgtactccagcttgggtgacagagcgagactctgcctcaaaaaaaataaaaaaaatattctggggaaccattggttcctcaggaccttagaggtgttaaagatgtataagtttgttgggattggaaggacctaccttctgtggtcaaataagttttgggagaaacaaattgatttcttgattgcaggacttctcagagcctttaatttgctaatgtgcattgtgactccccaagggagagttacaatatgcaatattccttggattcctttgaccaaagaaatcttttcaagagcaccccaacccagctactcaggaggctgacgtgggaggattgcttaaggccagcctaggcaacagcaagaccttgtccctaaaaaggaaaaaaaaaaaattacaaaaaaagagcagctcaagaaactataggaaacactttggttaacacaaatctgttctctgtgctgccttcaaactaatctataagaaataatgaagtccatgttagggaacacagataacttttctcaaatgagaaatctcaaatccctgtactttggagttaaaaaaaattattctagcttttccaacagtagagacattaggaaggccaactttggtgggcagattggggattttcctttgcttctgatgactctcttgtgccctttctcctctcaggtgccagatcggctagggatactcactcacctgtatagggactttgataaatgcaggtttgctgggttttgccggaaaattgcagaaggtactggaggtggggggtgggttttatctggctttgttctccaaagatccccagttgggagattgagtggggttcagacaggactgacaacaattttcctctcaccaagtgacctcagttctctgccaccactggccttggtggtggtgggccttggggtggaggcagaagggcacgtgggtcgtgttgacagttttgtattacctgtgtttttttctttaatagctatcatggcttgcttaggctgtatgcctgtttctgaggaatttatgaagcagttgtcctttggacaaatctataactttcttttcctagccaattatactcaaagaactaggggattatagagaggttaggcatattttgttgggtgtcaggagatgctgaacagagggcttgtatatctgtacattgctctttctccactgtgaggtccatcctgccttaatttgggttcctgcagcctcagggcattctagggctctcttagatcctgctggactgagtcccctctagaaaagaagcaggaacaggctaaccaacagcagactgttagaagttggtggagggcactgacaggagtaccagccagctgttcagctaggatcctgggtccccagagctgacagcctcataggaacagacttacagtaactcagtgtgagctggatgcatactaggtgccagtgcattcctttagtgggtgctgccctcccttcctgagttgggggcctgagtgagcacctctgtacagggcacccctctacagagggaggtagctggtatgtttgtcagtggagacttgcttctccacctgccacgaggcgggcatccatccggcagtagactcctagctcagggtgctcctgtgatggctgccttgcaacagagagaggatagcccaggaatggcagctccctcctttctcaccagtttccttcttccgtcctccctaccccaggtgctcagcagggagaccccctttcccgctatatcttcaggaaggctggggagatgctgggcagacacatcgtagcagtgttgcccgagattgacccggtgagttgaggtgggagtgaaggtggggagctgctgggtgaggagtggtcctttcccactgtggatgggactatcccatcaaaccctgcatagattggatactattttaaatgaacttagggtctaagaagcattctgcagaatgtctgtaacaaaaaagttctttggtcaaatgccgccctctgtaattggcctgtaatctgtatttatgtatagtaaattagtttaatgtacgtgtgtgtgtgtgctgtcccctttctattttattttttatttttttgagacacagtctcactctgtcagccaggctggagtgcagtagcgtgatctcagctcactgcagcctccacctcccactctacctcccaggttcaagtgattctcgtatctcagcctccccagtagctgggattacaggcgcgcatcaccatggccggctaatttttgtatttttggttttgccatgttggccaggtaggtcttgaactcctgacctcaagtgatccacccaccttggcccaaagtgccgggattacaggcatgagccaccgcgcccagcctgtcccctttctttcagttaatttcagttcagtcatgtttctgttcatttccctcacttctgtctttccttcctctctattgttgcttaacgctttttccttcctcttctctccttgccctttacaaatgtctcctattttcctccctttttttttcccctttcctgagtctgtctactgtttcttggcttgagggcgagtaactgggatagagtgggttggtcataggaaactcccgccttcagcactggagaggctaggttggcccccatatccattttctgctctccacccaggtcttgttccagggcaagattggactccccatcctgtgcgtgggctctgtgtggaagagctgggagctgctgaaggaaggtgagcctggggggaggctggaagggcaagggcaggggacggggctggaaaggaggtggcccaggaaagctttttgccccagagagaacctgcttcctggaccctgaggcctagacaggccactgatgctcccgtctaaggccctcaacctcattctgccattgagccctttaatgatgtcccatccaccttccttgaactcttgaaaagatgttgtgttccaaatgatttattgaataatagctacttttaaaaagttaaagacaaatcagacttaaaattggagcactgactggcatgtgataacctgggggacatccctagtcaacataattctagctagaagaaaagaggcctggcttcttagccctggcagccttatgccaggcagttggatggtttctaccggacattctgaagtagctcaaggactcccattgctaccatggaattcctggcattgggtcctttggagctgagaggagagcaggccccctatgttgctggctccaatactcgagtacccagtgcaccctgtgtgctgggcacttggcatgtaggcccctccagcatctctacaggagtacctcagggtctgggcgtccttgtctgtcttccttcctggccccagtacaggttgctgttctcctcttatctctgtccttgtgttcttccctccaggttttcttctggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaattggactgcattatcaaacacatgtgctatgtacatcctcagtgcacctgccagcagatatcctggagggctcatgagtgaatttagtccaagatttaaagccctgcccccaggtgctcagcctgtgatctgtatccactcagcatgcacttgggcagatgatttgtctgtgtgctacccttccccccatattaccatacatatgcactgtgtggctgccagtta

SEQ ID NO: 8289 - DNA, 293 bp, Homo sapiens
ccgggcacggtggctcacgcctgtaatcccagcactttgggaggccgaggcaggtggatcacgaggtcaggagattgagaccatcctggctaacacggtgaaactccatctctactaaaaaatacaaaaaattaaccgggcgtggtgtcgcgcgcctgtagtcccagctactggggaggctgaggcaggagaatggcatgaacccaggaggtggagcttgcagtgagccgaggtcgcaccactgcactccagcctgggcgacagagcgagactctgcctcaaaaaataataaa

SEQ ID NO: 8290 - DNA, 3451 bp, Homo sapiens
gcgggtccgcatcatcgagccgctgctggtcttcctcctcgcctacgcagcctacctcactgctgaaatggcctcgctctccgccattcttgcgtgagttctgggggccttgcaggcagatagctgggagggggcactggagatggttgcccctcatagggacacaggcaggaacttcaggagtccataggtttccctgagcccttgtggtagtgggagcctcagactgtcctggggagtcagtaaacctcagcaatatttcaggagctgcccccagagctgtcctcagcaccctgaaaccctctgggtgtaggctgggctggaagtagactttaaggcctggggccaccagctctggaggccgcagcactccagaaggtgcattagagagcccgctagtcagagcacgttccttccaccttcccttccaggagacactgaatgggaagcctggagatctggactcttagcccagcactaccattcaagtcttcaggcctccctgggcttcagctctgagagtctgacatcctgtaatgggcaatgccccctcctgcagtatgctcaaaccctggaggctgagccccctggaacccttccccacttgccatgtctctccatcctctcccagggtgaccatgtgtggcctgggctgtaagaagtacgtggaggccaacatctcccataagtcacgcacaactgtcaaatatacaatgaagactctagccagctgtgctgagaccgtgatcttcatgctgcttggcatctcagccgtggactcttctaagtgggcctgggattctgggctggtgctgggcaccctcatcttcatcctgttcttccgagccctcggtattgctggcaccctctgctttcccactctccttcctgtcccgcccctccctgcagctcatctccctatctgagtccacatctttgtcaattcctaagcctcctcttgttgctcacctgtcccagcccctgttagacctcagcccagatacttggtcccatccggtcccacgtcctccactcccaacgctttgctcccactggcctccctcccgctgtaggcgtagtcctgcagacctgggtgctgaatcagttccggctagtccctctggacaagattgaccaagtggtgatgtcctatgggggcctgcggggggctgtggcctttgctctcgtcatcctactggataggaccaaggtccctgccaaggactactttgtagccaccactattgtagtggtcttcttcacagtcatcgtgcaggtgggagtgcccacaaggctgggtagggagagggttgggcaggccctgggggagtcttggagcctgtgggacaggggcttctcttcccgctgggagatggagggccctgacttcccagaccttgagtgcagtggggtaggggtactgaagctgaagcctcattacggggagagaaaggcagcagggaactgaataggaatagggcagggctcacctcctgcctgtccatagggcttgaccatcaagccactggtcaaatggctgaaggtgaagaggagtgagcatcacaaacccaccctgaaccaggagctgcatgaacacgtgggtatcagaaccccagccctcgcctgtccctctcgaccttctcctattttgggcagagtcctgatccagtccccctacccaccccccttctagacttttgaccacattctggctgcagtggaggacgttgtggggcaccatggctaccactactggagggacaggtgagggagctgccccgaggctccttcagcagcagcagccccaccagccagggaagcatgggggatgtgccacacttctgagaagggacagagccaggttcaggctgggtgacctctgccctgaagcccttcagtggcatcccagtgctctcaggttaagacaaggctccccagtgtggcctgcttggccctgcatggtttggcaactgccagactccagcctcatcatgctctgctctgtctttgactgtctgcctgctaattccatggaccctgtcttagatcctcaggacccaccatgctcccccagcctggccactgggaccttctctgtactagaacactccttcacctccctctcacttactcagcttcgattcatccttcacaactcaccataggcttcaattccttagggaggacttccctggcctccctggctaggacgtatctgtgtcatattctctaattatcctttgtagttcttgtcatggttgcaattttacagtgatttgtaataatttcagttactgtcagcctttcccatgacattgtaaattccatgagggcagggactagccttgagattctctctggctgaggcccatatctaaaaagccaggccagtgctgacggtgtccttgccccgtctgaggaagggccacctggccaggccttgggaatgggactcagggccgggcctggcatcctctgtaggtgggagcagtttgacaagaaatacctgagtcagctgctgatgcgacgatcagcctaccgcatccgggaccagatctgggatgtgtactacaggcttaacatccgggatgccatcagctttgtggaccaggtgggccagcagcttccaggtgggccagtggtgggtgggcagatggtcagcagagcaggacagaaaggggtggcaagcaggctggccctgagcagggagttgggaattcctagctggctccatggtctggtgaagtggcagcggcaggaagcagctgggtctggtgctgacattcagagtctggcaggcagtccagagaggtgggaaacagctggactctggggtcagctcaaccattatcacttccaagcttgtgaccttgggtaagcacactctctgagcctgtttccttagctgtaagaaagcaggcataagaggctgggcacggtggctcacgcctgtaatcccagcactgtgggagcctgaggtgggtagatcacttgaggtgaggagtttgagaccagcctggccaacatggtgaaaccctgtctctactaaaaatacaaaaactagccaggcatggtggtgcatgcctgtaatcccaactactctggaggctgaggcaggagaatcgctaaaatctgggaagcgggctgggcacggtggctcacacctgtaatcccagcactttggggggccaaggcgggtggatcatgaggtcaggagttcgaaaccggcctggccaacatagtgaaaccccgtctctactaaaaatacaaaaactagccaggcgtggtggtgggcacctgtagacccagctacttgggaggctgcggcaggagaatcgcttgaaccctggtggagtttgcagtgaggttgcagtgagctgagattgtaccattgcactccagcctatgtgacagagcaagactgtgtctcaaaaaaaaaaaaaaaaaaatc

SEQ ID NO: 8291 - DNA, 2100 bp, Homo sapiens
ccaccaaccttgcagctttttaagagcactaccaagaaccaccattggggaaatggttcttattcattgtttctgttggaatgtggtcttactttctggattttaggaattcaggttactcaatataaaactttgagaaatcagtgtgacttagtccttcaccttctaatataaagtgaagatttctttacagaagaattcatgtccttactgttaaagatgtaattttattttcaaaacatccataatatggctttcagaagcagttcatttttccaagattcctcacattatactagataaataataggcgctcagttaataatcttgggttgattgaattaatctagtttgcagagtgaggtgtacctaccaactttcgtctgctcccaagtgcactctgagaagtaaaatgctctgggaaatggaacaagaattgagtggatgctgactctgtgtgcccacctcctcaattgattgataatggctgaccttgggcaagtcacttctttcaatgcctcagttccccatctgtcaaatgggggtaataatactgacctacctcacaggggtgttgttgtgaggcactgtgaatcaagttaatagaatattttagggtcctctatggaggatgccttgagctggagtttaagcctgacacacaggctttggtcctcactgagctgtctccaagactggaactacttagtgactcggcaaattctctgccccccacccctcatcaaagctgctagttcagatgttgacagtgttttcatgaatattggcatcttactagtccagacttaattaggatgttgttggggaaggcatttaagattttctatgtcttgcaatcacagagggaggccatttcagattcaagaacattggattagggaatcgtgaggcagggatgctactgcttatttctctctgcaggttggggattaaagttccattctccatgggtttgaagcagactcagactgtctcaggatcaaagcaaccttcaatggttttgatttatgtcatttcttaccactccccaaactgatcccaggacagctgggtgactgtacccttttgtggtatctgtaccctctccttcctcatagggaccagctgattgaataaatgtgaccaccttgtttccacccccctcaaaaagctaccttggaattatttttcctagaagtgtgtataacactcagaattggacattgatccttaaagcttcatccgattccctgtattcagtatctgtcatctctttctcagtgtctgcagtctgaacctaaccttgaccttttttccctctggtttgagaaaactttggacactatttctacttgcccaggtgtgggctcaagagccttactctttccatctcagtttagaggcacagccagcttctcttcccaatacagctctttctcctttctctctccttggccctagaattgtaatccatgaaaaagcacaaggtcctggctccttgcagtcacattctggttctctgtgttttgtggactctgttctcactgttcacccagcactggcagtaccagacggttctgaggagtcctggggaatggagagaccacagtctgacgtcctgccaagtagccagtagtttacttgcccatggtccgctggctttcccaccacttcctacaggatgggatctaagagactcaagagctggatttctttcagcactctgtaccatcccgagtagcagacaaatcactttgtagccagatttctgaatggaaatgagaaactgaattctctgtggactttcaggtttatgggggagttttggttgtgtttcttggttttatttcagacaaatgtgtctgcctttgatttttaaataaaagcataagtggtctatatatatgttcaccttttaaatgtaaatgtttaaaaagtaagcatttatgtgtttccataactgatatctgatgcagacctcattctctccccctcttctaccctcctattttccctcttttcatactcttgtattggttctaataaatggttgcttttcaaaaaaaaaaataaagaaaattataaaatagaatgaaagta

SEQ ID NO: 8292 - DNA, 1363 bp, Homo sapiens
ttgactcggaaatcttcatcccaccctccaaaaggttactattggcattctttttaagcttctttgttcatatgatagttcgggagaggaacagagattcagatagagagacagcggaagacacagaaagagacaaagagagaaatgccttctcctctcttgagttccgtgaatacaaacactttccctactcctctttgcagtcgtagacccgttgcagggagattctcagtgccagttgtctggattttgtgaaggtgctcagggtatatagtgcagtggttcagaattgggggtgactttgccccccctccccagagacatttagtgaggtctggagaaattttgggggctgctacagacatctagtgggtagaggtcaggggtgctattaaacatgctgcaatgcatgggacacccccaaacaaagaactacctggcccaaaatgtaaatggtgctgaaatggaggacccctgatctagttggaatggagacagagcattactggaacatagtgagttgccaggtttaactcatcttcacataagtaccattgagcaccaactgtatacagaacatagtgccatgcatttcacagaacgcctggtttaaggagcttcagtctataatgggaagaggaaatgggaaagcagtgcttatccaggagacactgttggacaccatccatatgtgttctgaaccaacatcacaacagccatattatgagacaggcatgattcatacccattttaaagataacctgaagcccaaatcactcaactataaggtggtagaggaaagatttaaacctggagctaagtgattccaccacccatgttctcatgatgctcttgattaggcagatgaacaaatatacaaataattatgatacaggacatagtaagagcagtgctacaagagagatgcaaatagagcttagagcttagggtgggattaacagactacatagaagaggtggcttttgacatgcattttgggtgagctgtaggatgaggggaagaagtttcagacatggagatgcatgaatgtatatacacagagaggccaggcgtggtggttcacacctgtaaccccagcactttggaaggttgtggagggcagatgacttgagcccaggagtttgagaccagactgggcaacatggcgaaacctcatctctacaaaaaaatataaaaattagccaggtgttgtggcatgtgcctgtagtcccagctacccagtaggctgaggtgggaagatcacttgagcccaggaggtcaaggctgcagtgaactgtgatggcatcattgtactccagcctgggtgacagagcaagtgaagaccctgtctcaaaaaaaaaaa

SEQ ID NO: 8293 - DNA, 4018 bp, Homo sapiens
tagtacagacgtgtaaatccttccaccccgacccgcacacacacccacactgctgccctggcgggggccatgggggtgatgaatgaccctccaacagccccacatgggttgtttctgtttctttggcttttctcgctccgcagtggagggtttactaggatttaagcttttgagtgcattgagaaccaagacagggcctggctccaactctgtgggccagaggtgggggactgctaggtcgagtctgcagcttcgccagtttcttggttgggacactcctctggcagccccagcaccaccacaaccccttgcagtgtgccccagtcccctggattcgctggactgcaaaaaggagcaccagggaaagctcagcaaaggctcaggaggcctcccgggtcctcgggagatgaagcatccgtgcctaggaaaaggggacagagggcaaggagagaagtgagagctacaattccagcattggagaagcgaggggcggggcgtcaacggcactgcttcaggacgcgcttgctgaaacgactccaacagctagttcacagcccagctttgtacgttggttaccatagctactgctgtcactgtagctgctcccgtagggtcgttgattcctgaacgtatcacatctcacctgcccccttcctcgtgggacgtgtcaagttgactttaaagcctaaggtggcttgtggggactgcaccagaaagtgtctaaccttgtgttccccgaaatcctttctctgacttaggaaccagcgccccctgctggagaagttttttcattttgttagccgacttctggtagcttagcaaagagaccagctgactgtctctcggcccagcccaccacgccgagtagcttgtgtggatgcagtcctgtgagggtgtgcataaccgttcccaggtgtacgcacgcgcgcgcgcgcgcacagacacacacacacacacacacacacacacacacacacagtaaccacgggtaggcaccaggggctttgtacattcaggagctgcagagaggaaaggtctcccatgtaccagagaaggaaaagtctgatcccgaaacagcttgaacgaaaggtggttaacacgtgaccaatccccatggcagacagcgggctggtgaacaggaagagcacagaatctctgtggggcgatgctgcagcggctgaaaccacgtcaagtcccccagagcccggcattctatgtaagcatccacctgtgacgccgtggagcaggatcttcattcatctcaccagagcaacagcccagtcctgaggatgggagggacgtgacttagccttgggattccacgctcgccgccctcccttggccgccctactccccagtttcctggcgatgagccatttattgtgtctcacaccagcctcatttccaactccgacttcctacttagaatgtggcagtggctttgtgagtgagaatcctgatgagttttccagtggcctctgcagaagctggcccccttctaagggcatagctaacccccttcccactcctgagtcactgaattcgaggagggtggggcagggaaagggctggcccccctgctgaaatcttgattctgcatttgaggaaggtcagggtgccgctgggggagcagggagcggggagggaggaagaggggaatgcacatcttttgcgccactattaaggcacctgtcaccttacatctcaatctggaatcaaagtgccctgggttgagaagcagacctgggctctggtcacactttggtcactcattagctctaggaccagtcactaatctctgagactccattttctccagggaaacgaggcttgcccagatagactaacaaccctttagtgctccaagaagtgagaatttccgaaaaagatctgccggcccagagcactccctcttgccctaatcctggcagggtctggatgtatttacccaactctgatcttgcgtgcagggatgcttgctgatggatgaaagaccacaataaaacaagattagcagcaaaacaattttaattgtcagtgaaaagcaaacatgtttgtcagactctcctgtggagtcatttcaaatggtaactcttctcttgtaccaggaagcagctgtaggtggggtaatgggatctgtctcctggtgcagaggggcagcttatggcggcagcagcttcaacaagcccgtcccacggccagccctaactgggccaagtgcaagctcctgatgagctgctgggcctggcagcgttccccacttcctagtgccttgctcccctggaattccacagccaatcaaccacagcagccgtgtcctccttgccagaaataacatcattcgtacgtcctgcctttgtaaaaatcaagacccagttaaccatcacccacttcttgcccctgattgatggggtccctgagtacaagcgtcctgtgcaatcccctccctcctaccgctttcctagctaagccctgctagccccacaaatcagaatctgggtttggggtgctggagagatggtgggccccagctcttccccacatagcccacgctgctcagggcacggtctccaaccaggctcgagattgcctgcctgcccgctgcagccgcagggccccaccctgtggaaaaggaagcttcccccactcaactgcactgtccttttctgctgtctagtctgtgctaagggacactacttgtacacttttcaaacggtgccctaaattggaagagaaggaggggccaggaacacagccctctccgccgtctttctccacctccacttcaccactcctgctctagacttcttgtcttgcatctttgataacttggagtcataaccgagtggatgtcggaataaatgagagatttgaagtagaaatcccacagggtccttcgttcttcaccgggggaagtgaagggggctgttggtgtggatttaagggtgaagcctcctcttcaacacccagagcgtctgtgttccacgctctccctgctcccacggtagcaaacctccaccttgttgcctggcatgcccccattgcctcagtcagagttcaatcggcggagatttgctgtttgttgggaaagtggctgaagggccctgctgaggatagtgagtttccctgtggggcaacccaggcctcggcccctgctacctgcccttcccctcttcccaaccctgcacacacaccttccaggctggtggtcttcctgcctgtgtagctcagggtaaaatcacttctctgaagcctgaggagatcatgtcacatggccagccctttgttacaggggcagcaagggaagagaggggaattgggaccagatccccagtgcagcccagcagagactacagaagtggagagggatggagggggactggagaactgggaactagctttgtgtgtaggagggagaattcggggatgaagtgagaacgtcttttgtgtgtgtgtgtgtgtgtgtgtgtgcctgcacttgtgcacatgggtgtgtacgagacagctgctctctctccacctcagggcctcagggcgagccctgactgcagcttgggggtacagcaggcagcctgccccagcagtccagcacccaggcctccagccctgcagcagccttccctagcaccagtgggagcacagcttccttcaccctcggcccagggagcagttggccacagctctgtcaccacagctgttctatggaatcagaaaccagaccctgaggcacactcatcattgcatccatcccaacctccagccatctcctttgccgccgcagggcagccagcccggactcggcctccagcctctcacccggcacatctgcttggcctcatgcttgctggcaagtcacggccctgacccagctcttctccctggtggccctcaactgccttcagcctcagctccagctggggaggagggtggaagagcagcttgagtcagactgaggaatgcaagagaggtgctggccgtccttgtcactgttctttggaaaatgcctccatcagtgcct

SEQ ID NO: 8294 - DNA, 4014 bp, Homo sapiens
tagtacagacgtgtaaatccttccaccccgacccgcacacacacccacactgctgccctggcgggggccatgggggtgatgaatgaccctccaacagccccacatgggttgtttctgtttctttggcttttctcgctccgcagtggagggtttactaggatttaagcttttgagtgcattgagaaccaagacagggcctggctccaactctgtgggccagaggtgggggactgctaggtcgagtctgcagcttcgccagtttcttggttgggacactcctctggcagccccagcaccaccacaaccccttgcagtgtgccccagtcccctggattcgctggactgcaaaaaggagcaccagggaaagctcagcaaaggctcaggaggcctcccgggtcctcgggagatgaagcatccgtgcctaggaaaaggggacagagggcaaggagagaagtgagagctacaattccagcattggagaagcgaggggcggggcgtcaacggcactgcttcaggacgcgcttgctgaaacgactccaacagctagttcacagcccagctttgtacgttggttaccatagctactgctgtcactgtagctgctcccgtaggtcgttgattcctgaacgtatcacatctcacctgcccccttcctcgtgggacgtgtcaagttgactttaaagcctaaggtggcttgtggggactgcaccagaaagtgtctaaccttgtgttccccgaaatcctttctctgacttaggaaccagcgccccctgctggagaagttttttcattttgttagccgacttctggtagcttagcaaagagaccagctgactgtctctcggcccagcccaccacgccgagtagcttgtgtggatgcagtcctgtgagggtgtgcataaccgttcccaggtgtacgcacgcgcgcggcgcacagacacacacacacacacacacacacacacacacacacagtaaccacgggtaggcaccaggggctttgtacattcaggagctgcagagaggaaaggtctcccatgtaccagagaaggaaaagtctgatcccgaaacagcttgaacgaaaggtggttaacacgtgaccaatccccatggcagacagcgggctggtgaacaggaagagcacagaatctctgtggggcgatgctgcagcggctgaaaccacgtcaagtcccccagagcccggcattctatgtaagcatccacctgtgacgccgtggagcaggatcttcattcatctcaccagagcaacagcccagtcctgaggatgggagggacgtgacttagccttgggattccacgctcgccgccctcccttggccgccctactccccagtttcctggcgatgagccatttattgtgtctcacaccagcctcatttccaactccgacttcctacttagaatgtggcagtggctttgtgagtgagaatcctgatgagttttccagtggcctctgcagaagctggcccccttctaagggcatagctaacccccttcccactcctgagtcactgaattcgaggagggtggggcagggaaagggctggcccccctgctgaaatcttgattctgcatttgaggaaggtcagggtgccgctgggggagcagggagcggggagggaggaagaggggaatgcacatcttttgcgccactattaaggcacctgtcaccttacatctcaatctggaatcaaagtgccctgggttgagaagcagacctgggctctggtcacactttggtcactcattagctctaggaccagtcactaatctctgagactccattttctccagggaaacgaggcttgcccagatagactaacaaccctttagtgctccaagaagtgagaatttccgaaaaagatctgccggcccagagcactccctcttgccctaatcctggcagggtctggatgtatttacccaactctgatcttgcgtgcagggatgcttgctgatggatgaaagaccacaataaaacaagattagcagcaaaacaattttaattgtcagtgaaaagcaaacatgtttgtcagactctcctgtggagtcatttcaaatggtaactcttctcttgtaccaggaagcagctgtaggtggggtaatgggatctgtctcctggtgcagaggggcagcttatggcggcagcagcttcaacaagcccgtcccacggccagccctaactgggccaagtgcaagctcctgatgagctgctgggcctggcagcgttccccacttcctagtgccttgctcccctggaattccacagccaatcaaccacagcagccgtgtcctccttgccagaaataacatcattcgtacgtcctgcctttgtaaaaatcaagacccagttaaccatcacccacttcttgcccctgattgatggggtccctgagtacaagcgtcctgtgcaatcccctccctcctaccgctttcctagctaagccctgctagccccacaaatcagaatctgggtttggggtgctggagagatggtgggccccagctcttccccacatagcccacgctgctcagggcacggtctccaaccaggctcgagattgcctgcctgcccgctgcagccgcagggccccaccctgtggaaaaggaagcttcccccactcaactgcactgtccttttctgctgtctagtctgtgctaagggacactacttgtacacttttcaaacggtgccctaaattggaagagaaggaggggccaggaacacagccctctccgccgtctttctccacctccacttcaccactcctgctctagacttcttgtcttgcatctttgataacttggagtcataaccgagtggatgtcggaataaatgagagatttgaagtagaaatcccacagggtccttcgttcttcaccgggggaagtgaagggggctgttggtgtggatttaagggtgaagcctcctcttcaacacccagagcgtctgtgttccacgctctccctgctcccacggtagcaaacctccaccttgttgcctggcatgcccccattgcctcagtcagagttcaatcggcggagatttgctgtttgttgggaaagtggctgaagggccctgctgaggatagtgagtttccctgtggggcaacccaggcctcggcccctgctacctgcccttcccctcttcccaaccctgcacacacaccttccaggctggtggtcttcctgcctgtgtagctcagggtaaaatcacttctctgaagcctgaggagatcatgtcacatggccagccctttgttacaggggcagcaagggaagagaggggaattgggaccagatccccagtgcagcccagcagagactacagaagtggagagggatggagggggactggagaactgggaactagctttgtgtgtaggagggagaattcggggatgaagtgagaacgtcttttgtgtgtgtgtgtgtgtgtgtgtgtgcctgcacttgtgcacatgggtgtgtacgagacagctgctctctctccacctcagggcctcagggcgagccctgactgcagcttgggggtacagcaggcagcctgccccagcagtccagcacccaggcctccagccctgcagcagccttccctagcaccagtgggagcacagcttccttcaccctcggcccagggagcagttggccacagctctgtcaccacagctgttctatggaatcagaaaccagaccctgaggcacactcatcattgcatccatcccaacctccagccatctcctttgccgccgcaggcagccagcccggacgtcggcctccagcctctcacccggcacatctgcttggcctcatgcttgctggcaagtcacggccctgacccagctcttctccctggtggccctcaactgccttcagcctcagctccagctggggaggagggtggaagagcagcttgagtcagactgaggaatgcaagagaggtgctggccgtccttgtcactgttctttggataatgcctccatcagtgcct

SEQ ID NO: 8295 - DNA, 8925 bp, Homo sapiens; identical to SEQ ID NO: 7271

SEQ ID NO: 8296 - DNA, 8924 bp, Homo sapiens; identical to SEQ ID NO: 7272

SEQ ID NO: 8297 - DNA, 2177 bp, Homo sapiens; identical to SEQ ID NO: 7269

SEQ ID NO: 8298 - DNA, 2177 bp, Homo sapiens; identical to SEQ ID NO: 7269

SEQ ID NO: 8299 - DNA, 3418 bp, Homo sapiens
gaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtcactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcaggaggcaggagaatcgcttgagcctgggaggcagaggctgcggtgagccgagatcgtgtcactgcactccagcctgggtgacagagactccatttaaaaaaaaaaaaaaaaaa

SEQ ID NO: 8300 - DNA, 376 bp, Homo sapiens
aaagaaggaaagaaaagaaacgagagagagagagagaaagaaaagaaaagaaaggaaagagagaaaaaggccaggcgcggtgactcaggcctgtaatcccaacactttgggaggccgaggcgggcggatcacaaggtcaggagatctagaccattctggctaacacggtgaagccctgtctctactaaaaatataaaaaattagctgggcgtggtagcaggcgcctgtagtcccaggtactcggaaggctgaggcaggagaatggcacgaacctgggaggcggaggttgcagtgagctgagatcgcgccactgcactccagcctgggtgacagagcgagactcacgtctcagaaaaaaaaaaaaaaaaaaaaaaga

SEQ ID NO: 8301 - DNA, 209 bp, Homo sapiens
aaccttttaacctttgtccttgcactttacaatctaaagatctacctgtggctctcagacttcctcacacttgggttttagaaataacttgtaaagcagactggacccaaggccgccttcagtgtcaagaagggcattgtgacttgcccctcaatttctgtccattgaagtctggttttccatgaggaacttgcgggctcacccacccc

SEQ ID NO: 8302 - DNA, 95 bp, Homo sapiens
ggaggcggagcttgcagtgagctgagattgcgccactgcactccagcctgggcagcagagcgagactctgtctcaaaaaaaaaataaataaataa

SEQ ID NO: 8303 - DNA, 8113 bp, Homo sapiens
cggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgcattgcctgccgccatcacctcttcctcaaaatgggctgtgggcgggtaggttcatcgctgtctatgtgctgccacagaattgctgagaccccccaggttagatccctggaagcagagccagaaagcagaaactgggggcacagggtttgtgggcaccccacccagatgggccggggaggcactggctgaggccaggagtctccccctggtcccaagggagggcaggctccagggggtgcacagcaccccagacagggggtccaacctgggcattggtacctgggccagttattatggcaggccccagtgtggggcaggaggcacccatgagccactaggagctgtggctggtgcaacagctgggatggggcagccacagcagccactaccggggagagtcaatggtggacaggggctgcgggagctgggacggccccacgtcaaagccacttcagggagcacagccctggcccagctggggggacaaggaaagctatgactgcaagcagcacagaagtgcagggtgggaagggatggcaggagccggccccctccccaccttccaccctgggacactgccgggacctccctcggccaggtgagcagcttcagaagcatgaccagtgagaagtccctagggcccaggccgggctagccaagtcccagtttctggatgaggcgcctcccaggctgtgtgtggcaggccccctttcttcagggaataagaaacatcttccacattcaagaaacaaagctggctgtgggtctggagagagggtgaggcagccccaggtctctgggtcaggcggacggtccctgcatgcagtgcccggcaggactgagcagggttcccggggtcgccggtacccatccctccccagcttccggggccccgggacggagccgctcacagaggcaccattcagacggccagacacacacgaaagctttatgtgcagggcccagcctctgggccgccttgcccaggtttccactcaagttgctatttaggatgaaaagcctttggcaagaccctccgccgcactaacgccccctcccccagggccagaacccgcagggaagcaggcccaggacctgctgcagctggcagggtggctatgagactcaggacaccctgggctcctggccagtgactcacagcggtcctccagcaagggcagtggctgggagacacccgtgccgtggagctaggcccagcctggctgggtctcagggctgcttctcttgggtgaccccagcggcccagggtcgttgtgaagatcaacgtggcttgtgggaggagcccggggcccagaaggaagtggggtcaggggctcaggctggccctcgggctgctctgacattgggtgggcactcgctggatggaatcacagttaacacctcgatcccaacacctggactcagaagtggacaggcgagtgcctgccccgggagaggaaggaggtggcacctgctcccaggggccccactgcagagcacggccactgtgagctgacgacagaatcacagtacagcaataatgtccctatcctcttccagaaccccagtggggccctcaggtcacgcaggacggagccagctgggtgggtcccaccaactcggcatgaatgagacgacggatgaaccgcagccccagcatcaggaggggcgcctgtgtcaacacccacgtgggctgggaccccgtgaatgccagtctggggccgacggacccccagggaaagcctgggtgcaggccaccttgtgcgctgcccaagcctgcaggccccgagaggtcagcctgaggaggcagcctcggctgccggtaatgctgcctgcttcatctgggccacctcccgctccaggtcctcgccggctcgctgcaggagctcacacctctgcctcagcacgttgcccgcctgctgcagccgctggttggcagccacgtaggcccggctttgctggtagagctgctctcccggggcctccgcatcctccatcatcctgaagggaactggggggtctgagacaggacacagcagcatcactgcctgctgaccaccccatcctcctgggcacccctcactactgcccccaaagggcagggttccctgcagtccccgagtgagcttgccagccggggtcttcttaacatgacggatgcagccaggtgtggtggctcacgcctgtaatccagcactttgggaggccgaggcgggaggaacacttgagcccaagagttagagaccagcctggacaacatagtgacacccccatctctaccaaaaaatacaaatacaaaaattagctgggcgtggtagcacgcatctgtggtccctacttctctggaggcagaggcaggaggatcgcttgagactgggaggccgaggctgcaataagctatgatcgtgccacggtactccagcctgggtgacagaatgagaccctgtctcaaaaataaataaaaacaaaaatcaagtaatggaggcttcctcgtccatcagctgggagaggcacagtggctgggtggcaggaggggcttccagctctaggctacccgccttagcaaagcgtgtgaccagggggatcgggtcacagaaagagctcaagcctcgccagcagtggccctcctgggggcggggcttccattcctgcaaaagccgtggcacccaccgggatggactccactgagctggcctggctctcattcctgctgtctctggaagccagagacgcaacaagcccgccaccgaaaacctctccaggggccgtgcaacctcctggagcacacacttagggaggcaggggtggcgaaggtgagaggtgggcattgacgtcctggtgactcccacattcagcagaaactacgtatggctccctgctcccccacgtatgcaagcccagtgcagcagggctgaagcagcaccgacttcagggtcactcagagaagcgtcaggggcccctcggctctggcctgcccctcggcagtgtggtctcccacggacgaaggctccacgtgccgcacgggtctgggctgatcaaatcacctctgtcatcacctgctttagcaacagggtgggaaaggccgggcagtgcctggatgaaggcacaggaggccccctaccttctgtgagcgccccccgtcccccgcacagcgtgcctcagtttcgccacactcaacggccatggacctgagcccatgaagctcaaaccacggccccagcaccctcaggtgaccgaactgcatgctgggaataaaaccaactcatgcaccttgaccagtaccggcccacagaaccttccagatgatgcgcacacctcccaccgatgctggtccacaccagccaccagccatgtgtggctcctgggcacttgaaatatgtctaaagggaaaacacaactcaatttttctctttttttctttttcagagacagggtctcactctgtcactcaggctggagactccaactcctgggcgcaagcaaccctcctgcctcagcctcctgagtagctaagaccacaggtgcatgccaccacacccagctagtttgtgtatttttggtagatataggttttgctatgctgccaaggctggtcttgaactcctggcctcaagtcatcctcctgcctcagcctcccaaagtcctgggattacaggcatgagccactgcacctggccccagaattttctaatattactttttaaaaatgttcccttagaaattcacagtttctatcattccacatggctcattttcttttttcttttttttttttgtttgagatagagtcttgctctgtcacccaggctggagtacagtggcacgatctcagctcactgcaacctccgcctcctgggttcaagcaattctcctgcctcagcctcccaagtagcagggattacaggcatgcgccaccatgcccagctaatgtttttgtattctcagtagagacggggtttcaccatgttggccagggtggccttgaactcctgacctcaaatgatccgcccacctcagccacccaaagtgctgggattacaggtgtgagccaccgcacctggccgattcatcttcatttgtttcccgccagccccagaacagcctggggcagacattcttgtttcttttgttcacttgtccattagcagtgctctaagcgcagagcccagcacacaggaagtgctcaagaaaaggattgttgaatgaatgaatgagcctcatccagaacacaaaattcacccaactgcactgctgaatcctttggtctctgactagcttccacctcgtaaatcaggagtggacaagctttcctgccaaaggctggagtctctgctcccactactcaactctgcccttctggtgtgagagcagccactaaccgtatgtgaatcatttggctgtgtgccgtaaacctttacttaccaacactgaaatctgaatttcatacctctttcaggtgtcagaaatgttctttttcacccacccccatttaaaaatgtgaagtccattcatagctcccagaccttaaaaaaacagccaggggcagggtttggggggccctagcttaccacctctgttttactttatttatttctatttattaattattattataattattgaaacagagtctcactgtggtccaggctggagtgcagttgcgtgatctcagctcactgcaacctccgactcccaggttcaagtgattctcctgcctcagtctcctgagtggctgggattacaggcccatgccaccacacccggctaatttttgtatttttagtagagacaaggttccaccatgttggccaggctggtgtccaacctctgacctcaagtgatccacccacctcggcctcccaaagtgctgggattataggcgtgagccaccgcaccggccacttatttatttttgagacacagtctggctgtgttgcctaggctgtatcctcccactttagcctccaagaagctggggctacaagtgtccaccaccacacccagtaatttttttttttttttgagacagtctcgcactgtcacctgggctggagtgcagtggtgcgatctcggctcactgcaaactctgcatcccgggttcaagcgattctcctgcctcagcctcccgagtagctgagattacaggcgcctgccactatgcccagctaactctgttttgtttttgtttttgtttttgttttgttttttcatttttagcagagacggggtttcaccatgttggccaggctggtctcgaactcctgggctcaagcgatcctcccgcctcatcctccgaaagtgctgggcttacaggcctgaaccacagcgcccggcctccacccctgtcagaagaaccctctgaaaatcggtcccactctacggaggagtagagggagactcggagaggatacggaccgtgcccatgttgcgggggttcccagggcgtggggtcaggagttaggggtgtgcttctctcccgtccccttgctgccggggtctcaggtccgcttttccccgggaccgggctccccctaccttccggggccaggatggtgaacactggatcctctgccggcgcaccccgcacatcctccaggatctgctccaccgtggggggcgctgggcgggtgggcagcagcacgcgcttctttgccttggagcccatctctgaaggcggggaagggggcgctgaccggggcgtccacctctccgcccttgcccgggctgctcctcccgcccagcgaactcgtacgcacccgtcgcggtcccgctcccggggaagcccgccctgtcccgcccctctgagctcgccccaggccctgaccctccctccgcccaaaaacacggtggccaaggcttcagggtctggctcaacctctgcctcagtttccccgcggtcaccccagtcgccggcctcttcccacctgggcgcgggacccgaaagcccagcgtcgacgacgca

SEQ ID NO: 8304 - DNA, 533 bp, Homo sapiens
ctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtggga

SEQ ID NO: 8305 - DNA, 99 bp, Homo sapiens
ttttttgtattttagtagagatggggcttcactgtgttgcccaggctggtgtcaaactcctgagctcaggcaatccgcccgcctcagcctcccaaagtg

SEQ ID NO: 8306 - DNA, 2227 bp, Homo sapiens
aaagaatcttctaggttgcattattaacgcttaaggcaaaaatgactatgacaaatggaaacctatttcaaattttgaaaggattttcaacttttgaaaacattggtagcagtgttatattccagcaatacttccttgcgatttttacgttgaacctgaaccttacaaattgtatgtttctttgaataaggaattcttacttaagtgactcaaagatcagttttgtattgttgtacatcacaggattacagaattgtcagtagcccgccgtaatttttacttttgggtacatgcgttgttgatcatatggctaatacctccctactgccattccatttcaaatcctgtttctctagggaaagtgggaagtgaggagtcaattcaggtgggtggagagtgggaagtatcttagagtatcaaccgttctttcctcttggcttcctcaggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcctctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggaactttgaaaaaccaacatagcatcattaatcaggaatattacagtaatgaggattttttctgtctttttttaatacacatatgcaaccaactaaacagttataatcttggcactgttaatagaaagttgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttctaattttttcaacatattgtttagtgtaaagaatatttatttgaagttttattattttataaaaaagaatatttattttaagaggcatcttacaaattttgccccttttatgaggatgtgatagttgctgcaaatgaggggttacagatgcatatgtccaatataaaatagaaaatatattaacgtttgaaattaaa

SEQ ID NO: 8307 - DNA, 4802 bp, Homo sapiens
gaattctctttttttctcccgccgattgctcggaagttggtctaaagcagaggttggaaagaaaggaaaaaagtttgcatcgagactggatttatttgcacatcgcagaaagaagagaatccaagggagaggggttggtgcaaagccgcgatcacggtgaggcacgtttggctcttcccctcctggcgccgcggccggcgcgttgtgggcaacatggagtaggtgcagccggaccaggagttgggtccgtctctccccgagcctccctttctcaaatcccgcagggtcttcgcgaggatccggggcgctccccgcggacctgcctcgcccggggcttgggctcggcctgcctctgcggggacttctgtatgcaccccgtgcagtgtccccgacaggcgaccccgcgcgcccgcgctctagggggttgggacggaggacagctagcctgaagtctgctcccagccgtgcactggccgcgaattcggcgctgagagcgggagagggagagaaaaacactttgtattttccaggttgcctttgcaggcgcccgcatttctaacctgttcttcctcttggtggaaggcaaagtccagggagaggctgtccctaggcggggcgctggtggggctgggggacacaggttgcccgcctcgggggcaggagacttccagggtgagaaaaaggcagggtgccgggtggagggagtgcccgcctctgctccgtgtggacagtctagcccggagcgggtgggagcgtcgccctgcctggcgccgggtctctgcggttcggaagtgcagctctctctcttccgttcttcgtggtcagcctgggtcacacttattttatttttggaagctcgggctgacccagcgcaggaagaaagtcatcaagcggtcgcgatcattttccattacctgaaagtaggtggcaaaataggcaattttttatttccttttgttgttgttgttgctgtgttttaatttggattcttgtgtgttttttacaaagcagtttctgtgtccgtttgccccaccctagagctgaagttcttttcccctaatcctcagtctgatcacacactgttcttaatgggggtttcaaagcactttcaaaggggaggggggactgggaaagagaagaggggcggaggtagggagtccagctttgaagaaggaggccagggatcggatcggcagaaatcacttaaaaaataaaaacaaaaaagcccccttttatttcaaagatgctactttgactgcaagcaaatctgcaccgaaagtttacagctccgggagctgggtcctgcgcgcccggagtgagcagtgggaccctggaaaatgccctttttttaaaaagccatttttctttcactttaagaaatatgatatcttttttttttctctcgacccaaaaggagataggcgtgtgcagattacaggcaatgcccccttcggtcagtgcagcgtggagtcgctgtgtgtgcgtgggttggacttgtgcgtcctggctgcgtgtctcaggcagggctttcgtgctcgcagtgtcggggtgggaaacctgtgccggatgtccgaggggctttgcagaaagcctggcagtgggcggcgtgacctctgcctgggggcggagtggctccttggggctggaaggcagttctcttgagttgggggagatcttagctggggagagggaggcgggggaagtgtgctcctgcatttcgtgacacgtacccttcggaggcgcccgcggcccccgcctgtctgagtctggggatcgtaagcaggggggcagcctggcccatggacagcgtcagtccgcctggagaaactcccctggggatcggctgtgtcccacctgctggggacggtgttggggcacagagaggcgataaactaagtgaaagcaaagagcagcgttgtcttctgccattcttttggaggtgaggagatccggtttccagcactgccttgctccgaattgggagacgtttgtcacctgccttgttcgctgtggcctctattctaaagagcggagatcggataaaggtccacttttgcctgttttatactttttattgtcatataggcttgggaaagggggtgatcgttttgaaattgaagaaggactgcagtttaaggaattccttgacagaatgctagatacgaaatgtgacatttgaatttttaaaacgcttttctggttattatcacttcgtttgtgttctcaattagcagggagaacaaccttttagctgcagaatctaaggtggtgttctaggctatcagactgtaaaatagttaattcttaagttgttgagaagttgaaaataaattcatgtcttcttcttgttaagtttgctttaatgtgtttctggcacctaataggatttgatttgcttttagttctataactttgtgctactatacaattaataaaaaatggcatgattgttgtagaatttgggtatttacttttttgcatgccatattcattctacctggtttgaaaaagttacagaatgccgtatacgtcacagttaaagtgtttgatgtaaaagtaaaaattaagaaccaagaaagaatcttctaggttgcattattaacgcttaaggcaaaaatgactatgacaaatggaaacctatttcaaattttgaaaggattttcaacttttgaaaacattggtagcagtgttatattccagcaatacttccttgcgatttttacgttgaacctgaaccttacaaattgtatgtttctttgaataaggaattcttacttaagtgactcaaagatcagttttgtattgttgtacgtcacaggattacagaattgtcagtagcccgccgtaatttttacttttgggtacatgcgttgttgatcatatggctaatacctccctactgccattccatttcaaatcctgtttctctagggaaagtgggaagtgaggagtcaattcaggtgggtggagagtgggaagtatcttagagtatcaaccgttctttcctcttggcttcctcaggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcctctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggaactttgaaaaaccaacatagcatcattaatcaggaatattacagtaatgaggattttttctgtctttttttaatacacatatgcaaccaactaaacagttataatcttggcactgttaatagaaagttgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttctaattttttcaacatattgtttagtgtaaagaatatttatttgaagttttattattttataaaaaagaatatttattttaagaggcatcttacaaattttgccccttttatgaggatgtgatagttgctgcaaatgaggggttacagatgcatatgtccaatataaaatagaaaatatattaacgtttgaaattaaa

SEQ ID NO: 8308 - DNA, 2227 bp, Homo sapiens
aaagaatcttctaggttgcattattaacgcttaaggcaaaaatgactatgacaaatggaaacctatttcaaattttgaaaggattttcaacttttgaaaacattggtagcagtgttatattccagcaatacttccttgcgatttttacgttgaacctgaaccttacaaattgtatgtttctttgaataaggaattcttacttaagtgactcaaagatcagttttgtattgttgtacgtcacaggattacagaattgtcagtagcccgccgtaatttttacttttgggtacatgcgttgttgatcatatggctaatacctccctactgccattccatttcaaatcctgtttctctagggaaagtgggaagtgaggagtcaattcaggtgggtggagagtgggaagtatcttagagtatcaaccgttctttcctcttggcttcctcaggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcctctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggaactttgaaaaaccaacatagcatcattaatcaggaatattacagtaatgaggattttttctgtctttttttaatacacatatgcaaccaactaaacagttataatcttggcactgttaatagaaagttgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttctaattttttcaacatattgtttagtgtaaagaatatttatttgaagttttattattttataaaaaagaatatttattttaagaggcatcttacaaattttgccccttttatgaggatgtgatagttgctgcaaatgaggggttacagatgcatatgtccaatataaaatagaaaatatattaacgtttgaaattaaa

SEQ ID NO: 8309 - DNA, 5325 bp, Homo sapiens
gccgcggccgccgcagaagctccctgcctcctccggaaaggcgagggcgcaggccaacggcgagccccccccgggcgggccccagacccttctcctcctcctcctcctcctcttcctcctcctccgcacccaccgcccccgcctcggcctcgctgcctcgcctccacaacgcccagtctgcaccgccgagagctgcgcgccgcagcgctagcggaggagaggggccggcggagcgcgcagcgcccaggcccccgcgcccgcccggcccggcccggcccgcgcccccgcgccgcctccgctacgacgcggccccggccgcaccacttggcgatctggctttaggttctccgtaaggccgttttcttttcccattcgctcatctgccagaaaaagggacttgccgttggcgcttcggcctcttgttcattgagaaaaaagaggaaatactccgcgtgcgcttgtagaaggggagtcgtctccagctccgaaccccggagtgttcatcagcggggaatctggctccgaattctctttttttctcccgccgattgctcggaagttggtctaaagcagaggttggaaagaaaggaaaaaagtttgcatcgagactggatttatttgcacatcgcagaaagaagagaatccaagggagaggggttggtgcaaagccgcgatcacggtgaggcacgtttggctcttcccctcctggcgccgcggccggcgcgttgtgggcaacatggagtaggtgcagccggaccaggagttgggtccgtctctccccgagcctccctttctcaaatcccgcagggtcttcgcgaggatccggggcgctccccgcggacctgcctcgcccggggcttgggctcggcctgcctctgcggggacttctgtatgcaccccgtgcagtgtccccgacaggcgaccccgcgcgcccgcgctctagggggttgggacggaggacagctagcctgaagtctgctcccagccgtgcactggccgcgaattcggcgctgagagcgggagagggagagaaaaacactttgtattttccaggttgcctttgcaggcgcccgcatttctaacctgttcttcctcttggtggaaggcaaagtccagggagaggctgtccctaggcggggcgctggtggggctgggggacacaggttgcccgcctcgggggcaggagacttccagggtgagaaaaaggcagggtgccgggtggagggagtgcccgcctctgctccgtgtggacagtctagcccggagcgggtgggagcgtcgccctgcctggcgccgggtctctgcggttcggaagtgcagctctctctcttccgttcttcgtggtcagcctgggtcacacttattttatttttggaagctcgggctgacccagcgcaggaagaaagtcatcaagcggtcgcgatcattttccattacctgaaagtaggtggcaaaataggcaattttttatttccttttgttgttgttgttgctgtgttttaatttggattcttgtgtgttttttacaaagcagtttctgtgtccgtttgccccaccctagagctgaagttcttttcccctaatcctcagtctgatcacacactgttcttaatgggggtttcaaagcactttcaaaggggaggggggactgggaaagagaagaggggcggaggtagggagtccagctttgaagaaggaggccagggatcggatcggcagaaatcacttaaaaaataaaaacaaaaaagcccccttttatttcaaagatgctactttgactgcaagcaaatctgcaccgaaagtttacagctccgggagctgggtcctgcgcgcccggagtgagcagtgggaccctggaaaatgccctttttttaaaaagccatttttctttcactttaagaaatatgatatcttttttttttctctcgacccaaaaggagataggcgtgtgcagattacaggcaatgcccccttcggtcagtgcagcgtggagtcgccgtgtgtgcgtgggttggacttgtgcgtcctggctgcgtgtctcaggcagggctttcgtgctcgcagtgtcggggtgggaaacctgtgccggatgtccgaggggctttgcagaaagcctggcagtgggcggcgtgacctctgcctgggggcggagtggctccttggggctggaaggcagttctcttgagttgggggagatcttagctggggagagggaggcgggggaagtgtgctcctgcatttcgtgacacgtacccttcggaggcgcccgcggcccccgcctgtctgagtctggggatcgtaagcaggggggcagcctggcccatggacagcgtcagtccgcctggagaaactcccctggggatcggctgtgtcccacctgctggggacggtgttggggcacagagaggcgataaactaagtgaaagcaaagagcagcgttgtcttctgccattcttttggaggtgaggagatccggtttccagcactgccttgctccgaattgggagacgtttgtcacctgccttgttcgctgtggcctctattctaaagagcggagatcggataaaggtccacttttgcctgttttatactttttattgtcatataggcttgggaaagggggtgatcgttttgaaattgaagaaggactgcagtttaaggaattccttgacagaatgctagatacgaaatgtgacatttgaatttttaaaacgcttttctggttattatcacttcgtttgtgttctcaattagcagggagaacaaccttttagctgcagaatctaaggtggtgttctaggctatcagactgtaaaatagttaattcttaagttgttgagaagttgaaaataaattcatgtcttcttcttgttaagtttgctttaatgtgtttctggcacctaataggatttgatttgcttttagttctataactttgtgctactatacaattaataaaaaatggcatgattgttgtagaatttgggtatttacttttttgcatgccatattcattctacctggtttgaaaaagttacagaatgccgtatacgtcacagttaaagtgtttgatgtaaaagtaaaaattaagaaccaagaaagaatcttctaggttgcattattaacgcttaaggcaaaaatgactatgacaaatggaaacctatttcaaattttgaaaggattttcaacttttgaaaacattggtagcagtgttatattccagcaatacttccttgcgatttttacgttgaacctgaaccttacaaattgtatgtttctttgaataaggaattcttacttaagtgactcaaagatcagttttgtattgttgtacatcacaggattacagaattgtcagtagcccgccgtaatttttacttttgggtacatgcgttgttgatcatatggctaatacctccctactgccattccatttcaaatcctgtttctctagggaaagtgggaagtgaggagtcaattcaggtgggtggagagtgggaagtatcttagagtatcaaccgttctttcctcttggcttcctcaggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcccctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggaactttgaaaaaccaacatagcatcattaatcaggaatattacagtaatgaggattttttctttctttttttaatacacatatgcaaccaactaaacagttataatcttggcactgttaatagaaaggtgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttctaattttttcaacatattgtttagtgtaaagaatatttatttgaagttttattattttataaaaaagaatatttattttaagaggcatcttacaaattttgccccttttatgaggatgtgatagttgctgcaaatgaggggttacagatgcatatgtccaatataaaatagaaaatatattaacgtttgaaattaaa

SEQ ID NO: 8310 - DNA, 329 bp, Homo sapiens
tctaacttggttttcttttttttttttttgagacggagtctcgctctgtcgcccaggctggagtgcagtggcgcgatctcggctcactgcaagctccgcctcccgggttcacgccatcctcctgcctcagcctcccggctagctgggactacaggcacccgccaccacgcccggataatttttttgtatttttagtagagacggggtttcaccgtgttagccaggatggtctcgatttcctgacctcgtgatccgcccgcctccgcctcccaaagtgctgggattacaggcgtgagccaccgcgcccggcctctaattcagttttttaa

SEQ ID NO: 8311 - DNA, 98 bp, Homo sapiens
tctaacttggttttcttttttttttttttgagacggagtctcgctctgtcgcccaggctggagtgcagtggcgcgatctcggctcactgcaagctccg

SEQ ID NO: 8312 - DNA, 329 bp, Homo sapiens; identical to SEQ ID NO: 8310

SEQ ID NO: 8313 - DNA, 434 bp, Homo sapiens
aggggaacagaaaaggggagaggtagacttgaaatggattctggataaagtcttaaaacctgcaacttgtttttcatgctaacactgcgtggcccagattagtcttaaatgttcattcccctttcctggtggcaaggagaaagttccctaagtcagctcgagcctctggctcgtcctcattgcctctgggcaaaccttaaggtcagtgtttccttgaaactagataaactgaccctgcagtgcccagcccggccccgcgggcgccccgcgtgacggcgctcgggcggcaggaccggcctggggacgcgcggggcggcgcggttgcccttttgaatgcctcctgcggctcggagcgctggcgggcgctggagtgtgagtgaatgtagccccgcggagccaatgagctgggaccggatgcgatatatcctctggga

SEQ ID NO: 8314 - DNA, 5711 bp, Homo sapiens
ttggttttctttttttttttttttgagacggagtctcgctctgtcgcccaggctggagtgcagtggcgcgatctcggctcactgcaagctccgcctcccgggttcacgccatcctcctgcctcagcctcccggctagctgggactacaggcacccgccaccacgcccggataatttttttgtatttttagtagagacggggtttcaccgtgttagccaggatggtctcgatttcctgacctcgtgatccgcccgcctccgcctcccaaagtgctgggattacaggcgtgagccaccgcgcccggcctctaattcagttttttaatgggctctgatctctaaagtataactcattggtttgaatattgagcataaagtgatagtcaactgaaatttgaagaggatttgaattaagtatattaagtcctatgaaaataatttgtttaaagataaataagaaaattggagcccaggcatggtggctcacgcctgtaatcccaacactttgggaggctgaggcaagtgaatcacttgaggtcaggagtttgagaccaacctggccaacatgatgcaaccccgtctctactaaaaatacaaattagtgggcatggtatcaggcacctataatcccagctacttgagaggctgaggccggagaattgcttgaacctgggaggtggaggttgaagtaagccaagatcgtgtcactgcactgtagcctggacaacagagtaagactctgtcttaaaaaaaaaaaaaaaaaaaagaaaattggatttttcaagaagcttccaactaacctgttaaatgttgactttatctatataccagcatagaattaattttcaaaatatggaagattaaatatttatgtctaatagattaaaagcaactggcactcattcactgcattaaaaataatttcttatttttatttttattttttgagacaaagtcttgctctgtaacccaggctggagtgcagtggcgccatctcaactcactgcaaccactgcactgccgggttcaagagagtctcctgcttcatttcagcctcctgaatagctgggattacaggtgcgcaccaccatgcccggctaatttttgtatttcagtagagaggggttgcactatgttggtcacgctggtcttgaacacctgtcctcaggtgatctgcccacctcagcctcccaaagtgctgagattacaggcatgagccaccgcacccagcaattttatttattttttaggttattattttttgaggcagagttttgctgtgttgcccagactggagtgcagtggtgggattttggctcactgcaacctctgcctcccaggttcaagccattctcctacctcagcctcccaagtagctgggactacaggggcacgccaccatgcctagctaatttttgtatgtttagtagagattgtgttttgccatgttgaccaggctggtctcgaactcctgatctcaggtgattcatcacacttggccaaaaataactgttttaatgttgcaaattatctcacttgggaaaaaatatggaggaataacctcaatttcttaatctctatttaaagttcatgaaaaattataacatgataaatttgtaatccaatggccattattttgatgtgatagagtaaaagtatgatgataatgcaaacataactgctaagcatttaggggaattttaatcatttttgtggtttcttgctttttaattttttttaaacctgtggatgctctatatttgagattcatataagaatgacaacttgattgttgttacttaaaacattcatttatgtgttttgaggaggagattttaaggccctgccaaatttctgccatgttgtagcttgctctggggattgtctgtgaaagaagaaagccaaaacccaggcaagtaatcccaaccaaactttttgcataacttctttcttcagtatacttctgtctcaaggactacttgactccaggatatgtaagttaaggtactgatgatgtcagataaatgaatttgctcttgcacagtgctgtaaggtatttgataggcagttgatgggtttgatgtaatttattaacttttaagcatttaggtcaaaattttcaaaggtttaatggttttagagtttcacttgaagtcatacccacaattggccatttgtcttcctctcctaaatgtgcacaaggaccagggtataaacacagaagtttcaactttgaaaatgggctgaatttgtacagctcaaaaacaggtctgtcaacttgtggagaatattttacattgttttcataaagaaaacatataatagtaggttattaactagtcacgtcattattgtatcagtatccagtctctggtttgcaatatccgttaaggcaaaagtcatgttaatttctattttaatttggtctaatgcctcacttctttatgacatactaagggtgggtctccattgagtggagatcagattagaattttaacaaggcctatctgatttgacataaaactgatcatcagagtaaagctatacatctggagtatttcatcatgggtttggccattcacaagaggataagagtaagactgtatatgtcctatactgtagattttatttgtacaccacactgccactcccttttcaccacaagagacaactgtgtgaataatgagaggcaaaatgtgaataccgctgatgatactgcacctctggtcaaaatttaacttaatacattcatttaatttacaatcaaagaagaaaaaagggagatagaaatatagcaaaagaggaaaaaagtaacatttaaacttttttccacgcctagcaaatattttacatttttatttaatactacattttgattgattgacttaaataatttttaaaagtcagtcttatttggcaactcatacttttttttttttaaataaactgttaaaggagattagaaagaagccttggcctctggcttggctagatgagacatgtaaggcttcagcatcacttatgaatttatttctcaaaacagttgctaatacacagagatgaataaataatttgacttaatacaaggactcacttggaagagaatttgggcacagaaatataaatttggcatttcaacctagtttttggatgcctactgcttacaaattactgggctagttgatctaatgcaaaaggaaagcggtagcaactctaatgcaagacaggacttagaagcacaagcaagatgctatgagagtgcagaaattgagggaaacgttgatgcattctcgttagttggtttgatcgccatgtctttgcaatggtttcagatacttaaatacctcaagagtttttgctaagacagttgcaacagaattagcatcactcattaaataaaactatgctcaccatcccatatccacatcctaaaatgaattgtagaggtgtttaatgaatatgtgaacaactacatgttgctatgtgcattcttttttttttttttttggagatggagttttgctcttcttgcccagggtggagtgtaggggcatgatctcagctcaccgcaacctctacctcctgggttcaagtgattttcctgccttagcctcttgagtagctgggattataggcatgtgccaccacacacggctaattttgtatttttagtagagacggggtttctccatgttggtcaggctggtctcgaactcctgacctcaggtgatctgcccgcctcggcctcccgaagtgctgggattacaggcgtgagccactgcgcccagtcgctatgtttattcttaattttaagattcatgactcactaaaatcttcccttaaaaaaatacaaataaaaaaatactttttcaagatgtagaactaagaaacaagttgaaaagatctgtctattcttgttcttccagttcttgctggaatttaccttttgccattaacccatagttttagcttgcttctgaacctagagaaggatgaattggaaataatcaagttaggggggcaaaaaaaaaaaaaaagtgtaaatgatattgtgaaaagaagtggttgagctttggagcaattctgcccttgtcaaaaaatacccgagacctggctgctcaggctcacatgcctctcaaaacctatgtgaccctctccagttcctaggccaatgcaactttcatttttggaacagtttttgctccaaataaaatctagtttattgacttgcaccaatagtgtttacagtcaagcagggttccaataaatatcatgtttgtatcatctctcatttctccagattcctagtaggcatagtgcacccatcctggcctcaaacgcagatttcctcctccaaagtagtcataaaatagccaaaatatatctgtagctactcacactagaaggccgctcctgagtttcctattagaaagtcatgtttgtaagttcagaacagcatttaagtttgcatatctaggctgggtgtggtgacttatgcctgtgatcccagcactttgggaggctgaggccggcggatcacaaggtcaggaggttgagaccagtctggccaacatagtgaaaccccgtctctactaaaaatacaaaaaattagccgggtgtagtggtgtgtgcctgtaatcccagctattcgagaggctattcgggaggctgagacaggaaaactcgggaggttgcagtgagccgagatcatgccattgcactccagcccagatgacagtgcaagactctgccacaaaaacaaaacaaaacaaaacaaaaaatttgcatatctaatggccactgtgaacattataaaatgtagtgaccaagcagcctagcatgtatcaagcaatagcacatacaaagcctttggataaatttagtacctgctctgttggcaaagctaatggctaggatgccccaagagatgtttgtctctgacacatgactctagtagtgagtaactgactccaggaacatgggcaaccacacaatcaacatttgcatttaggtcttgatgtcacctggactctgacctacacaccattaggatagagcctaattgatttagttttgtttgaactgtaagtgtaagcttaaactttggaaatactgaaaatatgaattattttacagagtactggtttacttcaaaccatctgtgaaaagtcacatgatgtgactctgataatgtgtcatctgtttctttgcccttttacatgaacaaccaaaactataggcccagagtgtaattacttgtcactaatttagtatttattgtgtatcttcagtgtaaaaggtattatggtagatagggaaaaagcattcgttagatctatgactatgaacaagcaaatgaggaatgactgctcatgaccctttggaagctgattatctaggaattagattataaatcatagaaaatgactggtagccggccgggtgcagcagctcatgcctgtaatcccagcactttgggaggccaaggtgggatcacaaggtcaggagtttgagaccagtctggccaacatggtgaaaccccatctttactaaaaatacaaaaattagccaggcatggtggcaggcgcctgtagtcccagctactcgggaggctgaggcaggagaatcacttgaacccgggaggcagaggttgcagtgagccaagatcgcaccactgcactgcagcctgggtgacagagcaagactccaact

SEQ ID NO: 8315 - DNA, 2258 bp, Homo sapiens
tttaaatgagaagtactgactttgtaattaaaaacaaaaactattttaaaatgtgctaaattttggacctatctcagcctgagaaggtttttttctaaaaaggttcaggcatctttttattttcctactgctctccttacctgtgcacacctcattgcctgtatctgtgatgcctctatttggagggaacctgggttatgcctgggcctggtttactcccataacatgggttgctgtacttgcccacttaattgtgagctctatccatccaggaaagtaatctgttccttattttgaatagcgtgttcttagaagttcatgggttctaattgaaggaaactagagggaccccttccatccttcagcaagggtccccaaagataggcagggtgcccagagaatgcctcaactgctgagaactccaccctttcaggtccagtgcaggctcatctccagaaaagctgggttagagttgtctcactgtttgggttggaatattgtgatttctaggagtggaaatgcacttgctaatttagctatctcctctttataagacgctcatggaaataaagattagccataaaatacctttaatgagcttccaaattttatctgcaaggaacccagggcctgtggcattatactggtttgtagaagactcctgtggtgtctgcagaaactttctctggtgaatatctagaatttccattactttgaatgtgtacatgttattaatcaaggaattaatcatccccattctctttgattgaaagtcacattaccttggaaggacaaggtgttgtcaaatgggcaaggcagatcatatgttttcttttactggactccttatttttctaattacagcctgtgtatcctgtgctagagagcctcttgaaattaacttaatttactatcacacttgtaacatacccatttatttgggcctgtgaatatgtgtgcactccatttgattacatctaatgttctccctaaataaagagtacaattaattcattagaggatggtttgtttccaggggtaagtgccagtttatgatgattccatcaacacttgcaccacattaatttatttccaatttaatcagtgtttaaattgaactgggatcaggcagaacaaaacacatggttttgcataattataatggagcaaatggaaatagtcatagcacttcagcattagaaacctcactgcagaagcacagatgggttaggagatgttgattaaaaaagatgtctaggaataaatcctctgtaagcactgtattaaaatccaagtgcctgcaggacaagcgactttgcattaattactaaaaaatttcttattctgggtatagctttctgtagaaatcctacagattgagtaaactgtggaggcactccttttcatgctccatttaacttaaattattagctggttcagaaagttgtttcttcccagacttgtctaggaagttcaatatttagcaattacccctttgtgcttctcgaaccttctccaagccagtgtcgttgaaggacagatttgccatgtgggaaggtgggctaccttggaaaacagatttttggttcggagcttgtctgaaactctctagattaagaattgtggccgggcgcagtggctcgcgcctgtaatcccagcactttgggagaccgaggtgggcggatcacctgaggttgggagttcgagaccagcctgaccaacatggagaaaccccatctctactaaaaataggaaattagctgggtgtggtggcacatgcctgtaatccaagctactcgggaggctgaggccaggagaatcactggaacccaggaggcagagattgtgttgagccgagattgctccattgcactccagcctgggcaacaagagcaaaactccatctcaaaaaaaaaaaaaaaaaaaaaaaagagagagagaaagaaaaaaaaagaattgcactggatgggtttgctccttcaaaactaacaggagagagaggctgaacaaatggtgttcttcaggcaaggggcttcctgacgtgtagtcatttgttaactgcccgagttttggtcttagaatttcttttccctctcctcctcttccttcttaataaatcatcacaaatacagttgaagtctccccttccacactgtgttccatttctctccattcagagaacccctagagaaccaccccctttttttaaattaaaatttattttgaaataatttcaaacttagagaaaaatcacaagg

SEQ ID NO: 8316 - DNA, 300 bp, Homo sapiens
ccagaaagtgcctttacatttttgtcttggaacaactctgcaatttcatcttgatttaatatttctagtaataaagcatcttccgactccacattcttatctctgggcagacattttattcttaagaattgtagtgattgataagaagctaaatggaaatgattaacgtgtcaatgattaataattataacaacattcaaacacttagaaattatagtatttcatcagatgtctttttaaagaggcatttctggccagttgtggtggctgacctttgggaggctgagacggctggatcac

SEQ ID NO: 8317 - DNA, 577 bp, Homo sapiens
gacattgcaggtaagtgcagtggcataagcagaaggaagggaaggacatatttgggcacagtcattctgctaccaccaaaagcatctgcctattggtgaactttccacatggcttttctttcattttgctgctgcgcctttgctttgtattattggagctcagccttctccctttctattgtttttttttttctttatcgtatatacacacctaagtttttccatcttgcatcttcccacaatctcacttctccctctggctcctgccccgtctttctccttttgttcatactcagtctcaaaggaagagtctatagtcactatctccacttctccacctgccatttagctttccaccctctgcagccagaatttgaccctcagaactccactgaaactactctgtcaaaagctacaaattattgcctaattgtcaaagtcaatgggttatttttcatattcatcatatatggcatttaacattatagctctagattttgcccccaccttcctttatgaaactcaataccaaaaatctcacacagcaactcaatagcaaaaaaaaaaaaaaaaaaaa

SEQ ID NO: 8318 - DNA, 455 bp, Homo sapiens
gcactattcacaataaacaagatatggaatcaacctaatccatcagtagatgaatggataaggaaaatggggaatatatatacaatggaatacgattcagccataaaaagaatgaaatcctgtcatttacagcaacgcagatgtaactggaggtcattaagtaaaataaggcaggcccagaaagacaaatattacatgttctcactcatatgtaaaggctgaaaagagggatctcatggagatagagagtagactggtggttgctagaggctgggaagtggggaggttgaagagaggttgatgatgggtataaaaatacagttagatagaatgaataagatctagtgttcaatagtttggtagggtaactatagttaacaatctattgtatatttcaaaatagctagtagagaagaattcatatgttctcaacataaagaaaagataaatgtttg

SEQ ID NO: 8319 - DNA, 856 bp, Homo sapiens
gagttttattattttaccttttacatttaaatctacagtccacctggaattgatttttaggtatgacatgaggtagaggtcaatattgtttttgtttttttttttccccagatggatatcaaattaatccagaacaatttatttaaaagactttccctttccagctactctacagagccaattttgtcataagtcaaagattcatgtgtggatatgtttctggactttcttttttgtcctgttggtctctttgtaagtctttaagtcactctcttcattctcataacttgaaggtcttgctatctgatagtgaaagtcttccactgtgttgcttctccaagagtctcttggcttttcctggtcctttgcatttcatttaattttagaattagcttgccaatttctaccaaaaaaaaaagtgatggaattttgatacatgggatgaataaattaattggaggagaactgctatctttacaagattcagttttacaatccttgaacgtggtatgttcctccatttaaccaaatgttttatagttttccgtgtagcggtctcatacatcttgtgttagatttagtcctagagaactatactaatataaatggtaactttttaaattttcctttttttttttttttttttttgagacagcgtttccttcttgttgcccaggctggagtgcaattgtgtgatcttggctcactgcaacctctgcctcccagattcaagcgattctcctgcctcagtctcccaagtagctgggatttcaggcacccaccaccatgcccagctaatttttgtatttttagtagagacggggtttcaccatgttggccagactggtctccaact

SEQ ID NO: 8320 - DNA, 549 bp, Homo sapiens
gtttttttctgcatctatgaagctatataattatataatttttcatctttattgatatttatctttattcccatttattgatttggggatgttaagtcaatctgtctttcctgaaataaacttaacttgacagtgttatattattctacccataattatttttaagattttttttgcatctgtgttcatgagagattggtttctaattttcttatcaagtttggtatcaaggttatgctaaaaatcagctgggtgcagtggctcacgcctgtaatcccagcattttgggaggctgaggtggccggatcacctaaggccgggagtttgagaccagcctggccaacgtggtgaaaccccgtctctactaaaaatacaaaaattagctgggtgtggtggcacaagcctgtaattccagctacttgggaggctgaggtaggagaatcacttgaacccaggagctggaggttgcagtgaggcaagatcaggctactgcactccagcctgggtgacagagcgagacttcgtcccagaaaaaaaaaaaaaaaaaaa

SEQ ID NO: 8321 - DNA, 310 bp, Homo sapiens
gaagtttttttttttttttttttttttgagacagattctcgctctgtcacccaggctggagtgcagtggcgtgatctcggctcactgcaagctccgcctcctgggttcatgccattctcctgcctcagcctcctgagtagctgggactacaggcgcccaccactatgcccagctaattttttgtatttttagtagagacggggtttcaccatgttagccagaatggtctcgatctcctgaccttgtgatccgcccacctcggcctccaaagtgctgggattacaggtgtgagccaccacgcccggccaaa

SEQ ID NO: 8322 - DNA, 3647 bp, Homo sapiens
gtagcaatggggtttcaccatgctggccaggctggtctcaaactcctgacctcgtgatctgcccgccttggcctcccaaagtgctgggattacagatgtgagccactgcgcctagcctgaaaataatgtttaactcccatttatatgttaggctgctcagatatattaaacacatacacacacaacacacacacacacacacatacacactgcacaaggaaacagagggacaaagcaggaagtccaagtttccattaaaccagtctttaaatggttaaatttagtaggaaataaaggcatccttaatagaagttgagaagcacaattcaatagtgacacctaaaaaaaaattaagacttgattagttgaataaaatcaattgtgaacattgctcagttactggtgatgctacaggaaaaaaaaagtgatgccaggatagatttgttaggcttgtttaaaaaatacataaaattgttcattaataagactttaatatccagtttttatgtctgtgattaaatatcattttttatttttaaatggtatagtttttaaattttgaaacaattaattttgcataaatatttgtctatgtacatatatacatgtgtattcacatatatatatgaaggacacttagctatcttatttactgaagctaaagaagtaggtccttaaaaagccattgacaggtcttgagtttgcaacgtgactgtgaaacaggcatccttgttactcacacgtttgctgaaaggataacagaaagccctcgatagaaaaatctcactagattgtttataatttgttgatatttggagtatcttgagtggtaaactttaaatgtggatttattttttctttccttttaggatttggatctctccaatcttttttatgattaattgttcagtgtttatgcattattgcgaagtgataatgaaaatgctcaaactcagggtcctgcaggcactgtgggggaggcagtggggacgtgaggggattacagatccagtagaagccccccgacccccatctgcttccaccccatctccttccagaacaccaccgatagccacaccgaagagttctcccatttgctggttcccggacaaaaaagctgctgatcccttgagcacactgcagtgaagctcccagctgacatgtcctgtccatgtaaacagaacttcctccatgtaaacagaacttccagcattgtttgtgttttcctcttaactatgtactgacatccaagggttgttaggaatgtttggaaagtctaggtacaaaagagagacctaaataaaataaagcaaacaccagccaccataacaaaaggaccccagagataggcagcgcagggaacggaagactcaataaactataattgtggtatccaaagaattagtatagaaggcaaaatggaatcaaatatcatgatgaaaagtgtaaatgagggaataaggtcagaagagaacattcatttatatgatttcttctttttttttttaaccttttaaacctctatttaggttcaggatacatacgcaggtttgtgacataggtaaactcatgtcgcaggttgttgtgcaggttatttcatcccccaggtactaagcctagtacccaatagttattttttcctctccctcctcccacccttcaccctccaccctctgataggacccagtgtttgttgctcccctctttgtgtccacgttctcatcatttagcttccactcataagtgagaacatgcggtatttggttttctgttccctgcgtgtgtttgctaaggataatggcctccagccccatccatgtttctgcaaaacacatgatctcattcttttttatggttgcatagtattccatggtgtatatgtaccacaatttctttatcccatctgccatgcatgggcatttaggttgattccatgtctttgctattgtgaatagtgctgcggtgaacattcgcgtgcgtgtatctttatgggagaatgatttctattcctctctcctctggttgtatactcagtaatgggattgctgggttgaatggtagttctgtttttagctctgaggaatcgccacactgctttccccaatggttgaactgttttacacacccaccagcagtgtgtaagtgttcccttttctccacaaccttgccagtatctcttaatttttgactttttaataatagccattctgactggcgtgagatggtatctcattgtggttttgatttgcatttctctaatgatcagtgatactgagccttttttcttatggctgttggctgcatgaatgtcttcttttgaaaagtgtctgttcatgtcctttgccttctttttaatggagttgtttgttttcttcttgtaaatttgtttaagttccatatagatgctggatatttgacctttgtcagatgcatagtttgtgaatattttctcccattccgtaggttggctgtttactctgttgatagtttcttttgctgtgcaggagtgcttaagtttaattagatcctatttgtcaatttttgcttttgttgtgattgcatttggcatctttgtcatgaaatctttgcctgttcctatgtccagaatggtattgcctagattgtcttccagggttttttatagttttggcttttacatctaagcctttaatccatcttgagttgatttttgtacatggtgtatgtaaggaaggggtccagtttcagtcttccagagcagaactttctaacttgtgtgtgggtgttgtgccctgggcaggttaacagatccctccaactcgaggagtctgggtggctggagctctgcactggtcacctttggggtgagtagcctggccccaaagtgacatacaaacatcattttctgtgtgtgtcacagcctggagaaaggtgagaagtcccagatgatatcagtctaagagttttgtacttgacagaaaaagagaacaaagagccagtctggaggaaatcagcaagtgccttacatttttttcccaagctaggcttggtggctcatgcctataatcccagcactttgggaagccaacgtggaaagatagcttgaggccgggagtttgggaccagcctcggccaccgagcgagaccctgtctctacaaaaaataaaaatgaactgggcgtggtggtgtgcacctatcatatctagtctttggactagaaaaatctaaaatggtttggtaagactttgctgttgctttaaagcaatggtccccaacctttttggcaccagggaccagactggttttgtggaagacagtttttccactgataaagttgggggtatggtttcaagataaaactgttccacctcagatcatcaggcattcgattctcatacgcagcatgcaaccaagatcaccacgtgcacagttcaccgtaggttcactctcctacaagactccaacgctgccactgacctaacaggaggtggagctcaggcggtgatgttcgctcacctgctgctcacctcctgctgcgtggcccagttcctaacagaccacagacggatctgctggggactcctgcatataaagtaagtgtgtttggagggaaagtaactaatttaaagagattcccaccagccaattagaacaagaagaaaaaaaaa

SEQ ID NO: 8323 - DNA, 761 bp, Homo sapiens
gtattcccatgtcattactgtgatttttattattattagccctatttatatcccataatgttgtacataatgttttattatgtacaaaacctgtgagttttaccttcagtgaaattcctagaagtggaatttttaattcagatagtatgaatgtttccatgacattttcttttcttccttcactttattgtattttacttttatttttgacataattctaaatcatactcaggaaatactggtgtaccaatttacagtattgttactgatcgtgggttcttagattctcatgcagtggaaattgacatgagacagagaaagtgtcccagacaaggctttataatgggcttatgctggagcaggagggcagcggcacaggggcaggagttcccgggctggccctcgggacaggtgttcctggtgttttagggtgacatggatagtcatgaggtgtgtcagcagcattacacacgctagtggcaggcaccggggaacatcatgttagcacagatgtgtcatgatcagggcatggcagatgagcccctgaggagagggttttagtaatacaacaaggcaagaggtcaggatcgtcgttctgatcctgtatgcatgtgggcatcaggcttaactcccttgggtaagatttggggtggaacatggcttatcttgtttccctccctggtttgcatggtctggtgggcaggtgtgatggcgtgggggatgtatggaaaatacgggagtgggtacgggccaagctctgt

SEQ ID NO: 8324 - DNA, 710 bp, Homo sapiens
tgtcctaaagattggcttcggaaaactgaggtacagaaaattaataattaatgttcacatgctgtcaggaatactcagatgcgagggggcatctgagtccattttttgggcacttttgctttctgggatgctctcgtgcctaatgacagccctgcagctgcctgcatcctttctggtgggggtcaggcctgatgcgatgagatctgatgtgttcagtgaccttctagttaaggtcctgggccggccttgtattgctggggcttttatgtgtgctgggattaacaccagtgactgctgttatcagcatagatggcgtttgttctcatttcaggaccgtatctgagtaattgcatccattgtgatgtgccaccaaagagaaaagtactttggtcatactcgactatgtaaactaagtattttaagttaaggccaattccaatgcattttattacaattcagcatgaaacagttaacacggaccagtaacagtagagtgaaattagcatgaatagaaccaacattcttttccacatatgtaataataagggcacccaagcagatgttgtacggtcccagggaagaccacacaccttacatttccaggcttactgcacttgggattaagccaaggcatccaaagaaagaaaattttttttttttttttttttgccaggctggagtgcagtggtgcgatttcggctgactgcaac

SEQ ID NO: 8325 - DNA, 808 bp, Homo sapiens
aaagagggggcctccttccctggaggccatctgatgagggtcgatgggccagtttgagaaccatttgtggcaagcgtttaaatcccaggctgctttttgccccagtacctggtatccagccatcgattgatgtgctacgagagaagatgaaccaattttattattagcctgaacaaaacataattaggaggagaaatttgcttctgctgttgcagttgctgcagcaaagaagttacataaggttcattcggatgacttgggaacaccttccctacttccctattcctgttcccgtttctctggcttgaaccaagtaaatagaggtccagagcctccactctgccctctagaaattcccaagacagaaatgtgctcaaggagcagatctaagaccctcagcctatagcggacacggaacaagggcacaaatcgaataagtcagtgcattgtcatgatgaacatgtggacaaaggcaagaaaagggagaagggacaagagagaggagcagactggaggagaaggaataaagagctgaggcatagctctgctcctgtgatgttagaggaagggaaggtggaaaaaaaaggcattgaattattctcagacaatttcagaaggaccagatggattctggaaggaattaactctgttatgtcctgtactagtatcattactacactctaagatgggcaaacgaaaggatttggagcattttggcagatactctttgggtgattgagagggggaggtaggagggcatggctgttggggtgactatatgggggtcgcatttgggctgaaagttaag

SEQ ID NO: 8326 - DNA, 430 bp, Homo sapiens
agcacctggtcaggatatcccagtcatcacctccgggaagatgatgttccctggatagcccatacattttctcacctccatacctagctaacactgctgcatcagtcccaatgaccccacttcccatcctttactctctgagatctggatttgccttcaagatgcaccccccatgccactttcttaaggtagtcttctcaactccccccaaagaatgaactattatttttggggggcttccaaagcaaattgctttgaaattccaaaagatcatacattctgttttaatcatagtgggttgttaagctcctgcactagactataatgctacttgtggatagggactatgatttgtttatatctgtaacttccgtctcttgcctcttttccccagcatagagcagaatgactgccatacagtaaatcaaaa

SEQ ID NO: 8327 - DNA, 408 bp, Homo sapiens
aaattagctaggcatggtggtggcgcctgtaatcccagctacttgggaggctgaggcaggagaatcgcttgaacccaggaggaggaggttgcagtgagccgagattgcgctactgcactccagactgggtgacagagtgagactctgtctcaaaaaaacaaaaataataaaaaataaatttctgagaaagaaaatagtttctttttttttctatttttctgttttttttaaacctctttcctaattacttacaaggaaaaaaaagaaggcagccctccctctcaatctctcagttcttttgcttagaagacaaaagatccttcagaattagagaggaagaggggaaaagaaaaaaaaaaagattccagttaaaaatcttaaaaatcttcatcagggtcaaaaacctga

SEQ ID NO: 8328 - DNA, 14175 bp, Homo sapiens
gcgacgcggaaccgaggcggcggcggcggctgcggcggcaggaaatcggggctcggccccgccggcgcgcgaccccatccccatcccggtccctgcagagcgatccccgggcccagatatggacgcagcagagccgggtagggggtcggggatccgggaggggcctcccccgaccatcccctgcttcctacattgagggcacacacttgtcccgctccgtcctgagagccaggagaggagttcctgaatgggaaggacccagggatcctccattgtggggagccctgtgcccggatgggttcaggaccccagcccttcactccccctcccccttttgatccctcaccccagacgcctgggggagggggcccaggaaggggaagtgactgcttctgcttctgatttttgtgatgggggcagggtgccacgactgctgagggagagggcaacgcggtaggatccccacagggcccctctgtagccctggggagtcggcagtgctggtctaggccccttaggagagggggcaggggggcagcagtagaaatgtggcggggtccgacttggtgtttccggccgtctttgtgtctgtgttgtgtatgtggagtgtcattcggtctttatgtccctcacggcttcagtctctccatgtgtgtttctgccccaggctctgcctggctgtcccttgtgtatttccatctgtctagcccgtggttccattgtcagaccggctttcttctcgggacagcctggttgcatctggggcatctgttttgttggtttgcttctgggtgcaggcagacccagggagtgggtgtctctgttccccgagcagctgtctctggtctctggtggtgtgtgagtccatctgcctgcctcgagttggccccaaccaagccccccccagccctctctttctctctctcactcttccctttctcttccaccccctccaaatgagactggttgaggtgccgtgggtggagggaggcagtggttagcccatgtattacactcccctcccctaggactccccccaggtcctgagggcaggaagaggtacagtgacatcttccggagcctggacaacctcgaaatctcactggggaacgtgtgagtctgagcctggatcacccccaaatcctgccaagatgccccaagcccctaaccatttaggtgccttgcagtcccatttggaacctgtaacatctggacctacatacctaataaccagagaagtctaggatgggaccctccaaaatgcctcggtatcctaaaagtgtccccctaaatagactggaaatccccaaagtggtcctagaacccctacatatccttgtaaccccttaaaatatttgcgatccctataatcccactctatgaacctcaaagttatctggggcccttcagatgctttttcaagtcctatttaaaaaaaactcacctgattcccccaaaacaccattcttcagacctcccagacacaagagatgccacagaggtgatgtttgccacaaacaaccctaaggtccccagcaccccttggcaggacagactgggtgtaaggtggcatcctgacacacctttatcccccaggacccttgagatgctggctggagaccctctactctcagaagacccagaacctgacaagacccctacagccactgttgtgagtggggagtaggggaacagggaggaagacctcaagcagagggggccttaggaaggccaggcccctgccctgtttgcttctgaatactgtctccctcccgcacagaccaacgaagccagctgttggagcggcccctccccagagggtcctgtacccctcacaggtaggggggtctggaggccaggacagtggggacagacaggagtctttccttcaacaaatcaccactgatcccctgttccatgcaaggcatcgtttaggttttgggaatatggcagtacacacaacagatctcagtcccagccctcagggagaccccaggcagggtggaggctgaggtaggaggatcacttgaagccaggaattcgtgaccatgctgggcaacagtaagacaccatccctaccaaaagaaaaaatatttttttaattagctgggtgtggtggtgtgtgcctgtagtcccagctactttggaagctgaggctggaggactgattaagcccaggactttgaggctgcagtgagatacgattgtgccactgcactccagcctggatgacagagcaagaccatgtccaaaaaaatcaaacacaaggccggacgcagtggctcacgcctgtaatcccagcactttggaggctgaggcgggtggaccacgaggtcaggagatcgagaccatcctggctaacatggtgaaaccccatctctactaaaaatacaaaaaaatttagccgggcgcagtggcgagtgcctgtagtcccagatactcgggaggctgaggcaggagaatggcgggaacccaggaggcggagcttgcagtgaggcaaaatagggccattgcactccagcctgagcgacagagcgagactccgcctcaaaaataaaaataaaaaaacccatcaaacacaggccgggcacggtggctcatgcctgtaatcccagcactttgggaggccgaggcgggcagatcacctgagattgggagttcgagaccagcctgaccaacatagagaaacctcgtctctactaaaaatacaaaaaattagccgggcatggtggcgcatgcctgtaatcccagctactcaggaggctgaggcaggagaatcgcttgaacccgggaggcagaggttttggtgagccaaaatcgcgccattgcactctagcctgggcaacaagagcgaaacacagtctcaaaaataaataaataaataataaaataataaaaaataaaaaacaaaaaacagtgaatctgtaaaattgcaaccaggacaagtgatcccaaagtagtgtttggggagctgtgaggctgtaggacaggtgccactgggctggtctgggggcttagggaagacatccatagcagactagggtgcaaaggtcagaggtccatccatcttccccaggggaggaactggacttgcggctcattcggacaaaggggggtgtggacgcagccctggaatatgccaagacctggagccgctatgccaaggaactgcttgcctggactgaaaagagagccagctatggtgaggacctcttccgcccagccccagttaccaggcagtccccagaccccagctagacccagagcccggctctctcttcccccagagctggagtttgctaagagcaccatgaagatcgctgaagctggcaaggtgtccattcaacagcaggtagtcatgaccagacccccccggagagcccaagccccctagaaccccacctttgtcccccacagatcttcagtatcctcctacaccactctgtcttccccagagccacatgcctctgcagtacatctacaccctgtttctggagcacgatctcagcctgggaaccctggccatggagacagtggcccagcagaaaagagactactaccaggtgaggggggcagggtggaatgttacagaggtcaccctgctatcctgctgtccttcaggcctgatcccctcgtttcccagcaagctgggaggaaggcaccactaccaacgtcgccatttcattgatgaggaagctgaggcccggggatgcttgggaacttgcccaaggttacccagcaaagattcaagctgggcttcctgtgcaattgcaaaacttcactttactttttttcttgagacagaatatcttgctcttttgcccaggctggggtgcaatggtgcgatctcagctcactgcaacctccgcttcttgggttcaagcaattcacttgcctcagcctcctgagtagctgggattacaggcgcctgccaccacgcccggctaatttttgtatttttagtacagatggggtttcaccatgttggccaggctggtctccaactcctgacctcaggtaatccacctacctcagcttcccaaagtggtgggattacaggcgtgagccaccacgcccagccaaaaacttcgtttttgtttgtggggaggggaacgaggtgctgagtgttctcaggaggaaagccttggtgtctctgcttccaagcagaaaggatggggtgactacatgagacttctggactcaggggtcggggagagcaggtctggagaagaccccaggaggagaatactgactcagaaaagggtccagcctggcacggtggctcatgcctgtaatcccagcacttctgggggccaaggagggaggattgcttgagcccaggagtttgagaccaacctgggcaacatagtgagaccccctgtctctacaaaaaaaaaaaaaaagttttttaattagctgggcctggtgcacatgtctgcagtgctagctactaggaggctgagggtggaggattgcttgaggccaggagttcgagactaacctgggcaacatagtgagatccctgtctttatctaccaaaaaaaatttatttatttatttttttttttgagacagagtctcactttatcatccaggctggagtgcagtggcatgatctcagctcactgcaacctctgcctcccgggttcaagtgattctcctgcctcagcctcccgagtaggtgggactataggagtgtgccatcacatctttataatttttgtatttttgtagagacggggtttcaccatgttggtcaggctggtcttgaactcctggcctcaggtgatctgcccactttggcctcccaagtgctgggattaaaggcatgagccactacacctggccaaccaaaaaaaaaaaaaaaaagaagaaattgttttttaaattaactaggcctagtgcacatgcctgtagtcctagctactgagaggctgaggctggaggattgcttgaactcaagagttcaagttcaatgctgcagtgagccatgattgcccacttgcactccaacctgggcaacaagagcaaaactccgtctcgaaaaaaaaaaaaatagagtccagaggtggcaaagcacatggcgcaggaatggaaggactgggtggctgcttctgggttggccctaaggcagcgtctccatccccatccccaacccttgccagcccctcgccgccaaacggactgagattgagaagtggcggaaggagttcaaggagcagtggatgaaggagcagaagcggatggtgaggcttggaattggtggaagggtagggtgagagagaggccgggacgctgaccttctcatcatcccccagaatgaggcggtgcaggcactgcggcgcgcccagctgcagtatgtgcaacgcagcgaggacctgcgggcacgctcccaggggtcccctgaggactcggccccccaggcctcgccgggacctagcaagcagcaggagcgtcggcggcgctcgcgagaggaggcccaggccaaggtgggcacccggccccgagcccctgtagcgctgtggcgccccctgccctccactctcgcccacacgcgccccaccccgctcctggcctcccgtttccccaggcgcaggaggccgaggcgctgtaccaggcctgtgtccgcgaggccaacgcgcggcagcaggacctggagatcgccaagcagcgaatcgtgtcgcacgtgcgcaagctggtgtttcagggggatgaagtgctgaggcgggtgaggcccatccccaaggccatcctcccctcaccccgttggggccccgactgagtgccccactcctcgcccctaagccaccctggagacaccaggactaggccatttccctcgacagccagttcccgcccccagacccactgtctcggctccgccccatgaggtcctgtcccctggatgaccagcccctgctctgaccatgcctgggtcccctggccgactgccctagttcctaagccgcccaggtgcgtcccaaaccctgaccacgttcgcgtctctcaagccccgccccagctctggccctgcccccaggctcccaggctccgcccctccccaacctgctgtctccacccggcaggtgacgctgagtctcttcgggctgcggggggcgcaggcagagcgtggcccccgcgccttcgccgccctggccgagtgctgtgcgccctttgagccgggccagcgctaccaggagtttgtacgggcgctgcggcccgaggccccgccgcccccgccgcccgccttctccttccaggagttccttccctccttgaacaggtgggtcactggagcagggagtcgggaacgagccccggaatcgcgatgccaggctgttggcaccgcaggctggttactcgaggttagagaacgcaaagccttagtggaatttagtactccaggctctcgggggccataggagggtgaatgggttgtcccagtcctaggggcaggggcaggaatgtggggctactgtatttcaggggccacaatgccctgggtgtcagggtttgcagacccaagtgcttggagttggtacctagacatgatgcctgggtgccatcaccccaggccagtttcctgggattcaaaccttcaaacttctgtcttctcagctcccctctggacatcagaaagaagctctctgggcctcttcctccaaggctggatgagaattcagctgagccaggcccttgggaggatccgggcacaggctggcgctggcaaggtgagtgcaatgagggccaggtgggagtggtgccaggagttcgttccaccaacacataggtgggctgcaggagtggggtttgtgagcaggggaccatccttattgacctgtgccacctagggactccaggccccactccgggcagcgatgtggacagcgtgggtggcggcagcgagtctcggtccctggactcacccacttccagcccaggtagggataggacctggtcctgacccacactccacctgtgaccatcctccagcccctggccaagctctgaccctcaatctttaactatctttgacctctgacctaccccacacccctgacctatttcctcaacctctttttttacctttttaaaaattatttatttatttatttgtttgtttatttgagacagtctcattctgtcgcccagcctggagtgcagtggcgtgatctcggctcactgcaacctccacctcccagattcaagcgattctcctgtctcagcctctggagtagctgggattacaggtgtgcactaccacgccggctgatttttgtattttttagtagagacggggtttcaccatgttggccaggctgatctcgaactcctgacctcaggtgatccacctgcctcggtctcccaaagtgcagggattacaggtgtgtgccaccacgcccggccttttcttttcttttctttctttctttttttttttagggagacagagtcttgctctgttgcccaggctggagcgcagtggtacgatcttggctcactgcaacctccgcctcccaggttcaagcgattctcgtgcctcagcctcccgagtagctgggactacaggtgcctgccaccatgcctggttaatgtttgtatttttagtagagacaaggttttgccatgttggccaggctggtgtcaaactccttgcctcatgtgatcctcctgcctcagcttcccaaagtgctgggattacaggtgtgagccactgcgcccggcctatttcctcaacctcttgatccagcttatgaaccacccccctcaggttgctgacccaattctccaacccttaaccactgacctgtccaatccccctcctgacctctgaccccttgggaattagtgggtggttctggaagccctaaaaaccaggagtgcctcccatagcccaggaatctcccatgattcctctgaccccaggcgctggcacgaggcagctggtgaaggcttcgtccacaggcactgagtcctcagatgactttgaggagcgagaccctggtgaggctgaagcagggtaggtcaggatgggacagggcagggcaccaggcactcctgaccctgtctccctgcagacctgggagacgggctggagaatgggctgggcagccccttcgggaagtggacactgtccagcgcggctcagacccaccagctgcggcgactgcggggcccagccaagtgccgcgagtgcgaagccttcatggtcagcgggacggagtgtgaggaggtgtggcctgggttaatgaccaaatgacctttgctgacccttgatcatctccctgacctgagattcctacagcctttctgcccctgggacccaccctaacctgatgtctcccatgagcccccattccttgaggatccttgtaaccttctcttcccctactggtccctaatgacctccctgtccctgtgaccttccccacagtgctttctgacctgccacaagcgctgcctggagactctcctgatcctctgtggacacaggcggctcccagcccggacacccctttttggggttgacttcctgcagctacccagggacttcccggaggaggtaccctttgtggtcacgaagtgcacggctgagatagaacaccgtgccctggatgtgcaggtgctgccctgacccttcatcatccccagaagtgacctgaccgaatcgatggcctatcacgaaccaggtgtctgtttttcaccctcaccctgcagggcatttaccgggtcagcgggtcccgggtccgtgtggagcggctgtgccaggctttcgagaatggccgagcgttggtggagctgtcggggaactcgcctcatgacgtctcgagtgtcctcaagcgatttcttcaggaggttggtgctcaggacactgagggggacgcgggcaggagccctccacagcccacccacactcgtgttgcgccctccgttccacccccagctcaccgagcccgtgatccccttccacctctacgacgccttcatctctctggctaagaccttgcatgcagaccctggggacgaccctgggacccccagccccagccctgaggttatccgctcgctgaagaccctcttggtacagctgcctgactctaactacaacaccctgcggcacctggtggcccatctgttcaggtgtgcatgggtccctgagccttgaaacgcgacccttttccctggacatgcgactactaacttccctggctgacccctgacactgacctctgacctttgacctgtgttttctgaactctgaaccttaatccatgattcataactttgggtactgacccctgacctccagttctggatatgtggctgctggtctcagacgacttacacctgtgacatgggcaagtcacctctaggctggcctgcgtgtcccacccttaccctcagaccaatgagcttgcatcctgtaccctgacctttctcttcacaccatccccagggtggctgcacgatttatggaaaacaagatgtctgccaacaacctgggcattgtgtttgggccgacactgctgcggccgccggacggcccgcgggcagccagcgccatccctgtcacctgcctgctggactctgggcatcaggcccagcttgtggagttcctcatcgtgcactacgagcagatctttgggatggatgagctcccccaggccactgagcccccgccccaagactccagcccagcccctgggcccctcacaaccagctcccaaccgccacccccgcaccttgacccagactcccagcccccagtcctagcctcagaccccggcccagacccccagcaccacagtaccctggagcagcatcccacggccacacctaccgaggtaagaacccactgggcccacagctatggagagggccttatctctgttcaattctcttaccttctctttcaccttccttcctttttaaaatttccttcattctcttcctcccttcctcatttaacttatgttcattctggaaggaatagtgaggaatgagcagtgggcagtgatgatgtaacaaaaggggacagccctgcagaggtactaacatgggtgatcattcattcctccaacagaatatttattgaacatgtattttgggccaagcattgtcgtaggcattgcagatacatccaggagctaaatatccaaagaccctgccctctcagtgcctgtgttttagtggggaaagaacaaccatatacatgacacaaagtcagttatctggaatgtgatgaggtgatgatgataagggtaatggatcatgaaaaggtagagtaatggctgggcgcggtggcacacgcctgtaatcccagcactttgggatgctggggcaggcaaatcacctgaggtcaggagttcgagactaatccaaccaataaggagaaacctgtctctactaaaaatacaaaaattagccaggtgtggtggtgtgtacctgtaatcccagctactcaggaggctgaggcaggagaatcgcttgagcccaggaagcagaggttttagtgagccgagagcatgccactgcactccagcctggacaatagagcaagactttgtttcaaaaaaaaaaaaaaaaagtggagtaagacacatgacaccagggagcagcacggtgggaggtggagtttgtatcactaagtaggatggtgggggcacgtcttagagagcagacggacttgagcaaagactggaaggacatgaaggagtgagctggcaacatggagatcaggtgaagggtgttccaggcaaagggaacagccagtgcaaaggccctgaggtaggatcgtgcctggtgtgttaggacgcagccccatcctgtaatgaatgacaggaaggtggtatgaagtgataccaaagaggagtgggcccaggtggctctgccagctatcctgaccttgcatctgctattcacaggcacagaccaccactgaatgtgcacctgctgtgcaggggacactatagaggcttcctgttgtcctctccacagtcctgagaggtagacagtgttaatgaaaatcatttacagattaaacaatgaaggctctgagcagttaatggccctaaaaggggactgtaagcagttggaatcttttatttttttttggagacagaatctcactgtgttgcccaactggagtgcagtggtgcgatctcggctcaccacaacctccgcctcccgggttcaagcaattctaatgcctcagagacaaggtttcgccatgttagccaggctggtctccaaccccctacctcaagtaacccacccacctcagcctcccaaagtgctgggattataggcgtgagccaccacacccggccgcagttggaatcctttatttttttagacggagtttcattcttgttgcccaggttggagtgcgatggcgtgatctctgttcaccgtaacctccacctcctggattcaagcgattctcctgcctcagcctccagagtagttgggattacaggcatgcaccaccacacccagctaattttttttgtatttttagtagagtaggggtttctccatgttggtcaggctggtctcaaactcctgacctcaggcgatccgccctcctcagcctcccaaagtgctgggattacaggcatgagccactgcacccggcctagaatcttttttttttttttgagatggagtctcgctctgtcacccaggctagagtgcagtggtgccatcttggctcactgcaagctctgcctcccaggttcacgtcattctcctgcctcagcctcccaagtagctgggactacaggcacccgccaccacacccggctaatttttttgtatttttagtagagacggggtttcaccgtgttagccaggatggtctcgatctcctgaccttgtgatccacccgcctcggcctcccaaagtgctgggattacaggctggagccactgcacccggccgcctggcgtagaatctttaacaaaggtcaccagtctggatccagagctcagctgtgaaccaggaagatagcagcacccgctgctccggattgctagaacagtccatgcccaaggcctgtgctgctggtatcttgctgcatctgccattcctgagagcaaggatctctcctgcagcagcccagagctgggaagcggctgctggtgaactgtgggtctctgagagctggaatgcctcataaagtgctcgggacagtgtctgatgtgtagacactgccaaccatttagctaaggatggaacagtaaagttggtaaggttgcagagagcagcccaggatagtagttcagaggcaccacctggtcctaatgtggagagggctgagccactccctgggctggccatttgctaaacaaggattttcccaccctcatggagcccacggtccagactcaatgaatgacactgctctatgctggaagggcaagcagtacacttattattatttttgagacggagtctcattctgtcacccagactggagtgcaggggcatgatctgagctcactgcaatctccacctcccaggtccaagcgattctcctgcctcagcctccctagtagctgggattacaggcatgcaccaccacgcccggctaaattttgtatttctagtagagacggagtttcaccatgttggccaggctggtcccgaactcctgacctcagataatccaccaacctcagcctcccaaagtgctgggattacaggcatgcaccaccatgcctggccaagcagtacacttataagggcatcgtctatccccaaacaccaaaactgcaaaggatgacaggtgcacagtcagtggtggtccatgccctgtgcataggaggagttcaatggtagtccacacccagtgcagagtaggtgcaaagtcaggggtggctggcagagccacctgggcccactcctctttggtctcacttcctaccacctttccctcattcattacagggtggggctgcgtcctaacataccaggcatgctcctacctcagggcctttgcactggctattccttttgcatgtccaggaacaagcccttggctctccaggaatctcaaagaactgggattttagtgttggggtctcattcttgggtttctccctgcagattccaactccacagagtgaccagagagaggacgtggctgaagacaccaaagatgggggaggggaaggtgagtatgttagagagaggctcaggagttctgggggtgccctggccccagggtggcttgctaaaagatgactcctggggggatatacagagaacttggaggtgctctgcactgaccacccaccccgtacacagtgtccagccaaggcccagaggactcactcctggggacacagtctcgtggccacttcagccgccagccagtgaagtatccccggggcggtgtgaggcctgtaacccaccagctgtccagtctggccctggtggcttccaagctgtgcgaggagacccccatcacatcagtgcccagagggagtttgcgggggcgggggcccagccctgcagctgcctcccctgagggcagccccctgcgccgcaccccgctgcccaagcattttgagattacccaggagacagcccggctactctcgaaattggacagcgaggctgtgcccagggccacctgctgcccggacgtccagcctgaggaagccgaggaccatctctgaccaccctggcaccttaaataaggaagaggcccagattgtgaagacggacccatatatccctacctcccaccacctagtggccaaacaccccgccaggagttcaatgctgggagaggtccagagggttcctataaggaaaaactatttaatacatgacctaggggaggcctaaaacccttttggggataatgtcccagagtccccccactagacacaggtcactgccaagcatcagggccactcgggctcagaggtcactcagggtcaatactcagggtcagtgcaggttatgagatccttggggtccaccctagtctctgacacctgggacaggggtgcttttgctactttggttgtggtcactcccccacacctgcctgcctccttcacggactcgaagtgaccttcctggaggaggtgggcagctcagactccacatgctggtggtgcctgaggtctgatggcctctaataaactgtgtcctatatgc

SEQ ID NO: 8329 - DNA, 406 bp, Homo sapiens
ggcctcttttttttttttttttttttttttttttgagacggagttttgctctgtctccaggttggagtgcagtggcacgatctccgctcactgcaacctccacctcccgggttcaagcgattctcctgcctcagcctcccgagtagctgggactacaggcgcctgccaccatgcccggctaatttttttgtatttttagtagagacggggtttcagcatgttggccaggatggtctcgatctcctgatctcgtgatcgtcccgcatcggcctcccaaaatgcagggattacaggcgtgagccactgcgcccggcctcaaggcctccttcttgcatcatcaaacaccctgcagcacctacgtaaaggcagttggagctgggtcgcagcacccggctgagtcacgcca

SEQ ID NO: 8330 - DNA, 287 bp, Homo sapiens
gtggctcaagcctgtaatcccagcactttgggaggccaaggcgggcccatcacaaggtcaggagatcgagaccatcctggctaacacagtgaaaccccatctctactaaaaatacaaaaaattagccaggcatggtggcgagtgcctgtagtcccagttactcgggaggctgaggcaggagaatggcgtgaacccaggaggtggagcttgcagtgagccgagataacgccactgcactccagcctgggcaacagagcgagactccaactcaaaagaaaaacaaacaa

SEQ ID NO: 8331 - DNA, 1998 bp, Homo sapiens
gaaaaatgcgaagactgctttatattttgtttgctcctctacactgttaattgatgaacataaatccaccagggaatgtgcaagatgtttaatctgccattccttttgttggtctcagttgctttatggtgcaagcaactgaaaacattgaatgtttatactataaggcctcgaaggcaaatgaaatacttcttttagggctcaactgaagaattagtaatttttcccaattgtggaggatttctaaatatttgtcagtattaagctaaaattaatgagtgaaaaaatgtatacagtctttacttcacttttaatttatgggatatgtactttattacatcatttttaataatatgaaataatttaaacacatagataatatacaacgtatacgatgtataaagagtagtgaaaggaaccacccaggttatgaagaagaagatctctaatattatcaaagccccaagaatagtttttctctattcaatcacttaccttgatccccagggtagcatcaatctgactttgttgcttcccattgtctttttttaataggtttatatacatatatgtatatctctttaacaatttctttaattataagtgtttttacttttacaaaattggtatcttatatatggttttcatacttgccttttttactcaatattgggtgtctgagattcctccaggtttttaatcagttttcctaagataaatattttgaagttgttttcagcttttcactattgtaaacaatgctgcactggatattcttattcatgtttcctgatagacatatgcaaaagtttctttaggcaagggattattggtccataaggtatgcacctgtgtaactttattccaaaatgccaaaatgcctttaaaagatttttgattacactcttgccatctttttatgacagttctacttcctccattcctcgccaatagttggtattgtccattattttattttacttttaaattttattttatattatacttttgtcaatgtagtgagtgtaaagtaatatttcattatgtgtttagctcagaagtacaactgccggattgcaggatatactaaatagttttccaaggcttcctttaccaccctctgctcctgtatctaatttccgctctacaatgagggtaaaattatatcccattgtggttttaatttgcatcttcatgattaccagtgaggagcttttcatgtattatttagctattcatgtttcctttcatgtagaataactgctcttgtttttgcctatatttatagaagtttttgtatgttctgaataatcttttttaggtcatatgtgtggcacatattttatcctagtttttgtcttctctttttatttgcaatgtattgtcttatgataagcaaaagtttataattttaatgcatagagcttttaatataattgttttcacattttctgatgtgcttaagaaatcctcaatgctgtggtcatgaagttattctcattttttttcctaaaaaatttaaggagttgtttttcacatttcagtgtttatttggagaatgtgtgtgtatgtgtgagcaggtgtgtggtaggaggcaggaatccaatttccctttttccaacatgagtcctagtaccccttgtcaaatatgccccattaatgtgcaatgacaactctgtcgtatatgagttgccatatgtgtttgggtgtgtctgagttcccaaatcaattccatttgtctttttcttccatatccataataatgtgccgttttcattattacaactttattataggtcttaatatacagaatgggcaagtcacactacttgttcatcaggaaatcttaactattttccttttatcttccatatgaatattggaatgagctcactaatttccatgccaacattgtgactggaattacattgagactaaagatcaatttgggaagaaatgccatctttataataatatatcaataaatccttaatatta

SEQ ID NO: 8332 - DNA, 528 bp, Homo sapiens
tgcaaattcgtaagctttctgaaaacattttgagactttgtaaaagatttttttaatttttatttgagcttatcagctattgttagtgttaatgtattttatgtgtggcccaggacaatttgtgtttatccagtgtgtctcagaaaagctaaatgattggacacccctgcaacagtacatgcctggaaaagacataagaagcagacacaatagtggtaaaaaagcattacacaagataaaaggtaagtctgaggccacagcttacaaggtggcctacacaggaagatgcaataaaaacagtttctcggttatctcctatctttgtgaagctactcctattcatgctttcttcccacttcttttcttccttcttcttcttgttctttcttcttcctcttcctcttcttcttcttctcttcttgttcttcttcttcttcctcttcctcttgctccttctcctcctcctcccccttcttcttcctcttcctcttcctcttccccttctccttctttctccttctccttctt

SEQ ID NO: 8333 - DNA, 1931 bp, Homo sapiens
cttagaatgactaatttggtcataagttttacacttagattttcttctttcccagtgttgcccttttgccttcttttatgtaacatagcatttgggttaaataataccttttcttagtagaaacacacatgattatctgtagtgaatgtaatttaatttgtaaactccttttgtgcggcattcctgcaggactgtgcactgtgacatggttttctattcatcaatcccttgccttgtatttttcaagtgttggttgaaccaattcttacaagtgaattattacaccctcccttgcagctcaaaacaaacaaaaaagttctcctttccaagttgaaacctataatttgatcagtttgcataaagtagttacagctattctcttccttagtgtcatctattgagagtacaccttagggaaagaagttctggagaatgagctgctcctgtcctcacggtagagatagaaaggtctgctcaatgtctccaatgccctctaatattctgaacagtaataaccttaaagatattaagataccccacttgaccatgccccttgggggtcctctccatcagtgctatctttctgtgaagatagagatgttctataatctgcaagtccattgtggtaaccagtagccacatgtggcttttgagcacttgaaatgtagggtaatgcaatagggggactgattttaacttttatttaatgttaagtaatttaaatgtatatagccacatgtggctaatggttaccacatcaaacagcatagctctagacagttgtgtggttctgaagaatctcaatgttcaaaaaaaaaaacattgacctctcttaccctcatattttattacaaacaccctgagtaaattagtattgaagacttggctgtcgaggcactctggtttgtgaaaaggtgggatttggagtcacaggccttgggtttagttctagccctaccaatcactgatcgggtggcctgggcacacattgtcccctcacatcagtttcctcatatataaagtagaaatgatggcacctatctcctaaggctattgtgaagatgaaatgaaacaacacgtgtaaggcactgagtgtaccctgtctaaattatgctggtctgtgtccacatctgactcaggcagagatttctcagttttccttatgtttaaaaaataaacaaataacagatcatctctgaagccaagcatgtttccaaagagaactctgaaaatcagctttattattttaatcctgtgctgtctgtgactgtctccagatgtgtgtctgtggagaaatagatcttcataagtctgagaaaggtatttagtctgtccgaaaatgtgtttctaagtatactcatctataattttattactgacatcttactagtaccactaacaagtaaagggaagttagtttaacataaagattattgatattgtttcctgagctatcagtgttacttcatttaattggatagagaggcttacttttctagattatctttgtaattgtttacttccctttaatgtgtctatgctatggtagagaataatggaaggcattaccatgctactccattttcatttggcctatgaagactggcacagtaagggctttatagaaatggaagttgtagaaaattgaaagtttaaacttattaagcatcaggacattaactttaactgctttttaaatagaaatattcctgaaatgtagaatgtttttgtaaattagaagtgttttaccagcctcctaaaaaatctgttgtttgaaaacttgggtcataaaagagataaaatcttaagtgcagagttaagcatcacaagaccagattgacttctagtacctggtgcatcaaacaaaaattctgatattggcagcctgggcaacatagtagaacttcatccccacaaaaaaattgtaaaaa

SEQ ID NO: 8334 - DNA, 106 bp, Homo sapiens
gcatgttttttttttgttttgttttgtttttgagatggagtttcactcttgttgcccaggctggagtgcaatggcacaatcttggctcaccgtaacctctgcctcc

SEQ ID NO: 8335 - DNA, 665 bp, Homo sapiens
atataagctctaaaactctcctgtaatatctctgacccaatttagcaccacttttttccatttcattttttaggactgaaacataaaagaaccagtgtccagaggcaagtgacatatgtcttacacttgtggccatccttcatttcttcataaactttgcttaaaagactaaaattcccaattccttataaaaaatatattcttgccctcagccccagtggccactggcaaagactgttatttcccaatggataagagagcctccttcatcttcttggccatagttgggatgaggtgcgtgtggtcatccacacacttggtcacacaaccgtccagctgctgcttcacctgaagctccttactcccagtatccattgaatctttggctttgttgttgcaatgcatggcgcaccgggccaggtggtgccggaacttctccaactcactggtgagcaaagcccgggcttgagccagaggcacatggcagtgctttgatgtactggtgcacctactgcatggaggcctggctgtcctcacaacagctggtgctgcaccggaacatgagaccctgcatcttccagatgttctctctctccagactcttcaccatggagtccaccacctcctgcacccacagctgctgcagctctgccatggcgtcccca

SEQ ID NO: 8336 - DNA, 783 bp, Homo sapiens
ggtttggccatgttggccaggctggtctcgaactcctgaccttaggtgatccgtccatcttggcctcccaaagtgctgggattacaggcatgagccatggcgcccagcctctgtctttcaaaaaaaaaaaaagggacttactagggcctgctttgcctgggtccctatgcatcctgggattggtcagagtgaaccaatgagaagactgagctgctctcaagaagggctaccacaagctggttttgaaagcttcttggttctgagaacaaccagccctagatccttttcatctctgatgccaaatgatgtggcactgagaactgaagaggaaacgtgaacagaaagaagagtgagggctgaataagaagcctcgccagtgggaaatagggcccttggtaccttttgctcctaatagtcacatctgtgtttagaagggccaggaactcccacctcctgcgtcagagcctgtcaagcatgtcaggcctagagtggctttctgatccctgttatacacctatttataagttatctaagctaattctgagctcagagtaattttcctgaaggagcttcaggtaaataaggatgacaaagaactaaaaccaaatttactgtaaatgataacttcagcttctaagaaaagaattactgactccacactgatgtcaatagctggagagcaagggctacgaggaagaaaaccagtgaaataatccatggtcatgccacttgcccaaatatctgaattgcttatcattaaaaaagagcaaatttacgtttata

SEQ ID NO: 8337 - DNA, 762 bp, Homo sapiens
ctgtgtcctgtgcactagagcttcatcccccaactcaaaaggtcagctggctgagcccgacctggaacaggccgcacatctcattcaggctctcagcaaccacgaggatgtattcacgtctatgataacattgaataaccaggctacatgtgcccccgggttccttcctagaaatgtggcagcccattccagcacacaggcttctgcagcaatctctgagggtaaagccggtgggaggctcagcaggccaggaggcccaaggacaggacttgcgaccttgaagccaaaggaatctcacttgtggggcctccttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggtgattattggttgctgcattgctgttgtatggctcttgagtcttcctgagtttgtgtccagctgttgggatcctctggactaactttcaagtccctaggcttagctctactactccaatcccaggattatttttttaattggccatagaaatgtagttgtatccaggcactccatggtctgatgctggtcttacagcctaaacctgtcattcattcatgcaactaatatttctggaacactagctatataccaagaactgtacttatctagagcataag

SEQ ID NO: 8338 - DNA, 3557 bp, Homo sapiens
tatgagatagggaagttctcctggaacagcatgtagattattttctagagcactttagttaaatggtacttaatgatgataattcttctgaacacaattcagaatttgaaccaatatttgttgtttcaggaaagcagaatttcctttgaatgatggataagaatggtgaggatctttataatatagaataaattgctgaaaagaaactttgagggaatattcaaagcaccctcttattttgaaccttccttgatcatctctaatgtgactgctttctcagaacttccatatcatttgtcccctcttttggagttcttgctgctttttgtttttgtatttgttttcacttattcagtaattattcagtgtccactgcatcctaggtaatatttcagctgtcaaaagtcagattttggctgggcatggtggctcactcctgtaatcccaacactttgggaggccgaggtggttggatcacctgaggtctggagttcgagaccagcctgaccaacatgacaaaaccccgttgctactaaatataacaaaaaaaaaattagctggtcatggtggcacgtgcctgtaatcccagctacgtgggaggctgaggcaggagaatcgctcaaacccaggaggcagagggagactatttttataatgatactaagatgccatttctgttttcactgtgttgacacttgtactgatggtccaaaagcagtaatagggaaaactgctgggcactttaacgtaaattgaggcagggactccaagtgtcactgatagtcattatattattcgctacctctccacttgcagttttaaaaaaacaaaaagggctgctttcacttaaacagaccctgatgaagcagtaaaaattaaaaaaaaaaattggccttttgtcttttcatgaggaaatgggaagtacatgaattgcttttgctgcacaaagaggtacagtgcctgttttgagaaacagcaattgtgtagtttgagttgcaaagcgaactagctgcttttattgtgaaatgccatttttgcttgaaaaagtgggtagcagacaatctgcagttattgagacttgggtatttggtggacgttttctggaaaataaatgagaggaaataactgacaatttatgaccaatgataatatttgtgctttcaagcaaaaatcaaaattttgaaaaaatttatctgctacagtgagcttgacagtttctcaatagttaacgacttctttgatgagattggtgacaatataatgaatgagtatttgatattatataattaaatgtgtcagcatttggaagatccacataattttgtgaactaatattttccagctcaccattgcaccacgttacaaagtcatagtgcatgggtaaaagattcattcaaaagatagaccaatggattttaatgtagtgatatgaaaagttcactgataagagttatagattctacattataacttttttttttttttttttttttttgagatggagtcttgctctgtctcccaggctggagtgcagtggcgcgatctcagctcactgcaacctctgcctcccaggttgaagtgattctcctacctcagcctcctgagtagctgggattacaggtgcctgccaccatgcctggctaatttttgtatttttagtagagattgggtttcacgtgttggtcaggctggtctcgaactcctgacctcgtgatccgcccgcattgatctcctaaagtgctgggattacaggcctgagccaccactcccggccacaactttttttttttaagagactcccccttgcctggttttggtgttgtatcaaggaagaatgtccacagtgatctgaaaaggctgctgagacaccccacctttttccaactgcatgtctctctgaaaaaggatttgattcatagacttcaaccaaaaaaaccacacagtacaacagattggatacaggagcaggtatgagaatccatattgtcttctctgaagccagagttaaagcaacttgcaaaaatgtaaaagaatacctcttcttactaaatgtttttgttttcagaaatcttttatttttagtaaaaaatattatttaccttaatatctagtcagtttattattaaaaattttaaatgagttaggccgggcgcggtggctcacgcctgtaatcccagcactttgggaagtcgaggcgggcggatcacgaggtcaggaggtcgagaccatcctggctaacacagcgaaatcctgtctctactaaaaatacaaaaaatcagccgggcgtggtggtgggtgcctgtagtcccagctgctcgggaggctgaggcaggagaatggcgtgaacctgggaggcggaggttgcagtgagccgatatcgcaccgctgcactccagcctgggctacagagcgagactccgtctcaaaaaaaaaaaaaaaaaaatttaaatgagttaaatatttaaaaaatttcacagtattagttttgtttgtttgtttgtttgtttgttttttaagatagtgtctcgctctgttgcccagttgggagtgcagtggtgtgaggatagctcactgctgcctttaactcctgggttcaaatgatcttcttgcctcagtctcttgaataactagaacatagtagctgaaagacatggatgtcatcatctatttctttatattttttgtaacattttaaagctattgcctagtttaataattatttcagtttgtgtatgtaaggacaatcaggcatttaaatttataaaacatgtttgaaaatctttaaaagttacacttactgactagttgcttgtctgttgcactaacaaaatttattattcatgtttcgggaataccctctttaggttttgtttgttttttttttcatagtaaattatcccagtacaagtgtctttgtacaaaattttgatttctaagtttctttaaaaatatcaatgccagctgggcccagtggctcacacctataatcccagcactttgggaggtcgaagaggatggctgaggaggttggatcgtttgaactcaggagtttgggatcagcctgagtgacatggtgaaaccccatctctgctaaaaaatatgaaaattagggctgggtgcagtggctcatgcctgtaatcccagcagtttgggaggccgaggtagacggatcacttgaggccaggagtttgagaccagcctgggcaacatggtgaaactccgcctctactaaataaaaaaaaaaattagcctggcatgggggcaagtacctataatcccagctactcgggagactgaggcaggagaatctcttgaacccaggagccggaggctgcagtgagctgagattgtgccactgcactccagcctgggtgacagtgagactgtctcaaaaaaaaaaaaaaaaaaaagctgggtgtggtggtgcacgcctataatcccagctactctgatggctgaggcagggagaaccgcttgaacctgggaggtggaggctgcagtgacctgaaattgcaccactgcactccatgataccctgtctaaaaaaaaaaaaaaaa

SEQ ID NO: 8339 - DNA, 3557 bp, Homo sapiens; identical to SEQ ID NO: 8338

SEQ ID NO: 8340 - DNA, 142 bp, Homo sapiens
tgcctgtaatcccagctacttgggaggctgaggcaggagaaccacttgaacctgggaggcagaggttgcagtgagccgagattgcaccattgcactccagcctgggcaacaagagcgaaacttcgtctcaaaaaaagaaaaa

SEQ ID NO: 8341 - DNA, 213 bp, Homo sapiens
gttcgagaccagcctgaccaacgtggagaaaccccgtctctactaaaaatacaatattagccaggcgtggtggcacatgcctgtaatcccagctactcggaacgctgaggcgggagaatcacttgaacccaggaggcggaggttgcggtgagccgagatcgtgccattgcactccagtctgggcaacaagagcgaagctccgtctcaaaaaaa

SEQ ID NO: 8342 - DNA, 142 bp, Homo sapiens; identical to SEQ ID NO: 8340

SEQ ID NO: 8343 - DNA, 213 bp, Homo sapiens; identical to SEQ ID NO: 8341

SEQ ID NO: 8344 - DNA, 11081 bp, Homo sapiens
ctggaatgaggagctgcagacgacgagggagctgcctcgcaagaacctgcctgagcggctgctccgagaaagggccatattcaaggtgcctgcagcctctgctgaccggcagtctgaggcccgctgtccacctgctgacgggttttctcatggagaggaggaaagcaagggaggcaggggcagccctaaccctgtcaggttccccgaaggccagtcagcgtctcccgcagggtctgctagccttccgcctcccagcagaccatcccagtacctttctctggcctctctgaggctttgagtccctggaaggagcgggccctacttcccatagggactgagtgtccagggccgtgcagcttcccgccctctgtgactgctgcggggcttttgcctgggcgagcactggccggccatggcccttctagggcgggtgctcatttgcataacacttttagtttgctggggtttaaaagttattagtgctgggttactaagagaaatgaggaaaagcagttgcttaagaaaaaaaaaatctcaggccggcttcagtagctcatgcctgtaatcccagcactttgggaggccgaggcgggcggatcacaaggtcaggagttcaagaccagcctggccaatatggggaaaccccatctccactaaaaatacaaaaattagctgggtgtggtggcgcatgcctgtagtcccagctactcgggagtctgagacaggagaattgcttgaacccaataggcggaggttgcagtgagccgaaattgcatcactgcactccagcctgggcgacagaacaagactacgtctcaaaaaaaaaaaaaagaaatctcagccaggcacagtggctcacgcctgtaatcctagcactttgggaggctgagacaggcagatcacttgagcccaggagttggaaaccagcctacgaaacatggtgaaacctcgtctctgcaaaaaatacaaaagattagccaggcatggtggcatgtgcctgtagtcccagctactcgggaggctggagtgggaggatggcctgagccaggggaagtcgaggcttcagtgagctcggatctcgtgccgctgcattccagccttggcaacagcgtgataccctgtctgaaaacaaccaacctcccatagttatactgcctagagatgataattgtagaaacaaaaactcatttctcgggtaccgacttcaccagagatggtgccaagtgcgttatagagactatttcctataatatattggacaacttgtaaaggtcaatacctttatctgttcaagttcacctggcacataactggtggatcccaaacctgcgcacgcttgttaatcactaagccctgctgtctccctcagcacaagtgtattctcaaaacatgggggttttggtttgtttgcgcttttttagaaatggagtctcactctgtcccccaggctggagtgcagtggtgtgatttcggctcactgtaacctccacctcccgggttcaagcaattctcctgcctcagcctgtcgggtggctgggactacaggcgcgcgccacctcgcctggctgattttttttgtatttttattagagatggggtttcaccatattggtcaggctggtctcgaactcgtgacctcaagtggtctgaccgcctcggcccctcaaagtgctgggattacaggtgtgagccaccgcgcccggccaaaacatggttttcttgcccttttctacatatgaggaaactgaggctccgggtccttgggtttccaaggcaggcccggttgcctccgcggtctaggtgcgtgcgcttggccaggtggatgcaggctcttgtgggcgcggcctctaaccctgccctcctcgacccccgccaggtgcacagcgacttcaccgcggcagccaccaggggcgccatggccgtcattgacggcaacgtgatggccatcaaccccagcgaggagaccaagatgcagatgttcatctggaacaacatcttcttcagcctgggcttcgacgtccgagaccactacaaggacttcgggggggacgtggcggcctacgtggcgcccaccaacgacctgaatggcgtccgcacgtacaacgcggtggacgtggaggggctgtacacgctgggcacggtggtggtggattaccgcggctaccgggtcacggcccagtccatcatccccggcatcctggagcgggaccaggagcagagcgtcatctacggctccatcgacttcggcaagaccgtggtgtcacacccgcggtacctggagctgctggagcgcacgagtcggcccctcaagatcctgcggcaccaggtgctcaacgaccgtgacgaggaggtggagctctgctcctcggtcgagtgcaagggcatcattggcaacgacgggcgccactacatcctcgacctgctgcgcaccttccccccggacctcaacttcctgcccgtgcctggcgaggagctgcctgaggaatgcgcccgcgccggcttcccccgcgcccaccggcacaagctctgctgcctgcgccaggagctggtggacgccttcgtggagcacaggtgaggggcggccctgccggaccagggccggggccagctgcagggagtgcgggcgccctgggtggatccggggttgggtccttgaagggagaagcgctggagagtgaagaagggctccgtctagccacagtcattggagacccgtccccacctgccctgctgtcaggctcccgagcgcagaaacccgggctgcagactcgcgagcagccaggcgggtaatgtggctgtggcggacactgttctcttaaggagcacttggaagtctgggtggctgtgactgtccccgtgctggggcgggcaggtggggcaccgggggtccccgccgctggtgtttagtgcttaggaaatggggaaatggccatgtcagaggtcccacagcatgagtaactctcaaatgccagtggcttcctgtcactgttgagagccctgacctggatggggagctcctcttttcccataccctccagaacgcagctgcctttttttttttttttctgagacggagtttcactcttgtcgcctaggctggagtgcaatggcacgatcccggctcaccgcaacctctgcctcccgggttcaagtgattctcctgtctgagcctcccgaatagctggtattacaggcgtgcaccaccacgcccagctaattttttgtatttttagtagagacggggtttctccatggtggtcaggctggtctcgaactcccaacctcaagtgatctgcctgcctcgtcctcaaagtgctgggattacaggcgtgagccaccacgcccggccgcctttttcttcctgtcttgggagatcttggtttttctgcgttgactcatgcacaccggccaggaggtgccctatgcctgcggggtgtggagccccagctgccgggagccgtgggccagcagagctcctctccccgatgtccagctcctgctctgccctgtttcctctgctccaggtacctcctctttatgaagctggccgccttgcagctgatgcagcagaacgccagccagctggagaccccctcctccctggaaaatggtggtccttcctccttggagtccaagtctgaggatcctccaggacaggaggcgggaagtgaggaggagggtagcagcgccagcggcctggccaaggtgaaggagctggcagagaccatcgccgcagacgacggcacaggtggggctgctgcagatggccgggagagagcccgggctggccctgccagggtggcttatgacccccacctgggagaggctggcagacatctctgcaaggagctagggggcgaggcttggcgcagcccagctccaccggtggcagaggggacccgtgtctcatggagccatgtctccacagcagaccctcggagccgggaggtgatccgcaacgcgtgcaaggcggtcggctccatcagcagcaccgccttcgacattcgcttcaatcctgacatcttctcaccaggcaggtggtgggggccggccagcgcaggagccctccagggccagagcttcgctggggggcctgggcccttggggctggtgggtttgtcccccatctgagcgcttcccccgccagcgccaggcggcatttgtcttgccactgcctggctcagcctctctgctctccctcctccaggggttcgtttccctgagtcctgccaggatgaagttcgggaccagaagcagctgctgaaggacgcggctgccttcctgctctcctgccagatccctggcttggtgagggaggggctgcggggctgggtggggcttgtgtggagggtgctggtccctcatctgtctccgacttggaggcccatgaacacaggctcgcaggagtgactttttcagctttccctgagtgggcatccccgtttgacagatggggagcctgacccccagaggtcaagggcacaggccctgctgagcccaccgtgtgggctggcagctggtaatccagtcttctgagccctggatggtggcatggctgggggacggggccagagctcagtgggggctgcccatcctcctcctcctcccgcaggctctgtgtctggttccaggatgctgggtgctcccccaacaccgtggcctccaagcctcaggacacggggctgggggtcaagtagtgcccccaagcgggcacctctgcttctcccacatggttagagggggcctgtaccaccaccgggctcttggttcttggcctgcgctcctgccagaggctgggcacattctgacatcctgactgggagctggagccttcggggtccttctccagggcctcccaggatagctgtgctcccccagaaggactcagttgggtggaggcagaggagctgggtgggggcctgagctgctgcagcccgcaggtgaaggactgcatggagcacgcggtcctgcccgtggacggggcaacgctggcagaggtgatgcgccagcggggcatcaacatgcgctacctgggcaaggtgctggagctggtgctgcggagcccggcccgccaccagctggaccacgtctttgtgagtgctgcccggggtggggcggaacgggagctgtgggactgggatggaggccgggggcctgaccaagacctcccttctgaatccttccagaaaatcggcattggagaactcatcacccgctcggccaagcacatcttcaagacgtacttacaggtgccacccgtccgctctgcggctggccatggcctcccagggtggtgtggggcgtcgggaaagagcctgaggtggggctgagggccctcatgactcggatccaacctgcctcgcagggagtcgagctctccggcctctcagccgccatcagccacttcctgaactgcttcctgagctcctacccaaaccccgtggcccacctgcccgccgacgagctggtctccaagaagcggaataagaggaggaaaaaccggcccccgggggctgcagataacacagcctgggctgtcatgaccccccaggagctctggaagaacatctgccaggaggccaagaactactttgacttcgacctcgagtggtgcgtgcggggcaggggcggtggggtgggtgggattgggcagatgaggcggccaccacctgctcccagatggcgtctaaggcctgtggtcataggccagggagtcagagagaagagggagcagctgtggagatcactgggtgctggagggtgagggcagccgggaggctcccgggggccgggtggggcagtgttgggggcccgggctggacagcgttggggagctgggtggggcggtgttgggggggcccggcggtgcttgggctgctcaggccccctgctccctcctcagtgagaccgtggaccaggctgtggagacctacggcctgcagaagataacgctcctgcgggagatctcgctgaaaacagggatccaggtgggcatggctcacagcatccccgctgtgtccccgctgtgtccccgctgcgtccctgctgcaggctcccactcctggccagggccacaggggaagtggctttttcacggtagccgtctgtgcgcaagcgttggtgggttgggaggtgccaacccgctgaacctgggcctgaggcttcctgtggtgggggggctgccccccaggtcctgctgaaggagtacagcttcgacagtcgccacaagcccgcgttcaccgaggaggacgtgctcaacatcttccccgtggtcaagcacgtcaaccccaaggcctcggatgccttccatttcttccagagcgggcaggccaaagtgcagcagggtgtgtggccaggtggggctgggtggaggtgggggttccccatggcccgtcctgaccttgccacccctgggggtgccctgcaggcttcctgaaggagggctgtgagctcatcaatgaggccctgaacctgtttaacaacgtctacggagccatgcacgtggagacctgcgcctgcctgcgcctcctcgcccgcctccactacatcatgggcgactacgcagaggtaccctctgggctgtggcagcaaaggcctggcctcgtgttgggggatggggagtgagggggcccctgacggaggagtgggtggagtccagggagaccccaggaagtcgctggttctgcccaggccacccctggctccacccctctgtaactgtgtcccgagcgggagagctcaggagcaccctgtgctgcggtgaggtcagttctgggaggcgatggcaggggacccccccacagggcgtcagcaaggacgcctcctgagactccgtgagtgggcaggaagcatgccaccgagctcccacgtcctctgtgcccagtgcaggctgtggggttctgggtgccctgcctggccggggctggtggaggctgtggtggggttctgggtgccctgcctggccagggctgtttcagggttagcatgtcttaggatccctactccctgcaaagggactgttttttcttctgtttataaatgggtgggttgtttgtttgtttgtttgtttctgagacagggtcttgctttgtcacccaggctggagtgtagtggcgtgatatcgactccctgcagcctcaacctcctgggctcaagcgattctcccacctcagcctcccgagtagctgggattacaggcgtgagccagcacacccagctaatttttgtatttttagtagagatggggtttcatcatgttggccaggatggtctcaaactcctgacctcaagggacccacccctgctcaggctttttttttttttttgtaacatttttagtagttttaggtttgtatttgggtgtttgtggagattttgttgggtgtaagacatgggtgtgtggagctctctgtggagcgtgacctgcccttcaaggtgtggcagcagctgctgctgatccccctcccccctgctgcactgtgctgggcgcagccggaggggacaggagcctgcagagcggcaccgtgggctgctgggccggggccaggcgggctctgggtgcagtgggggttcccacgccgcggcaaccaccactgtctctccccaggccctgagtaaccagcagaaggcggtgctgatgagcgagcgggtgatgggcaccgagcaccccaacaccatccaggaatacgtgagtcgcgagtgccgcccgcgccgggggatgcgaggggctgggtccgcggccaccctgacctgtctccgccccgcccgcagatgcacctggccctgtactgcttcgccagcagccagctgtccaccgccctgagcctgctgtaccgcgcccgctacctcatgctgctggtgttcggggaagaccaccccgagatggcgctgctggacgtgagtgctggggcgggggggcggcagggacccagctccatcccaggggaccgggagctgaccagggccccccaccgcctgcccccagaacaacatcgggctggtgctgcacggggtgatggagtacgacctgtcgctgcgcttcctggagaacgcgctggccgtcagcaccaagtaccacgggcccaaggccctcaaggtggccctcaggtgaggggccgcccgtccaaacgccaaggccggcggaggcctgcggggcagccggcgggggcggggaagagacccagtgctcctgtcttcctccacccgagaaaatttctctcgacctccccctcttccctgagccctggacttgctgttcccctcggtggcttccagggagggatctacgggagaccccgggcccccgagtcaggcccccacacccagcccacttatgcccttccctcgccccgcgccgcgcctcccggcagccaccaccttgtcgcccgagtctacgagagcaaagctgagttccggtcggccctgcagcacgagaaggagggttacaccatctacaagacgcaggtgcgcggcgggggcgtggcgggggcgggggcggggcgggggcgtggcggggcgggggcggggccgcgggggcacgggggggcctgatcccttcccgcctccccgcagctgggcgaggaccatgagaagaccaaggaaagctccgagtacctcaagtgcctgacccagcaggccgtggccctgcagcgcaccatgaacgagatctaccgcaacggctccagcgccaacatcccgcccctcaaggtgagtccggggcggagcggcccctccggcccggcgagcgcgggagccccgctcaccgctggtttccccgccccgcagttcacggcccccagcatggccagcgtcttggagcagctgaacgtcattaacggcatcctcttcattcctctcaggtgaggcctccgccccactcgagtgtctcccggttgggggttttttgtgagtcggagtctcgccctgtcacccgggctggagtgcggcggcgccatcccggctcactgcagcctccgcctcccgggttcagcgattctcctgcctcagcctccccagtagctgggattacaggtgtccgccacctcgcccggctcatttttgtgtttgtagtagagatggggtttcaccacgttgaccaggctggtctcgaactcttaaccttgcgatccgcccgcctcggcctctcagagtgctgggattccaggcgtgagccatcgcgcccggcccgccccgcttatcttccccagcatcctcgcattccgcgagtgaagaccttggtgtttctgcttcacacaaagtatcttggcgttttcccaccagtccctaagaagcggcttcattccctccccacgcttcccatcctgcggcgggggggggctgaggagcaggccccgggctccccggggtggccacaagcagtgtggcctcctgtggggagtggatttggtcagcaaggcgtggcagcagccccccaactccgctttcctccccctgcgctggagggaggccaccgagggcagcgaggggagccccgaggccgggtcaggtgcggggtccttaccttctccgtgttcagggaccttccgccttcaggagggaagcgcttgttcacacacattccccactgaatagagcgcagagcctgagcttatcccacaggaaagccgggaggcgggtggagcccccaggactcctctgagagccacctccatccccacccttatcctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccgtccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcggc

SEQ ID NO: 8345 - DNA, 488 bp, Homo sapiens
gcctcaagttcgccaccctcggacaggattcagagagccaagacccaggtggacttgagcggcagagcctgtctctagaggggaagttgagctctcagtagctgctgaccgctgctcgccatctgtctccaagagcaggccctcggccccaccaggaacatacgccttttgggatgcttggagagatctgtacgtcttggaaattctgaaaagaaaaaaattccatccctgagtctgtcagttttcctgagccaaccggagaaaaggtgcttctgacctggcggttttaggtgacacccggggacagccaccagcgagtgagtgtcctgctacagaacctctcagacttcccagcagccccagcccagcagcagcttcctttgctctcaccggtgtgtcctgaacattctgtcccctctcctgagtgtttgttgttgaacgtgagccacatgttcatgcacctctcaaaacagggcctcctgtgaagc

SEQ ID NO: 8346 - DNA, 1075 bp, Homo sapiens
ccagcctcgggtccctcagacagcgggaagcggaagaagggcttggagatggaccccatcgactgcacaccacccgagtacatcctgccagggagccgggagcggccactgtgtcccctgcagccccaaaaccgtgactggaaggtaggatcctgggggagggaggaagagggtccctggcggggtggaggccccacaccagaggcctggcccctcagactcggccgctcccgaagcccttgcagtgcctgaaagtactcaccatgagcggatggaacccgcccccggggaaccggaagatgcacggggacctcatgtacctgtttgtgatcacagccgaggaccggcaagtcagcatcaccgcgtccacacggggcttttacctgaatcagtgagtccctgccagcccaccacacccccctgccgtgccagccgtcctgggtctgggcagacacctgggcccccgctcagtgcccgccctctccctgcaggtccacagcttatcacttcaaccccaagcccgccagcccccgcttcctaagccattccctagtggagctgctcaaccagatcagcccgaccttcaagaagaacttcgctgtgctgcagaagaaaaggtagtgcctttgtcccctcccgccttgtctcatggcacacgggggcatggggtgagccggcccacctgcactccagtgcttctgtctgaagaaaccgccctgggcccccagtgttggagtccccgctctagggagctgtcggccagtgccgagacagcagccgcaggagaggcgcccgtgcacttccatctggctccagggcagtgtctcagggtgggagatgccggagcaggcgggggcctcagaaaaggggcccgtggaagggctctgagcttggtgggctgccccatctccccctcccctgcctgccacagggtccagcgccacccgttcgagaggatcgccaccccattccaggtgtacagctggacagccccccaggcggagcatgccatggattgcgtgcgtgcagaggacgcctacacctcgaggctgggctatgaggagcacattcctgg

SEQ ID NO: 8347 - DNA, 1086 bp, Homo sapiens
tttgattgctgaaagaggcatagaaatttattttaaattgacagtgccaaacagagcaacaaattaatgaaacatcaacaacagtgagaggcttttcatgttttcttacaatcccttttaagatcagagaacattttttccccaaaaatttcaaaggaagagtcagagccaaagcattttgaaaagaaaaagagtttacttgaaaaggttcaagggagtcagacttcagaaaaactggataagcaagtgaaaaatataacaggtatttaaagaaaaatataaagaagattaccatgattactaagtttgcattaatttgttcatggagaaaaaacaaaatcttatcacatgatgatcatattcagaaagatcttgcaacatgagctaaataaaagtcaagaataaaatggtgtttgctggggatctgggattataagaaatactcaatgtttcattattttgggaccagaaattgacagggtaacgctgttatttttggttaatcttagggtacaaggtgcttcatcatgatggaaacaaacagggcatgatttctgctttgcttccagaagcataaagcaaatgtcactactacaaaatatagataggatatttcttataactctaatcactgttgtaagtaaataaaaatccaaagtcaaatcatagactctcaattaccatggtttttacacatttctaccatcccttcctggtgcactgtattgagccatactgagctatatttttctacttcacaacttttcacttacgggaagacagctattgtcccccacaccaccctaatgtgggcaagaggaccacttgaccctcatatatttaacactcttgaccctcatatatttaacattcataattatgtattgcctaaatactcactgttgtagtcactgaaatgcctgtgaaataatttttaaaactgtatttacaaaagaaagcctatttctagtaatggtgatggaaattaagagaaaatatagacatctataaaagtgtgatggttctcaatgacaaaatatgatttatgaaacaaatggctaaaatcctaaatcttttgcatgtttg

SEQ ID NO: 8348 - DNA, 4677 bp, Homo sapiens
tcatttcaaaggtgtccttgaatggccattttggacaaaactggttgtggtagccattggcttcacaggaggtcttgtcttcatgtacgtacagtgtaaagtctatgttcagttgtggcgcaggctgaaggcctacaaccgtgtgatctttgtacaaaattgcccagacactgccaaaaaactggagaagaacttctcatgtaatgtaaacacagacatcaaagatgctgtggtagtgcctgtaccacaaacaggtgcaaattcactgccatctgcagagggtggcccccctgaagttgtatcagtctgatggaacctgttgggagtttcttcaccgaagaatatctttctagccctcagccactacaaatgacagaagtgatcttgaattatttactcccttcagctcctcctttctcctactgacacatttttcctgactttgttcaaagaggaaaggagaaaaacaaacagaccaaatgcccaggagcccatgaagtaatagcgtaaagtaaagtatgatatggaaatgtgaagtttgcaagagaatgatttccaagacaattaagaactactggggcaatgaatgcttttaggcagtaatcaaagattaaatggacccatgatactcttcttcacagtaacaggggaaaagttcaagaatacagacttgaattgcgatgtgtattacttctagggccttgtaatgttaactgtctcatctggaaataactaacatatttggttttaagcctgaaattgtctgcattatccctaagtcacattggaagtgaacttggaggatgcatattttgatatgctttgacagctaacagatttgtatggtttagtggagtctggttattttgacagatgcatgttttttttaaatagatgcaatatacatttgaagacattgatatttggaattaattacgtttgtttaagtcacgcaaaagattttcagaaaatgttcggatataattagctctgttaaatacccacagaactgttatcaggtcttatatttattttcatctggttcctctaatacagtgctgtccaatagaaacacaacagccacaaatgcaggccacagatgcaaatatttaacttcccagtagccctattttaaaaagtaaaaataaatgtttgtttgttaaaatgaattttgattttttaaaaacactatatgttatttcaacatgtcatcaatataaaaaattgattgattgattgatagtttacatctgtttcttgaaccaagttttcaaaatccagttggtaatttaaaagtacacttcaacttgaattaactatattggatagcacagccgtaaaattagagactaagcttctgctttatttaacagttgttgagtatttcaaaacagtttaattcattcttttatttcaaagtcacaaaagttagttatgatttttaaaagcattaaattaagtgtcctcattttaaagtcagatgaagttcacatctctaaagggtaaaaatccaaaagtatagaaagataaaacaatcaatctgcctatagcagagttgtgaaataaataaattgttactatgaagtacttacaataggggaataaaattacctatttttgttattaaatcaaatgtgtaaggcttatttcatccatatgaggtgtcaacttgacagatgatgagtaattatgactaagaatctagcccttacttttaaaagctgacaggatttcccttgctcagttagaaaacaaaaatattcaacagattctgtgataagtaattaatcgtttaggtttgacagttgattattgtgttctttgcatattcatgtaaaactgatgtgtgaatgacattgcagtgagctagattaacggtgattatagatacagtggcctgtcaaagaaagatgtcctacatttaaaaaaaggaccttatttttgttagctgtcattatttattaacatgaaaaggcaatgatggccataagaaccaaagcatgagtatcacactgcacaaatctgggtatcacatggatgcactttgtaattatcagtgtgcttgttcttcacagatcataggaaaaagggaaaaaaaaaacaaacctttaaatgaggagaaagatggtataaatattagtagtggctgacactgagtccagatagtcttgattcctagaaataaacaaaaggtaaacaatgtcaattttgtgtgtgtgtatggcgtgtgtgtagtcatgtatatatgcggggaaaatgttaaggtattcagtcaggaaacaaaaggtttaaaactcatctttcttaaaacttgttataagcacagggaaagcaaagttgaggtaactaaactgaaccaaaaattctgtataaataaggatataagtaattaacgttttaaaaaacatgtggaccttaaacaaactgtatattaaattcctcttaaatgcccattttaaatatttaagataaatacatttatgaataacaaatctgtgggtgatttaaccatggcaccatatccaagggattaaccttaatgcaattttcctgttaattgtcctaagctttttactaatccattttccctgtgggttagtaatggcaacatgctgcttacagatattcccggggaaaaacatccagacaccagcaaacaaagaaatgttgatttctcttttgtttgctctgaaagtaaaataattatttactttaattaacatggaaaatattgtttaaattctgtacgaacctaaacaagatacgttgcagggctgatttcacagtggaggatgatcggctaaaataaagcctcatttattaagggctacacttttaacactaagaaaacatttctagaataaaaagcaaaggtaagcattattctattaatagtaaaagaggacatgggattttaaaactatacctaaattcttgcaattaacttttatgggcttggacattgttgaaatgagaaaataatataatatagcttcctggcaggttaaaagtcaacacttgattttgctattcttctgactttttgaaaccctgaagttctgaatttcaagcttttaagaagcttttcagcaatggttgtttgtttatggttcaaacatctgaaataactacctgcatttaaaatctaatgttgattattttctttttacattctgtgtggcaatggaacatttgccctttcaaacaataaaacgatttagctttgtggcagtgcttttttgtagactgactgactatacccttcaaaaagaaaaactgctctacggaatgcaaattttgaggcatgtttacctgctcgtggaagaaataaaatggaattgaaaaaaaaaggactaaaattgaagaatgaaattacagttgtgttaaaaaccttggctctttataatcatgaatcttcagtattaaaccagacattgatgctgttaatttttttaaagaactatcactcttatcgtacaggagtaaagattaaattgtaaaagaaagaaattccaattttttaaaaagtaaagcccaaaaggcaattaagcttaagtacaaaaacaaaataaaaatgaacaaaatctaaactaaagtgagcccaacaacctgagatacagcaatgtgtaacctgaaggaagataggtgtagactgaaggagtctttcaaaacaccccagcattaaatctcactctgcgctgcttctacacgtgattatagtcccagacagacgacctcatggttttttatcttgttttacaaaaggtccttgggtactctttaaaacatctattctttggcaggaaaattagctcattagaacaatgacaccattaagggacattataagggtcctggggctgaggtgggaagatttttctatctgccccatatagtttacccttccttgccttgaaaatgaatattatagaacagagtacagctcttaaaagttattagtatcattattattatagttgttatataatactttaattaagaaagatgaaaaccttttttctttcctaagtcagcccaatggtgctattttacatatcaacacagttgaaaggaagtactgttattttgggctgcagtgtttcctccacatctaaagaaagcccattttgaaactggatactgcattaaaacaaagaaggaaaaattattttaactgtgtgcagtttttgaaattaggcatttgtactattttggttttacataattctcttgcattaacaatttactgttttgtgaatcatgtgtactaaagcaaattaagaaaaagaaaataattatctgtgaaagactttgtatattaaacaagtgacgcaaaccttagttgtggtttccacaatttttgcctaacagactgatatttgtatttgcaacatccaaacacacatacattttttaagattttacaagggtctgaacatataattattttaaagcaaacctacgttgactaactcatgacatggtacaaataaataaatacacaaacagagggaaaccaatgaaaataaactatgtggactttcaaacctgctttaaaaaaagagttcaagagaaatcacaatgtaatctaaagcgggactgtctcaagaataagtcttggatatagaaaaataagcatataacagcatttttctgttcagagataatagtggattc

SEQ ID NO: 8349 - DNA, 9507 bp, Homo sapiens; identical to SEQ ID NO: 6413

SEQ ID NO: 8350 - DNA, 434 bp, Homo sapiens; identical to SEQ ID NO: 6414

SEQ ID NO: 8351 - DNA, 743 bp, Homo sapiens
  misc_feature (2)..(2): n equals a,t,g, or c
  misc_feature (129)..(129): n equals a,t,g, or c
  misc_feature (131)..(131): n equals a,t,g, or c
  misc_feature (138)..(138): n equals a,t,g, or c
  misc_feature (192)..(192): n equals a,t,g, or c
  misc_feature (220)..(220): n equals a,t,g, or c
  misc_feature (495)..(495): n equals a,t,g, or c
  misc_feature (672)..(672): n equals a,t,g, or c
cncatctcacccctctaggccatcaagtattggctgggtgcggtggtttatgtctgtaatcccagcactttgggaggcggaggcgggaggactgtttgagctcaggagtttgagaccagcctgggcaancnataacanagaccctgtctctacaaaaatatataaattagccgggtgtactggctcacaccntgtagctacttgggaggctgaggtgggnaggatcgcttgagcctgggaggtcaaggctgcggtgacctgtgattgcaccaccaggagaccctgtcttaaaaatgtatatataaaaataaaaagaacatcagacatcaccatcacctcgcttagaatccatggggccttctcctcaaattcaatcttcccaggcatttcatgaacttgcgtctagtttctgttccctctcaaattgcccaggctgtcctgtgagtgacagcagctatttcgtgggcctcctctggaatcatgagaagtcacccnaaacaatctcagttttctagctcactccgtcttgacatttctacactgtcatccttggttttcttggaaattaatttgcttttcttcattgtctttctttggagctgctttccttttgttggttactattttatttttagcttctcacaccataccgacatatgttggttattcttnttagacatgttttttgttgttgttgtcacctggaacttttgtatcttgaataaatttggggatcaaataca

SEQ ID NO: 8352 - DNA, 451 bp, Homo sapiens
  misc_feature (118)..(118): n equals a,t,g, or c
gtatttttagtagaggcggggttttaccgtgttgaccaggatggtcttgatctcttaacctcgtgatccacctgcctcggcctcccaaaatgctaggattacaggcgtgagccaccgncacctggccctaaaagtagccttcttttcccttttaaagagttagtgtccatagctactggatgccattttggttcaggtggaccgtgaataggtttcactcatcatgcccaaaggttgccactcctgacaagtcacagacaacgcttgcaccatcatcttcttccttcagagtctgtggtcccctggatgtcactaaggtcctgcttcctgtaccaataggttttaaacactacccaaggcaggctggctttaaatatcctacttaatctggctgacaggctctccctgcacctctggtactctgctgcctcattaacagctccggctactc

SEQ ID NO: 8353 - DNA, 594 bp, Homo sapiens
  misc_feature (23)..(23): n equals a,t,g, or c
  misc_feature (119)..(119): n equals a,t,g, or c
  misc_feature (259)..(259): n equals a,t,g, or c
  misc_feature (451)..(451): n equals a,t,g, or c
  misc_feature (533)..(533): n equals a,t,g, or c
  misc_feature (535)..(535): n equals a,t,g, or c
  misc_feature (576)..(576): n equals a,t,g, or c
cctgggcaacatagtgagactgnccccccccatctctacaaaaaataaaaatcaaaaataatactgtgggcaaactttacttagattttattcagagtagtgcctgtttatttttcatnctgtgctacctgtgccggcattccatatgcatttgatttagtctttaaagtaccccggtaaaataggtcttttgtctgcatttttcagatgggaagactgaggttttgtttatttatttttatttatttattttttgagnacggagtctcgctctgttgcctaggctggagtgcgatggcacaatcttggctcactacaacctccgcttcctgggttcaagcgattctcctgcctcagcctcctgagtagctaggattacaggcgcccacaaccgcacccggctaattttttgtatctttagtagagacagggtttcactatgttgtccaangctggtttcgaattcctgacctcaggtgatccacccgcctctgcctcccaaaatgttgggattacaggcgtgagccaccacngncccagcctatttatttatttttttagaatcaagatcttgcntatgttgcccaggctgaa

SEQ ID NO: 8354 - DNA, 2866 bp, Homo sapiens
cctaaattctatttctgtcatttcagccagctcagcctggataaacactcttgttagagaatttgtatggtcatttggagcacatatgacactctggccgttttaatttttggagttcttgcgttagttctttctcatctccatgtgtgggtgttcctttaactgccatatagattgagtacagtcaatagatttctggctgttttcactaggctgaggccttgtgcagggtctttttttgaagctgacttcttgtctctagtttcagaggtgagtatgttagtgaggtattcttggtgttgaagctttggggtgtgatccagtaggtggcacttaggcttattggtcaactggtagactcttgctcagttgtgtggctcctctgtgttttctcatagttacagctgtgttcactctcaatgctctgaaagtgtgggttcctctcccccttcagtgccagctgtatggctatagattgtggtttgacactcctggctgcccactgcagctctggggcaatgtcagtgtttacgttccttcctcaacttggcggcaacagaggaaaggaccttagtagtggttgtggtcaagggtcttttgcttgtatcctgggagctccacaccagagagatgtaggtcagcaattcctcagtgcaatcaccccaggatgaagggtctgtgctgtgggctcaagccaggggttctctctggtgatgagtgggggttgggggtgtgggaaccatgggagacagactggcctcctcttcttgggttgattgcagcttgttggaggtataaataaggtacttagggtcttttcttcttcattagtctgagggtagcaagggcagttctactgcagagacagtggcagagaggctttcaggaacagtatttattaaccaattgtttcaacaaatatttattgacaattcaacatgtaccagacactgtgttaggcaaggggtcttcaatgggccacaaatagatgtggtccttgaccatgtcattggagcttaatgggagagactgatagtaagcaagtaaacaacaacaaaaaaataaggtaattcaggttgtgacaacctctctgaaggaaatatataggatgctataaaagtgactagagcaaggaacggcctaattgagctaagataatcaggtagggtctctgtaaggagttgacattaagctaacaactaaagaataagaagccagccatgtaaatagcttggataagagctttccaggctgaagggaatggaaatacacaggcctagaggtaagaaggagatgggtgtcttccggaaactgataaaaagtcagagtggctcagatatgctgatatgtcccctggtattttttaaaatttttggccgggtacagtggctcatgcctgtaatcccagcactttgggaggccgaggtgggcggatcacgaggtcaggagttcaagaccagcctgactaacataatgaaaccccatctctactaaaaatacaaaaattagctgggtgtggtggcacgtgcctgtaatctcagctactcagaaggctgaggcaggagaatctcttgaacttgggaggcggaggttacagtgagttgcgatcgcgccactgcactccagcctgggtgacagagcaagactccatctcaaaaaaaaaaaaattaatttttgagggtatattgtaggtgtatatatttatggggtacatgtaatattttgatacaggtattcaatatgtaataatcacattacggagaatggagtattcatcacctcaagcatttattctttgtgtcacaaagagtcccattatactcttttagttattttagaaagtacaattaaattattattgactatagtcaccctgttgtgctatcaaatactcggctttattcattctttccaactattttttttgtacccattaaccatcctcacctccctacccgccccacccctattacactacccagcctctggtagccatccttctactctctattttcatgttttcaattgttttgatttctagatccaaaaataagtgagaacatgtgatgtttgtctttctgtgcctggcttatttcatttaacataatgacctccagttccatccatgttattgcaaatgacaagatctcattcttttttatggctgaatagtaatccattgcagataagtgccacattttctttatccattcatctgtgaatggacacttaggttgcttccaaattttggctgttgtgaatagtgctgcaacaaacatgggagtgcaaatatattttctatatactgatttcctttcttttgagtatatacccagtagattgttgggtcatatggtaactctatttttacttttatgagaaacctccaaactcttctccatagtggttgtactaatttacattctcatcaacaacatatgagggtttccttttctctacctcctctccagcatttgttactgccctggtgttattttgcttcttaagtattagaactatacttagtgttatatgttctgtgattataagtaaaactgcctttgctatatagtatgcatagaatattttaaagttattactagaagctgacacattgttgttttctattacaaacaataaaattagtttccatttattgagggcctgtttcatgttaactgctttacaaatattccttatctcatttaattctcccaacaatcctacaagaaagctaatattatcccattttatagatgaggaaattgaggcttacagagggcaagtaacttgcccaaagtcactcagtaccagcaaacggacttttccccctctccctgcccccaaataccagccccccactgca

SEQ ID NO: 8355 - DNA, 2858 bp, Homo sapiens
cctaaattctatttctgtcatttcagccagctcagcctggataagcactcttgttagagaatttgtatggtcatttggagcacatatgacactctggccattttaatttttggagttcttgcgttagttctttctcatctccatgtgtgggtgttcctttaactgccatatagattgagtacagtcaatagacttctggctgttttcactaggctgaggccttgtgcagggtctttttttgaagctgacttcttgtctctagtttcagaggtgagtatgttagtgaggtattcttggtgttgaagctttggggtgtgatccagtaggtggcacttaggcttattggtcaactggtagactcttgctcagttgtgtggctcctctatgttttctcatagttacagctgtgttcactctcgatgctctgaaagtgtgggttcctcgcccccttgagtgccagctgtatggctgtagattgtggtttgacactcctggctgcccactgcagctctggggcaatgtcagtgtttacgttccttcctcaacttggcggcaacagaggaaaggaccttagtagtggttgtggtcaggggtcttttgcttgtatcctgggagctccacaccagagagatgtaggtcagcaattcctcagtgcaatcaccccaggatgaagggtctgtgctgtgggctcaagccaggggttctctctggtgatgagtgggggttgggggtgtgggaaccatgggagacggactggcctcctcttcttgggttgattgcagcttgttggaggtataaataaggtacttagggtcttctcttcttcattagtctgagggtagcaagggcagttctactgcagagacagtggcagagaggctttcaggaacagtatttattaaccaattgtttcaacaaatatttactgacaattcaacatgtaccagacactgtgttaggcaaggggtcttcaatgggccacaagtagatgtggtccttgaccatgtcattggagcttaatgggagagactgatagtaagcaagtaaacaagaacaaaaaaataaggtaattcaggttgtgacaacctctctgaaggaaatatataggatgctataatagtgactagagcaaggaacggcctaattgagctaagataatcaggtagggtgtctgtaaggagttgacattaagctaacaactaaagaataagaagccagccatgtaaatagcttggataagagctttccaggctgaagggaatggaaatacacaggcctagaggtaagaaggagatgggtgtcttccggaaactgataaaaagtcagagtggctcagctatgctgatatgtcccctggtattttttaagatttttggccgggtacagtggctcatgcctgtaatcccagcactttgggaggccgaggtgggcggatcacgaggtcaggagttcaagaccagcctgactaacataatgaaaccccatgtctactaaaaatacaaaaattagctgggtgtggtggcacgtgcctgtaatctcagctactcagaaggctgaggcaggagaatctcttgaacttgggaggcggaggttacagtgagttgcgatcgcaccactgcactccagcctgggtgacagcaagactccatctcaaaaaaaaaaaattaatttttgagggtatattataggtgtatatatttatggggtacatgtaatattttgatacaggtattcaatatgtaataatcacattacggagaatggagtattcatcacctcaagcatttattctttgtgtcacaaagagtcccattatactcttagttattttagaaagtacaattaaattattattgactatagtcaccctgttgtgctatcaaatactcggctgtattcattctttccaactattttttttgtacccattaaccatcctcacctccctacccaccccacccctattacactacccagcctctggtagccatccttctactctctattttcatgttttcaattgttttgatttctagatccaaaaataagtgagaacatgtgatgtttgtctttctgtgcctggcttatttcatttaacataatgacctccggttccatccatgttattgcaaatgacaagatctcattcttttttatggctgaatagtaatccattgcagataagtgccacattttctttatccattcatctgtgaatggacacttaggttgcttccaaattttggctgttgtgaatagtgctgcaacaaacatgggagtgcaaatatattttctatatactgatttcctttcttttgagtatatacccagtagattgttaggtcatatggtaactctatttttacttttatgagaaacctccaaactcttctccatagtggttgtactaatttacattctcatcaacaacatatgagggtttccttttctctacctcctctccagcatttgttactgccctggtgttattttgcttcttaagtattagaactatacttagtgttatatgttctgtgattagaagtaaaactgcctttgctatatagtatgcatagaatattttaaagttattactagaagctgacacattgttgttttctattacaaacaataaaattagtttccatttattgagggcctgtttcatgttaactgctttacagatattccttatctcatttaattctcccaacaatcctacaagaaagctaatatcccattttatagatgaggaaattgaggcttacagagggcaagtaacttgcccaaagtcactcagtaccagcaaatggactttttcccctctccctgcccccaaataccagccccccactgca

SEQ ID NO: 8356 - DNA, 621 bp, Homo sapiens
ctgagaggtccactgtaagcctgatgggatttcctttgcaggtaacctgcgttttctttctggctgcctttaacattctttctttcatttttaccttggaaaatctgacaattatgtgtcttggggatgatcttcctgtgtagaatcttgcaggagttgtctgtatttcctgtatttgactgttgtcctctctagcaaggttgtggaagttttcatggacaatatattgaaatacgttttccaaactgtttgctttctcccccttcctttcagggatgacagtgatttgtagatttggcttctttacataatcccctacttcttggaggttttgttcattcctttttattcttttttctttatttttgtctgactgtcttatttcagaaagccagttttcgagttctgagattctttcctcagcttggtttattctactattaatacttgtgattgcattgtgaaattcttgtactgtgttattcagctatgtcggacccattaggttctttattatactggctattttgtctttcagctcctgtatcactttattgtgatttgtagtttctttggattgggttttgctgtcctcctgaatctcaatgatcttcattccta

SEQ ID NO: 8357 - DNA, 156 bp, Homo sapiens
aaatgagtttcttatgtcttccttttctacatagacatgggaacagtctgatctctctttcttttccctacaatcattccacccctggcccctctcaaaactcatgtcctcacatttcaaaaacacaatcatgcgctttcaacaatcctcaaaaaa

SEQ ID NO: 8358 - DNA, 156 bp, Homo sapiens
aaatgagtttcttatgtcttccttttctacatagacacaggaacagtctgatctctctttcttttccctacaatcattccacccctggcccctctcaaatctcatgtcctcacatttcaaaaacacaatcatgcgctttcaacaatcctcaaaaaa

SEQ ID NO: 8359 - DNA, 621 bp, Homo sapiens
ctgagaggtccactgttagcctgatgggatttcctttgcaggtaacctgccttttctttctggctgcctttaacattctttctttcattttcaccttggaaaatctgacaattatgtgtcttggggatgatcttcctgtgtagaatcttgcaggagttgtctgtatttcctgtatttgactgttgtcctctctagcaaggttgtggaagttttcatggacaatatattgaaatatgttttccaaactgtttgctttctcccccttcctttcagggatgccagtgatttgtagatttggcttctttacataatcccctacttcttggaggttttgttcattcctttttattcttttttctttatttttgtctgactgtcttatttcagaaagccagctttcgagttctgagattctttcctcagcttggtttattctactgttaatacttgtgattgcattgtgaaattcttgtactgtgttattcagctatgtcggacccattaggttctttattatactggctattttgtctttcagctcctgtatcactttattgtgatttgtggtttctttggattgggttttgctgtcctcctgaatctcaatgatcttcattccta

SEQ ID NO: 8360 - DNA, 14769 bp, Homo sapiens
cctccccatagggttcccagcaccatgagggcctggatcttctttctcctttgcctggccgggagggccttggcagcccctgtaagtacctaaatatcatgtcttcttgttttcattcctaccgctagcaccaggggttctgagcctgccagccctggatgctgaaagggaacagggacttccccatttcaagttagtggtcttttttttttcttaagttaggaagctcgggataaaaactgggatgaggaccattgggtggaggtatcagagaagagagagttccatgtaatgttagataaacttcttagtagtcagagcctcccagcaatgaactaggattgctttagaaggaaatgacctctttgtcatatgaggaattcaagcaggcaggagacaggatgtgggggatttctggtaggggtggtattagaagagattcaagctatagagagaggaatgtgttggcttctgaaacagtgagggttgtttggttgtaagcaacagttcaatctgactaaattggggaaggaggggaagatacagaggtagattataatattaaaggccttggggaggactggaaaagggcagctctaggctttgggagttaagaactaatggacagtctctgagatattgctgtctgaatgaatcaactccagcaattttcacatcttgagagaatgtgccaagaaggtttttataaattcaaaaaatgagagccaatctggctgagcttgggtcctgagccagcttcttggccaggtgagagtggggccccttgattgacagacagttcctcgaagcattgcatgcagggacaggagtagttatccacagctcatctggaagccttcacaaggagaggaggaagaaacagggcaggcaaaaagtgcaatttctttcaacctgtgatcccctcatcctctgtttactaagaagtgggagtgatggcagaccctggcaatcttgatcaggctggtagatggaggcaaaagtttctcaaagttggcattaagttttgaagcagctccagccagctaagggcctcaaagttgtgtgttttcttgcttcctcctactccaagttgaaatggcaagaaaaattgcctaataatactactaataatatcacactgtgaggaagatgatgacatctgttaaaattcacagtgtcatcccctctggatgtcaattttcctatctgtaaagtgaaagaattggtctggatcagtgattttcagactttataagaattcaaagcagcagaaatacttttccaagctaaatcttaggtagacacctaggatataaaatatataaaatgggagctgcttgagtgttccacggtgctcacatgactggcttcttctttgttctgtccctcaccatggcagtccatgaggcacaactttggggatctccagtaagctgctctccaagctcccctagcctgtatccgaggccacaggcactttggaggtgaagctggccttattcctgacccctctgaacgctactttctctttccaacagcagcaagaagccctgcctgatgagacagaggtggtggaagaaactgtggcagaggtgactgaggtatgtgggcagtgaccgcagccccttagcccctctctacctgtatctgtgccctgagaaattagggcggatgctgtgggtctcaatgctagagtggggcattcgtctccctgtacacacatagcatagatgcaaaccctgagtatatcccacatcctgacacactcctgaatgcttcccaaaccttcaacggaaccctacgtttggggaccaggaccttaaaatttttgttttttaagctatgcaacagttgttcttccatgattacccacagtttttgcaaacgtaaaacagaggaggccgggtgcggtggctcatgcctgtaatccctgtaatcctttgggaggccgaggcaggcaattcacgaggtcaggagttcaagaccagtgtggccaacatggtgaaaccctgtctctactaaaaatacaaaaaattagctgggcgtggtggcgggtgcctgtaatcccagctactcgggaggctgaggtaggagaatcgcttgaacccgggaggtggaggttgcagttagccaagatctcgccactgtactctaccctgggcgacagcatgagactccatctcaaaaacaaacaaacaaacaagcacacacacacacacacacacacacacacacacacacacacagaggaaaggggagatgcttgggtgtggctggcaggggtggaggcttgacaccctcttgtgaacatagatctcagtcaatttagaaagtttactttgccaaggttaagaatgtgcctgtgacacagcctcaggaagttctgagacatgtgtccaaggtggtcgggagtacagtttgctttcatacattttagggagacacgagacttcaatcaacatgtctaaattgtgcattggttgagttcgctaaggcaagacaacttgagaagtgagggcttccaggttagaagtagataagagacaaatggttgcattcctttgagtccttgatcagccttcccctgaatacacaatttaatctggctcagtgaatctgcatttttacataaacaataggggagaggaagcaatcagataagcgtttgtctcaggtgagcctcagagggatgactgcatagaataggaggcaggtttgtcctatgcagttctcagcttgacttttccccttagcttagtgattttggggtccaaggtatattttcctttcacactctctttccctaacacccctggtgacctctaaggcagctcaacagaatcccaggcatactgcaaaacacagcaggcctatagattaaatctggattcccaaccctgcgtttgtgctttctgtgacctggaacccttcagctacccttatgggtctgggatgggagtggggccatttcacccattcttctccctcaattccaggtatctgtgggagctaatcctgtccaggtggaagtaggagaatttgatgatggtgcagaggaaaccgaagaggaggtggtggcggaaagtatgtcccttccctgtaacttggcacatccaagctgcccttggctgcctgggcctggggcacgaggacagcctacatgaggctccttccagcagaaatgcagggtggggtcctcagtgggctatgaaggaaacacggctttgacttaacaagtgggaaactgtggcactcagtcccctgggatctgggcaagatcggtttccaggccatccatgtgtgtggtaggaaggagagttctccagctggaaatgggcttctcccctcatagctctttgccctgagtccaaagctgagtttcccagtcccacggaggtcgctgatcacatctggtcaccgaaatctcccattgcttctgtatcagcccgtgccccacagagaagtagaactgagagaagagatcaggaacttgcacactcataagctcattctatttcacacagtccaaggaaacgaggtcctgaggaaatgcaacctgacataatccgtaccatgctatccatgcgttagtgccctgggagagaaatgacctaggggctctggctccagccctaggtgcaaagcatttgtactcaaggggttaagagcaaggactttggaagcggtccaaccaagctttgaacctaggcttctccacgccagcttgcttagcatctcggagcctcagtttctcatctctcatatggggctgatgaagatggcagacccttgtcccagggctgccgggaagttttcagacaagctgagtaggcatccgctaaaggattattaaaacacccaaaataaagcattgcgaggaaaaggccacattaagctctcatcctgaggggatagctaatggtatttgatctagctgggcacagggtttctgttgaacagagggacatctactgagtcatgttccttcccgcctccacgcccacctcatccggtgtttaccaggctctattgtccagcatggactttgaggctcttctcccttttcctttactgccacttaagtctgttttgttgggcctcagctccctggctcagtgtcaacagctgactttctaagccattctagaaagcttattctggaatccagaaatgccccactgtgattgttcaatggagacccaggaacacaatggttgcttcaatcttcaggaaagccatatggtatctagtgtttctgggtcccagactgagcctccagccccccagaagtgcctgacctctatctcaagctaaacctctaatccccaggctgaaccagctgctgccctaaatgttgactgtgaggctcagtgcaagagcaggcaggactcagggctgtccaaagcccagagtgggggccacagtcaaggactgtcagccctgagatctgtccaggtaggatgggggtggatgtgctagtccaggtgatgctaactcccttgtctttctgccctacagatccctgccagaaccaccactgcaaacacggcaaggtgtgcgagctggatgagaacaacacccccatgtgcgtgtgccaggaccccaccagctgcccagcccccattggcgagtttgagaaggtgagggctgagagacaggggcagggggaagggattgggcacttcggaatacaggatgtctgctcaggaaactgttggcttggtggttctatggggcagtgccagtctcagaagtccccttgctagacctagtcccagcaggaaagaggggatgagtcagagtgctctgcctggcactggatcttttcagcaaccagcaagactttaaacagcaccatcaggttccaagccctgtgccagactcttagagctaagagtataacagcatcagcaaagaatcaggtccaaaaatacgggttctggggccaaactgaaggttgacttcaaacctcatctccatcacttattaggtgtgagatttaagctaagttgccgaaccttttcaggtctcagttttctcacatccaaagagaggataaaaatagtccttaactcatagatctgttgtggagatgtgtcagaaatgtttggtacataacaagtatccaataaatgctacttaattttaaattatctctcaaatatgtcccttctctccaataggatccatccatccgtccaagtaaatattttttgagtgcctgctcctgcctaccatcatgctagtggcagtctagctcatggcagcaaatctagggccagcactattcctacagcctcccatctggcttctccatcttcagtttctccagagactacatagcctctgggctccacattttaatatcattgttaacattttcctcctcctcacccctccccactcccagtgcccagtcaccagtgcccatcagttctccctctgcagtgacatataagctatactaaataagtacggacaggatgttcaacacaggctcccctcctcctaacacagctacttacggccactgcatgtccagccctcaacatctctgcttggccacccctatgttcagagatcgactaggactccattggctcagcatacagttgtactcacacctaaggtttagtacagcgacatattcaggatatacagctggatcgtaagggaaaaagacactagcagagtctggaggaatctgggtggagactgactgactcccaagaggggtcatcagagtgcattcttaccccagctacaaagaggcagccacatgtgagtgatgtttctttccagggaagttcattagagactcagcacccaaagttttaattggaggctggtcacataggtaccctttgcctagcatgcaccagaatttcacacttccagaaggaaagcagatgttcagcataaaccagattgtttgtacaaacagtccaggcatagcgagccactcttatcagttagggaaagatttacaacagtgcagagaactgtttcccagctaagttcccagacaccagccacaggctgaccttacaagcaggccttttctaaggataacaattccaggcctgctatgttaactcttctttgaacactcttgtttctctcccattcctgtctttaactttctcttcaaatatcttccaggatttttttccctatatctcagaactgactcagtcatgcctctgctcagagaccatcgatggctctcagcctgggctgagcattgacctgggaacccaaaaagtggatttgtggcccagccctatcactaactcactatatgacctcaggctaatgacattccttgcttaaccctcagtgtccccatctctgaaatggacaaggatattggtatcagcgaagggctttgggaatgaaggagggggtactctgtgctttgccaacaggtgtgcagcaatgacaacaagaccttcgactcttcctgccacttctttgccacaaagtgcaccctggagggcaccaagaagggccacaagctccacctggactacatcgggccttgcaaatgtgagtgtccttgggcccttccagactcctgtcttggggagagagctctgagctggcactgatgctgtctctgccacccccatgctgggtgatcttgggcaaatctctctccctttctgagtctcggcatccccatttataaaatgaggtaattgtctatgagttggctcctctcaactctgagttcagggcactttctggggaaggactgagcgattatggaaggtcaacatcagggaagatttctggagtctctcactagcatctgagacaactgcatttcatttctctaatgaggaagaatttcttctctcaggctaagttgaatctttcttgcttcaacactgtaaagcaaaaatgatgtttgacctgggcctacaaaatattttgaaaatatctgattttgaatgctttaaaataagggcatgcctgtcggtttgctttgggccctgttacttggtactgtcatatcttcacccttttactccattacattcctatctgccctccgaagagagaggataagcaccctcttctggaaacctgggagtcagttgtctggggagggatgccagggtgtggtctgatctttggttagtgaccccagctgcaaactcagtggggccaagtgccttgttcagtatcctccctatcatgggagacccccaagaccacacctgctccccctccaaggcaacatccacactgtgggtcttgtgtattctggcacccgatggcaatgaggagagccactcacctacctcaggtgtacagggtgcagaaaagtatgtagggggtgggaaacaaagttctcctcgtgggaccccaggtatgaaattgagaaggtacagagtagaaaaggagggttgggggaagaagcatgggtaggaagtccctgggcagcaagactagagagcctgtcttaaggagtctttatgaagtggctttgctttccctgaggcatgttgcccactcacttcaactcctaaggtttttatcaccagatattctctcccagaccccagctgatgatgaaggtagcctcacagaggggactttccctggttcaatgatgagggaagaacagacccctaagcccccaggtgaccacactgccctggatgctggatgaggctctgacattgtggccttgagcaagtcccttctctccatgctgacctctaataagtccagtacaaagtgtgaacctgggtcaggcgcggtggctcacgcctgtaatcccagcactttgggaggccgagtagggaggatcacttgagctcaggagttcgagaccagtctgggcaacgtggcaaaaccttgtctctggaaaatatacaaaaattagctgggtatggtggcatgtgcctgtagtcccagctactcaggaggctgaggagggaggattggttgagtccaggaggctgaggctgcagtgagccgtgattgtgccactgcactccagcctgggcaacagagtgagaccctgtctaaaaaaaaaaaaaagaagaaaaaaagaaaaaagaaaagaaaaggaaaagaaaagtgtggacttggatgaaatcttcaggtccaacatttgggattctaagttccaaagaccaggttggaatcatttctaagaaggttctggtggttacacattcctgagtcctctactccccactccctgccaagctgggcctgtggatagatgtgatccctcagcctcccagcttcaaacacctgccagtggttgacgtgaacaacatgggctcagtctcagctaggatcacacccaaagcccagcacccagtaaggtgcaggagccatccatttccctgagcagagcagattaggctgaggaaagcagcagccatgcctttgcacaatgcatttctagggcattcttcccacacataatctcctctgctcattgtcctgtgaagaaactgtggcctggagaggttgagccactgtgccaaggccaccaatgcaggtggtatgtgggtgggtgggggcctggggtggggagcacggcccaggcagggtctgtgctgaccgcccttgtgtttggaacctagacatccccccttgcctggactctgagctgaccgaattccccctgcgcatgcgggactggctcaagaacgtcctggtcaccctgtatgagagggatgaggacaacaaccttctgactgagaagcagaagctgcgggtaagtggtctctctggccttgctggccccgtgctggtgaagatccagtcccattcctagaactgggcccccagctgcagggcggcatcctgctccggagcgtgcatttacccctgagcaccaggacacgtacttctcttcctgcctttggaggctgtggtgcacattaacatcttagaggctctgagaagtcctgcagcagagacctgctccctttgcttaacctaacgttaaacaaaagagacacaaacagccctattcctttttcctttggagtctgtggatcttaagctttaatgagcatattaactaccccaagaagctgataaaatgcagattccttggccccatctcaggccactgaaacagtgtctctagaaagcaaggcccaggaagctgcattctaaatactccccaggtgatttatgtttattttatttttttgaggcaaagtctcactctgttgccaggctggagtgcagtggtgcgatctcggttcactgcaacctccacctcctgggttcaagtgattcccctgcctcagcctcctgagtagctgggactgcaggcatgctaccacacctggctaatttttgtatttttagtagagatggagtttcactgtgttggccaggctggtctcaaaactcctggcctcaggtgatctgcctgcctcagcctcccaaagcgctgggattacaggtgtgagtgtgtgcccggccttcgccaggtgattttgatgtgggtagctatatggagaattctttgaggtcatcccaggcttctatttttgtgaatgagatgctagtacccatctatgacacctccctcccctcgctgtgagctttggtctggctagtctctgcctgctctggccttctgggaggggtgggagggcccgactggtccagacaatctccatggacctcttgtcacacacagtctctactccctcaggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtaagaccccagaccctagagtgaacagagctcaaggctggcaggtgcactagctatggccagaaagcctctcagcagcctatactgctccaagccctggcatccacagtttgcctggggattggagcagaaggatgaggcatctggagaaaagatgtggacctgggacaaagaaaccgataagacactctcatgctgaggtgaaagtcagtaggagctcaaaatagctccataatcctgcaagtactaggcgtggatatctggataatgaaggagtgtgaattaagaaggagtaccaggctccaaggggtggcaggggacaaggttgggtcagccacacgccccctgtccttcagcagaacatccaggggcagagcagccacctggcactgtctaagccccctcctaaggctcagccccaatagggcccaactgaccctggaagttatccaaaaaagcctgtctattttgcaagcccccagtttgagggctcttgtcccttgtccaaacgagttatgaggccctgtgcaactgcactgccgaacaggcaggcagctggccagttagcaaatgcttatggagtgtgcattttgtgccctgcactattctaggcaggggattgaacagcagtcagagctggcatggtccttgccctcatggacttatactctgttcataacctgtcactaccttctgaacttctcttgtggtgatgaagtgagagcccctgctcagcctcagatggagcaagctacacctgcaccttcccagagtggttttttcttcgtccttgggttgtggaagcagagcatcacacagaggggaaaggaagggctgccctactcacatactcagggaacttcctctctaggatgttcacccctcgctctttgtccagcctgtgtgcctggagtctgccaaccctgccagtgatcctgagggctggggtctcctgggctctgggaatctcccggccacttctctcccaggcttttgccatggctgggatccaactgagtcactcattatggcagggaggggaaaagtcaaaggggaacatctggagctcaggcaaagcaatttgatcccactgcaacagagggcctggagggaggctttcagatggggtgcaagaacagcacatctgggaaaggggtccagcttgggcaaggggacccgcttcctcctcctcccatcccagggctgtaggtgaccttgcctgcatccctgcccctccctgggcctcagttttccaccagtacaatgaaggggaggagaatgttcctatcagttcaaacattgtgtgatttctttggtgagctgggtggggctgcgaggtctagaggttaagaagacaactggagtcacattgttccctggagatcctttgtggatctttagggacaagtagttgggggctctgggaaacaaagaaaaaaattatacacatgctctggagtctaaggccagcagggagaatagggagggaggacagtgggagagacatccaaagggcctccctctcagacattacaggatacacaagcaaagctctatgaagatggttagagctcccgttgaccctcactgccaatcccagtccctttccacattcctccccagaaggcagcactgtcaccagattggtgtgtcatttttagaccctttactaggcatttatagatgtataaatgtgtgtccatagacaatatacagtgctgtgtcatgctagattttgatctacccatagcagaagtgctgaattttgattttaagtttctgtgtccccagttctcagccaattaggaaacaatcaaatacaccaaacagacctttgtttttgagaccctgaaaccttagagctggaagggccgttagtaattatggccatctcctcctctttgctggaaggagaaactgaggttccgaatggtgcactgctgttctctgagtctcagagcagtcagtggcagagctaggggtagacctgggattctggctttttgtcctgctttaaatatcctttcctccatgctctggggcaggctaactccccggttgcctcccaaggctgggtgtggagcttttccatgcctcaggccctcccctgcctccttccctgcaggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagagtgagtgtctgaacaaagaagcaaggggcatgggcagaaacactgctcccagggtgctgggttgtcatccccccactctccgctctcttggtctgtctgttgtctgtcctctctgcctgtctctgctctctctgcctatttgactcctgtctcttgggcgtcttcctgatccttctctgtccatccaactgtccctctctctttcccttcctcaagcgttagcactcacccgtgctaaacactattttgggaactggcaggcacacagagaggaaacaggaagtgtaacttggcagcgtgtgtaagagacagggacaggccagagacagagagagcgagattcctccgtcactgacttcctgggtgaccttgcatggccacctagacccctgcccctggggatgggtgggagtccactgactccttgggaagtgcgttatcatcgacacagccttatttttaaccgtgctcttttcttgctttgcagaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgccttcctgggtgatttgcatgtgtcttagtcttagtcaccttattatcctgacacaaaaacacatgagcatacatgtctacacatgactacacaaatgcaaacctttgcaaacacattatgcttttgcacacacacacctgtacacacacaccggcatgtttatacacagggagtgtatggttcctgtaagcactaagttagctgttttcatttaatgacctgtggtttaacccttttgatcactaccaccattatcagcaccagactgagcagctatatccttttattaatcatggtcattcattcattcattcattcacaaaatatttatgatgtatttactctgcaccaggtcccatgccaagcactggggacacagttatggcaaagtagacaaagcatttgttcatttggagcttagagtccaggaggaatacattagataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcctaaaaaatcaaactg

SEQ ID NO: 8361 - DNA, 465 bp, Homo sapiens
gtaggtgggagatgtaacatttgccctgtggactgaatgatgcagtctgtcccttggtcagcccagggcagatcatacatggaatacatgttactatcacggtagctctgccaccaacttactgacgttcagggagcttgggtgacttggtcatgtgatgaggcaccgataaagggggagaactggaacctggagcttcctccctcatatctggatgtttcactatagggagctccaaagtttaaaaaaaaaaatcagcatcaaagagccatgatgtatgaatcagctcagggccccgggcgggaggacagggtagggctgcatgccctgctggcttcagcaaaattcatcagctgagttaacagggtccctcagaatccagaacccttaagggtagagcttctatatcctccttctatctgtccttctccccacttcaaatcaatttttttaaaaaaaaaaaaa

SEQ ID NO: 8362 - DNA, 174 bp, Homo sapiens
ggaaaaaactctgtgtacctttgtcataaatagaaggaaactgtaaaaacaaacacataaaaaaaacaaaacaacttgattcagttccagctggatataacttcctgtggaagctctgagctggaggcttattctctttttgttaaaaaaggagatagatgagtataaaggagg

SEQ ID NO: 8363 - DNA, 1014 bp, Homo sapiens
gttaattaactgctctgtgctgtagtttctccatctgtaaaactgtcaaggtagtagtacatgtcattaggattaagtaaattaagctatgtaaaacacagataacattggatgacaccaatggttaggcagcagatacatttattagtaaagtgcaatggaaattttcctcttgctggataagagtaaactaatgattagacttgaggatggcttaactaagaaagaaagtgatcaagaaggtaagagtagtaatgattggttttgagaatttaattttctgtgcttatcatggaataaatttagctgaattaaaatgcattataattacaagagttaggataccttaaaatatctagtgaggctgtataacctagcaagatcaaacaaactcattgctattggattttaagaaattggattgtcaagaagataagtaatcaatatggcttggctgtgtccccacccaaatctcatcttgaattatagctctcattattcccacatattgtaggagtgacctggtgggagacaactgaatcatgggggcagttttccccatactgttctcgtggtagtgagtaactctcacgaaatctgatggttttataaggggaactcccttttgcttggctttcattctgtcttgcctgctgccatgtaagatgtgcctttcgccttatgccattattctgaggcctccccagccacgtggaattgtgagtcccttaaacctctttttgtttataaatcacccagtcttgggtacacctttatcagcagtgtgaaaatggactaatacagtaatcttgcaagcctgcacaaacttgcgctttgtataaaaagccacaataataaaacttgttgagaatatcctaccaaaattactatgaaagttatctctcccttttactatgagcagaggtggcccattagaataatatggttgtctctggattatgtataataagaaaatgtgtgtatacaaataaaatgcatttattatgaagtaaa

SEQ ID NO: 8364 - DNA, 585 bp, Homo sapiens
tcctcagggatctagaactagaaataccatttgacccagccatctcattactgggcatatacccaaaggattataaatcatgctgctataaagacatatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaataaaccaaacaccgcatgttctgactcataggtgggaatcgaacaatgagaacacatggacacaggaaggggaacgtcacacaccggggcctgttgtgggatggggggaagggatagcattaggagatatacctaatgctaaatgacgagttaatgggtgcagcacaccaacatggcacatgtatacaaatgtaacaaatctgcacgttgtgcacatgtgccctaaaacttaaagtataataataataaaattaaaaaaaaaaagaaatctacccaa

SEQ ID NO: 8365 - DNA, 279 bp, Homo sapiens
ctcacgcctgtaatcccagcactttgggaggccgaggcaggcagagcacgaggtcaggagatcgagaccatcctggctaacatggtgaaaccccatctctactaaaaatacaaaaaattagctgggtgtgttggtgggcgcctgtagtcccagctactcaggaggctgaggcaggagaatggcgtgaacccaggaggcagagcttgcagtgagccgagatcgtgccactgcactccagcctgggtgacagtgcaagaccccgtctcaaaataaaaaaaa

SEQ ID NO: 8366 - DNA, 1502 bp, Homo sapiens
ccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactcta

SEQ ID NO: 8367 - DNA, 1502 bp, Homo sapiens; identical to SEQ ID NO: 8366

SEQ ID NO: 8368 - DNA, 457 bp, Homo sapiens
atgctgaaggtggggaagttagaaaaatagaacatctcctgacaggtagaagacgggatccttggaggcgttcctttgggatttcattttacctccatctcgtttgttgtccagtttccttttacgaggattaagcaggcatcctgctggctagaatcctgtggcttccctggagcctcaaattcttgtctaaccacatttctagtcatggttcctgcaggagacatccactcaaaccacctgttactgaggcaccaagcaaccctagaggcagttggcctctggccctagcaggagcaggatctcaggccatcccaccaggcagccagcctcagcccctcaccgcagccttgcagagtgggctctgcagagaagccgatttgtggacagtgccaccctccatcctgagtcacatggctcatgtggttgcagccatttttgagccaggagggggccc

SEQ ID NO: 8369 - DNA, 457 bp, Homo sapiens; identical to SEQ ID NO: 8368

SEQ ID NO: 8370 - DNA, 2444 bp, Homo sapiens
ccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcttccagccccgctgagggtaaaccgaggcctctggcagctgtgcacaggtgctggcctctggctccttcaaggagcactgcctgtcactcgctcctgggctgtctagccatgtctcccacccccactttaccgcagccagctgctgggatcaaagcaagtctgttcttatgttatttgcctgtatgaaatcatttctcattttatcacaattccttcaactcagcttactcgcgtggctgcctgttcatatttgaaagcagccaccgtgctgtggctttggtttggaaaagcatagcacgcacttcccttggttttcccttcccagagccgaccgcagctggtcagccctctcttcccgctcctgaacctttacttactgactttgagctctgtgactccgtcggttctcgcaggaattaactaacttaccaattggttcaatccacttgagcgccatagctctgagctcctctgtgtgacatgccacagatgactattgcacacctgggtcctgccccagcaggccatgcccctcccatgtgccgtgcctgttgctgcagctgcccccccaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgaccttattatttttgaaaatatgttaagggttttttcatagagagagaaagaatggatttttttttaactgggaacctcctgattcttacggaaaattatccttctataagaagataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgattttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctggggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgtttgctccctggtcttttttaagtaagtaagtaagtatcttagtagatttttcctttgaggaaaatcggtaataaaataacatggattgaatgtttactgtgcgtcaagcacagttaatatatgatgatgtaaagtaactaactttatgtgatttaattcattcagtaaattgtaaatgta

SEQ ID NO: 8371 - DNA, 407 bp, Homo sapiens
agaaaaagaaaagaaattggtgagaaaagatgcaaacagctggtgaagagatgatagtggtgcgtttgagcagtgctgggtctgccctgggtgtgtgtcagtggtgtatttccctgcgtgtcttgcttcttgctgaggtcacatgcctgtagatggataatgggaacttgattgcaaggcgtcccttgtctgatcagaattaaatgatcctacagacaggaaaacgcatgccagatgggtcctaagggtaagagaggagctggtgccacctcccagaggcctgtgggatctgcctttgccatcacactccactcctgtcccctctgttcttcctgtggcctgcccaagggggtcatttcttctcagcccactgggtgctggttactgagcaccttgttattagaggg

SEQ ID NO: 8372 - DNA, 4034 bp, Homo sapiens
tctgctcggtgccattttatttaatgcaaacactagacagtttacaagtcacacctggacacaagcacgtgaacagatgtacagggaattctggaattttgagatcagtccccatttcttcctcagggccctggcactgaaccccagcccctgtcccagagcctcccctctgggtcccaccccagaagccacgcacacctccttccgcccagctttatctttccttgagctgtgacttcacccagcatgtgctcagagttgttacaaattttctctgccaaattaagctgacagagattggccactttcaaccagtcctttcagtccactgtgtctcccctctcgcttgggacaggcccatgctggccagtgcaaccttcagatagacacatggtgaccagagcccgccaggcttctgcaggtggcagtgtcgagcaagtgtaagatgtctgtgggaaggagaagctcctgaaatgaacgttctgcaaacagaaggctgaggggtcttccaggcatgtccagtcactaggagctgccaccggtgggcttgagtgccaggctctaggctttgtgcagaaagcacccggggcggggggcggtaagggagagcaaaatgggtctctctcaactgcagtcagtgctcctgggaacacggtctcacagacagcacatattctacgtcacagctctagggtttcaaggacttagccatccgacaggcctcaccataaaggtaaagtggacaacccctgaggtcacgctgtccaggtggcgacaggccacgcatgccaaaatcctccatagccacctccggcccagcaccagccagagggtggggccatcggttctcgacatacttggtatcagggagggacaagcctgacaaagttcacaatctggccaatgagtgtgggaggccctggaaacaggccaatcctgcaagccaccccacccttactaacttcctgaagcatgggaagcttctcgagaccaggccaaggtttctttccttcatggcaccacgcagaggcatttctgcagtgctgcaggtcccccttcagccacacagtccaggtctgtcagggattaaagggccgagcaggaaaaggggtggtaaggagctcaagggcacgcactgggaatggcctcacaaggcagccttgagacgcacagggctacaactgaccaccctccaccacaggcatgtttgcaaaacgaacacgaggcatgcgttagacagatgcatgtgggggctgcagattccagtggtttccttaagaaactggagttggctaatcccactcagcagacaatcccgctcagtggacagcctatgaaacgcatggggccatcatgcagaccaaagaggcccgtgagttttgtaagatcctgcctgtctggtgactcatatctgctttcagaagtgctttctgacacagcaaactgactatcagtagacaggggccctagaccctagcatgtggttctgtcccgtgagcctctgacaacagagctcaccgggacagaaccatatgtgggccaaaggaacattccaggaaaccagctctgctccagcccaaaccaggcagctccacgccaggtgaggggcgagtcatggggttcctgtgtttgccacggtgagcatggctccccacgcactctccctcagagcagacaagtaggctgaccacagagctacaaagtcacctgcgtttcactaaaccaagcgaatgtctctttcccctctcctcccccgccgcccccaattacatttttaagcaaacaagcaggattctggctttgatgctcgttcttgacatcggtcactcttgctaccaaaacagggacacagggtggagggtgagcacctctccccaacacaggataaaactcatctccggtgcagaaatgattgctaaagacctttctcatgtcaaccggaaggccacacccagccccctatggaatcagatgggaaacaggcctacgaattgcttcatacttatccggaagattcctaagctctcaaggcaggactatcacgagatgcatgtttgtacttaaatcactgaaagcctccgcttggaccggctctccggaagcccagcaacataaaacctgggatggggaagactgaagtgaaaccatcatcctgggtgctgcgtgtgtgtggtgttacttggtgctgaccggttcgctccttgcaggggctccaagtgggtgcaggctgagccccccacctgcagctccttgaggccactgtcaggggctgtctattggcagaaacctgccacaatgagccactccagtgtgcaggggtcacagtcccttgagttcaaactcttgtcccctaagcataaatgtcatcaggcctcagcatcatcttggcccccgcatcctgtgctcagtaaagctggaggcaggctggctttgggagttggtggctcagcagctcccgaggctggtgctggctttctatcagagctggctcttgaatttcggcaccaagtctcagcacgcttggggcagggcagagaaaccaaactcacaaacacccagagctcatccgggaaactcagaccaacaaggagccgatggcacagagcagcacagcagctgtgggtccaaatgaaggggtggggggagccgggtgacaagcggtggcaccattgtgcatgcctgcagctggacagggccctcagatccgggctggttcgggcggcggcggcggctctgcagactgcgtgtgcaacgtggagtatttcactaggggaaaaagaggccgtcagaaggaattctgctctgtcttgcacagaagaagcaaatacagcagcaagcccgtgctgggaacagaactgggtttccctttgtatcccctggggggccgcttagcaaccttccctcctgagcctgggagcagttttgggccggtcaaggggagagaaagagaaagctggacaggctctggaaacagctcagcctccatctcctcacctaaaaaatgagcgtgttcctgccagcgctgctggaagggttattttaaacaaagggctcaacctagcacctgcccacacagatgctggcctcgtggtggctaaccgtggcaaagctcatgacagtggatgcgacagcggaatccatttttccacatctgaacccaggcctattttagttcatttggtgcagcactgccacccgtcttcagcagcattgtagggcacctggctcccagtacacaccacacaggctgagcccctcctggtctcccaggcccagtccccacggctgctgcactgtagttccactggcaacactcgcctgagctgtcctagtctccctgcctgcgccaccaggcctcggctgctccccgaccccagcaagcctttccggacctcctcattggcatcccgtgggcacaggtcatatctgcctcgagcagttgggcactctaggcctgtggcctgaacttatgcgacctcaaattgccaacagctcctgaatccagaaagtgcttgatgaccacagaagggggagggaggggcacaggtgttgacaatagggtctgggttttacccaagttccctcttgcctgtggcaatttgcaaagggaaaagttctaggtctaggtgaaaagcttccccatggctctgttcaggatgtaattgtattcgctgatggggagcagaggtgcctggggctctggctcggacggacgaatcaagggcaggggccgagcagccgcaatgcccagaagtcacaggcatggcagcagatggccctggctgtcaccccagcatctttgggctcctgaaactgggaggcaggctcatcagggcaggcttttgctctggccggacattctagaagcagacgcctctgtgcttccctgcttctctagcacagttctgctcagtgctgggaccaactaggaaagcgtcagcaagggacagtgagtacaaagttctcaccttggggttcctcacataccacggcttccaggttctctcccttcacgtagtctgcgttgagaccct

SEQ ID NO: 8373 - DNA, 7116 bp, Homo sapiens
cccaaagtgctgggatgacaggcgtgagccacctcacctggcccttttctgcgttatttgcccgcctgcctgcctgagctcacttgcaggccgaggaagatgcttacggaagtcctccttgaggtagccccagcctgagatcaggcacttcttgctgggtgggaagatgtgtgtggcagccgggaggcacacgggctggatgtgccggccgaaaggcagagggctggtcagctccagcacagccacgtcaaagtcggccgtgtccgcgttgtacagggggtgcttgacgatctggaccacctgggcccgcacggtgctggcctccgagccgctgaggtaggtcgcacccacgtaggccacccacttcgtcgggtcttggaacctgcaggagcaaaccccagctcagaagccaccgagggtcagagccgtcgggggaggcagacgggacactcgccttgggtgcaaaatgtaaggggtatccccccacattaatatttatgaatagtatttataaaaatcaggccagacacagtggctcatgcctgtaatcccacacttttggaggctgaagcgggaggatcacctgagcccaggagttcaagacgagcctgggcaacatagcgaaacacagtctttaaaaacaacaacaaaaaacaggccaggtgcggtggctcatgcctgtaatcccagcactttgggaggctgaggcgggaggatcacgaaggcaggaattcaagaccagcctggccaagatggtgaaaccccatctctactaaaaatacaaaaattagccgggcatagtgatgggcgcctgtaatcccagccactcaggaggctgaggcagagaattgcttgaacccgggaggtggaggttgcagtgagctgatattgtgccactgcactccagcctgggcgacagagcaagactctgtctcagaaaaaatatatatatattagcggggtgtggcgatgtgcacctgtggtttcagctcctcaggaggctgaggtaggaggattgcctgagcctgggaggttgaggctgtcatgagctatagtgagctatcactgcgccactgcactccagcctgggcaacaggtaacctgtctcaaaaaaaaaaaaaaaaaaaaagaaaagaaaagaaaaaaatcacaggtgcaggagaatgcatgatgcatgaagtatcaacatttttgttttgttttgtttttttgagacagagtctcgctctgtctcccagactggagtgcagtggcgtgatctcagctcactgcaacttccacctcccgggttcaagtgatcctcgtgcctcagcctcccaagtaactgggatgacaggtttgcgccccctatgcccgactaatttttttgtgtgtttttagtagagacaagctttcaccatgttggccaggctggtctcaaactcctgacctcaagtgatccccccacctcagcctcccaaagtgctgggattacactcatgagccacaagctcactatagcctgtccaagtatcaacattttaaacaaagacaggatgagacagagttgggattagggtgaggggagccagccatgagccttgggcacaaaatttaaagagttgccaaaaatctcagccatcaagataaatgatatcgagccgggtgcagtggctcacacatgtaatcccagcactttgggaggcagagacgggcagatcacttgaggccaggagttcaagaccagcctggccaacatggcaaaaccacgtctctactaaaaatacaaaaattagccagccatggtggcgggtgcctgtaatcccagctactcgggaggctgaggcaggagaatcgcttgatcccgggaggtggagcttacagagagccaaaactgcaccactgtactccagcagggcgacagagtgagactctgtctcaaaaaaaaaaaaaggataatatcacgacagaatattttaaaaaatcaaagtgaatgcaaaaaatgtccacaatgagcaaaacatcaacaaaatgtcattggtcaccgagaaatccaagtcaaaaccacagggagatgctacttcacacccactggcatggctactctcaaaagaacagcaagtgggccaggcacggtggctcacgcctgtaatcccagcactttgggaggctgaggtgggcggatcacctgaggacaggagttcgagaccagcctggccaacatggcgaaaacccatctctactaattatacaaaaaaaaaaaaattagccaggcatggtggcgtgcacctgtagtcccagctacttgggaggctgaggcaagagaattgctttatcccaggaggtggaggttgcagtgagctgagatcgcaccactgcactccagccagggcgacagactgagactctgtctcaaaagaaaaaataaaataaaataaagaggccgggcgcagtggctcacgcctgtaatcccagcgctttgggaggccgaggtgggcggatcacgaggtcaggagatcgagaccatcctgactaacatggtgaaaccccgactctactaaaaatacaaaaaaaaattaaattagctgggcgtggtggcgggcgcctgtattcccagctactcgggaggctgaggcaggagaatggcgtgaacccgggaggcggagcttgcagtgagccgagatcacgccactgcactccagcctgggtgacagagcgagactccatctcaaaaaaaaaaaaaagaaagaaagaaagaaaagaggccgggcacgatggctcacacctgtaatcccagcactttgggaggccaaggcaggcagatcacaaggtcaggagattgagaccatcctggctaacacggtgaaaccccgtctctactaaaaatacaacaggcgtggtggcgggcgcctgtagtcccagctactcgggaggctgaggcaggagaatggcgtgaacccaggaggcggagcttgcagtgagccaagatcgcgtcactgcactccagcctggacaacagagcgagattctgtctcaaaaaaaaaaaaaaaaagaatgccctcagattcaacaacagcaaaagcaagaaagaaaggaaaagaaaaaattacttccaggggctctaaggaaaccagaagtgacgtccccagtgcacgagggaaggcaggagaaatacagagggttcgggtttggtgctttgggatgggggcttactcattgaagcagtgagcagcagacaccagccacctggcgttgatgatggcggccccacagaagtgctccttgttctctcgaaggctggcttgccacggaaactcccccggggatgcttccatgccgcccacgatcctgccggccatcctccaggcaggctgcaagccacactctgcaagacagcaggtcaccagccatgaccccacgaaggcaggacctcaccctgaactcccagaacatgcatctctgagtctctcgtctacagtccctaagttcaaagagatgcttgggggcccctccttggcttccctgactcttctggggtctccccatcccttcctcttcaactcctcggctgccccatcctggcacgtaggtcaagcattcaaggtcacgtgcaccagtgagtggcagagaaaggtctctatcttagctgtgggtaaggggcgatgaccccacgtacatgtttgtataggatattgtgtctgtctgcttatttagtctacttttatgtccttcacaaaattttgtaattctataattatatataataattatcatcacaggcatggcacgtttgtaagtttagtctttgattttttttttttttttttgagatggagtctcgctctgttgtccaggctggagtgcagtggcgtgatctcaactcactgcaagctctgcctcccgggttcaagggattctcctacctcagcctcctgagtagctgggattacaggcacccgccaccacacctggctaattttttgtacttttagtagagccggggtttcaccaaattgaccaggctggtctcgaactcctgacatcaagtgatctgcctgcctcggcgtcccaaagtgctgggattacaggcctgagccacggcatcaggcctagtcttgatattttttgtcactactgatcatgaaagatattttttcctttgtatcttctatcttattattactgtataaagcaaaatgacagcttttttttttttgagacagagttttgctctgtagctcaggctggagtacagtggcgtgatcttggctcactgtaacctccacctcccaggttcaagggattctcctgcctcagcctcccaaagtgctgggattacaggcgtgacccactgcacccagcctttattctaaatagctttttagtcaatttcttgattcattttattttactctttcagcttctctccttctgtttggatattgatttattttagacagacaatgatttcaaatgaattaagattttcctcttccttttcaatacttaaactgctgtccttaccttattgcatgggctagtatttttatagaaacattggctactcttccagcattttatttatttttgagacaaggtctcactctattatccaggctggacagtgcagtagtgcaatcatagctcactgcagcctcaatctactgggctcaagcaatccttccacctcagcctcctgagtagctggggccacaggcgcccaccaccacgctggctaatttttttttcttttttttttttttttttgagacagagtctcgctctgttgccaggctggagtgcagtggcgtgatcttggctcactgcaagctccacctcccgggttcacgccattctcctgcctcagcctcccaaatagctgggactacaggcgcccgccaccacgcccggctaattttttgtatttttagtagagagggggtttcaccgtgttagccacgatggtctcgatctcctgacctcgtgatctacctgcctcagcctcccaaagtgctgggattacaggtgtgagccaccgtgcctggccaatttttttttttttttagtagagatggggtctcactatattgtccaggctggtctgaaactcctggcctcaagtgatcctcctgccttggcctcccaaagtgctgggatgacaggtgtgagccaccgcaccctgctaatctcttacggcattttaattgtctctttccgttgctcacatccctgtggccacgccccactgcttataggacagagctccagttcctggtattcaacacttcccaggctgtggccacaacctctgttttcagcctgatatcttctccctcctctccccaggcttcttcccatcacacacctgcacttttcctttactctgctgtttgctcatgtttctccccataccatgggtgcccctttcttttctctgcccagcccccataaatgccaggcctgtgtgcccagtgaaataagcacagtgaccacagaccagagccagcagctgaccctggaaaagggaaggggcccagagaccaggccagacaggcagactgaccgcagtgcgcctcgtcggacccatcggagcagtcctcctggtcgtcacactccgggttcaccttggtcacacactggctgttcccgcaggaaaaggagttccctggacagcggcctgaggacagaaaagaaccgactttctgacctcatgctacatctcctggttggagtaaggcaccatgctatacttagtaccaccagggtacggaaatgtggaaactctctctctccttttctttccttttccttgtttttatttttgtttttgagacagggtctagctctgttacccaaacgggagtgcagtggtgcaatcacagctcaccgcagcctctaactccaggttcaagcaatcctcctgcctcagcctcctgagtagttgggaccacaggtgcacaccaccaacccaggctatttattttatttatttttattttattttatttatttatttttttgagacagagtttcactcttgttgcccagcctggagtgcaatggcacaatcgcggctcaccgcaacctccgcctccctggttgaagtgattctcatgcctcagcctcctgagtagctgggattacaggcacgccccaccacgcctggctaattttgtatttttagtgagatggggtttctccatgttggtcaggctggtctcgaactcctgacctcaggtgatccacccacctcggcctcccaaagtgctgggattacaggcatgagccagtgcgcccggccttatgtattattttttgagacacagtttcactctgtcacccaggctggagtgcagtggcgtgatctcagctcaccgcagcctctgcctcctgggttcaagcgatcctccttcctcagcctcccaagtagctgagagtacaggcaatacgccactatgcccggctaatttttattattttttataataattttaaaaattatttttggcctttttttattattatttttgtagagatagggtctcgctctgttgtccagcctggtctcaaactcctggcctcaagtgatcctcctgcctcagcctcctgaagtgctgggacgacagatgtgagccaccgcgcccagcctcgttccagggattccttcacttccttgaaatgagtcttaggaaacctctgtcagtaactgcaatcagagaaaaggccagagagaaaaacatacctgatttgaagtctctttctgccaagggtcccttatgtctccctgcaacaaaacagagaagatagaagctcactgaataagcggtaaaaccctttgaacacatcctattggccgggcgcggtggctcacacctgtaatcccagcactttgggaggctgaggcgggtggatcatttgcggtcaggagttacagaccagcctggccaacatggtgaaaccctgtctctactaaaaatacaaaaattagacgggtgtggtgccgggcgcctgtaatcccagctactcgggaggctgaggcaggacaatcgcttgaacccgggaggcagaggttgcagtgagccgagatcacaccattgtactccagcctgggcgacagagcgagactccatctcaaaa

SEQ ID NO: 8374 - DNA, 293 bp, Homo sapiens
tttttttttttgagacggagtctccctctgtcgcccaggctggagagcagtggcgcgatctcggctcacttcaagctccgcctcccgggttcacgctattctcctgcctcagcgtcccaagcagctgggactacaggcgcccgccaccacgcccggctgattttttgtatttttagtagagacggggtttcaccgtgttagccaggatggtctcgatctcctgaccttgtgatctgcccacctcggcctcctaaagtgctgggattacaggcgtaagccaccgcgcccggcca

SEQ ID NO: 8375 - DNA, 6554 bp, Homo sapiens
gccggagctggagccggcgccagcggctggagcagcaagggagtcagggccagggccagagagccggagagaggagcccccgaccgagagcccaggtgagcccacccttcctccccagcccagccccagcccagcccagcttggcccagtctccataacaacatctcctggagcccgcagagagatcccagccctgcccaatcccttcaccaccacaagcccctgcctatctcggggacccccaagaactgggagacttgtggctggaaggcagagacccccctcccccagcccagaccctccctcacatatccagaaaggcacacactgtggggaggtagatacccagccagagaaaggtcccacttctgagggaggtacaggaactgtcacaccctcctggaaacggacacacgacatggggggacagacacggagggtggggcactcagacacaccaatgcacactcactcggggaagcatgacatgggatcagacagcctcaccctgagatctgtacagacacagatagatggactgaccggccatgaactctggccggcatacccctgcctgcttcagcccgaggcttggtaccactgctgggggaaggtggcatgcgtgcatcccacgggcagcatggagggagccacgactccccaaaaatcctgtcgctaagagacggtgccagtgctgccaagaagtgtgaaaacaggggaggtggggagggatgtgaggcttgtcacagttagagctcctgccaggagcctgaaggagctttcagcagagccctggtcctgcctcccagcccaccaccactccttttccatcagctagccagaaggggaatgggggtagggagtggatagggatagcccagcaggggactttccaacctgtctcctgcccactgcagactccacttctgagacccatcctcttcagaactccagaggcctctccaccccctgccccacccccttgccctagtttagctccctcgtgccaagactgagtgcagcgctggcacaacaccagtcgggaaatagcagaaggtgctgaggcggcagaaagtgtagatcaatcgatggcctaggagccaagactgccaggaacatccccaccccaatccttcagccctctccagccccatccacgcatacctaggccagcagcacagggcttctgagcaggagtgggaggctcaggtcctctgccctcccctgctcagaactctggtgaagctgaggaagcaggaggtccgtgaggccccagggtctagggaaggaggttaaggggtggggcccagggaccctagaggatagacccctctgctggcaggtgttccctttccagagtccaggccacctgctctgtccccacagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtgagagcagctcaggtttctccttaactaacctgggttaagcttgggaaagagggaggctgggtgggagcagtgaaagccttgcagggaaatgtgtggactctgcggcgccttctcgaggccgcttgggtaccctggagatggtgtcccagagggtcctgagattgacccagaggcagtggggttgctcccaaaggcctcatgatagcccggaggactgagagtccagtgggcaggcagcaccccaagctcagggatcagcttaggaagagaagagctggttgctggggacgtgggggcccaagaagagctggcatgactagggcagtccaggacagggaaaagtatcctcggttcccagacagccctcgcctcccttcaaccactaccacaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccaggtctgcattcccggcctccccggctaccctaccctacctccatcagctttgcctctggaagccaaaaagagagaaaacatgagctctagagctagttcaacccagccttggctcccatctctgccattcactagctgtgcagcctcaggaaagatacttaacctctctgagtcttagttttcctatctaaaaaatggaggagtggtcagagtgcttccctcttcagactattgtaaaaattgagcccaaccctagcccaactcaaagtgccaacccttgcagacactcagagcatttattattccatcccttgtacgtggccaaggcagatggggatgtcacagctgggtctccctccacctccatccccagattgtgtcacaaaccaaggtcactaagccattattgctgaagaatgggaagactgcgggcaagtccaccatcacggtaggcaagatcacctgtactcacccttggtccaggtattcaatgcccctgcatggacacctatggtgacatcatgcccaggaccacccccacctaagggaaaggggatggggtggcccttgtggtaaggttaggggagtcctgccacttgtatcccccttgcagatcgtggccgaggaggtatcaggcacaaacgactatgtgcaactcaccttcagagcctacaagctggacaacaaggttggaaccccagagtccaggcccccaactcccctgtcactcctaggcctcccactcaagacagatcccaggagcccaggcctgctctcttcccagtgggagcccatcccccaccctccttgcagctctcaccaacctcaagggccctttctcctgtatcttcaggatctgttcagcaagtctgaccctttcatggaaatctataagaccaacgaggaccaaagtgatcagctggtctggagaactgaggttggtgcctggggctatggggatgaagggagggagagtaaagtaagaagacacagacaggagctgaccagccacctggtgcctctccaaggtggtgaagaacaacctgaaccccagctgggagccgttccgcctgtccctgcattccctatgcagctgtgatgttcaccgacctctcaaggtgaagtcccagccaagccagcacagcctacttagagcaaccaatctgctatctaagacctttcccctgcatgtggcaagcctccctcctctcccccaagtgataatcacatcccactgtgggataaataataggtcacagctcaatgttaaacttcccacatgtgtgcattttatcagtggccaaagtccctagcagactgagccaaagaacaaagttcagcaggtggcctctccgggcaggctgaggatgtctgtttgggcatggagactctaaggcccaagtccccctactccaagtccccgagtccccctactcaccgtgaataccgcagagcatctccaacctgaccccacccctccccctgccttctcagttcctggtgtatgactatgactccagtgggaagcatgacttcatcggcgagttcaccagcactttccaggagatgcaggaagggacggcaaaccctgggcaggaggtgccacaaataccccacccccagaatcccacccagatccctgggagaatcctgagggtgatgctgaagagaccaccataggtgataggaagtggagagggtggaaagcacctgggctcagctgaaggacggaaccatgggggtcttgctctgggaggctctgctggaagggagaaagaggggtcacctgatggacttgtgaccctgagcttgtggggtggggtctagatgcagtgggactgtatcaaccccaagtatcgggacaagaagaagaattacaagagctcagggacggtagtgctggcccagtgcacggtaaatttcacttcctgcttcaagccttgccccagcccctgcccctaccacactctcaggttcaacccttcccttgtttcaaagaccagtttctctgcttctgggaactggaaaccacccccaactgcaacccaaaaaactctggctcccccatgttccccacagaagccctacccaagctccctcctcaaaggaccaccccatcccctcgccttacccctctccctacctccaggtggagaaggtgcacaccttcctggattacatcatgggtggctgccagatcagcttcacggtaaagactcagagggagggcacacaggcaagagggaggggctgagtccatagtgaaaggaaggagcccagaatctccactgccccaacttgggctgctcatgagccttcgcattgtcagcttatgcacccccacatcattatgtggctacctgtagcctccccaccactcatcttagtcctccctacagatcccagctctggcctaggcaatctggtggctctcatggttgcagcatgaccttcttcccacccccacccaggtggccattgacttcaccgcctccaatggggacccgaggagcagccagtccctgcactgcctcagtccccgacagcccaaccactacctgcaggccctgcgtgcagtgggaggcatctgccaggactatgacaggtaggagagagtggggcgggagggaacaggcagggaggccttgcccaacggattccacagctttttcttctccccagtgataagcggttcccagcttttggctttggggctcgaatcccccccaacttcgaggtaggctagatgcgagggaaagaaggagatggggggcgtgtcagtcaggcagaaaaggcaggccctcactgctcccgccttgccctcacaggtgtcccatgactttgctatcaactttgacccggaaaatcctgaatgtgaaggtaaaaggggagattttcacctgccccgcctccccgcagacacactccacacaggagcacagactccactccccagggcccagcttcctgtcccttccacccatcccaggcctgtctttatcaggtgaggcttccagggccgaggcccagcatctgcacccaactctccctgccaagggaccatccaactctcccactgcttaatgaaggaactcgaggggagggcagtcctcagacctggaagcatttccttgctttaaggagtgtcaggagggggccctgctcatttctgccagcttcacaacttctcttcactcacagagatctcaggggtcatcgcctcctaccgtcgttgcctgccccagatccagctctacggccccaccaatgtggcccccatcatcaaccgtgtggctgagccggcccagcgggagcagagcaccggccaagccacggtaggaagacatggcgggcaaacaggagctgtcccatgtgtctttaagtggtgccagggccagggtctgcaccttggtggaaacggtgtcaacgcccttgcacacaaagccaacccttccaccctctctgcttgccctcagaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgtgagtcccccgggccccttccggctgaaggactcctcagcttctcatccccccaaatctgaccttcgtcttccaccatttgatgtcctgctaaggacgcgggagcccagctggccaccctgaagccccacttctccctcagatgaccctgcctcccctactcttcctctcacccctaaccacatcactgtccccaccctaggctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgagtcctggggcttccaaaggagtggacacagggggtgcaaagtggggcttggtagagcccaactaggctgggtgtagtgtagaagagagtgcttatgactctcccaccccctcccaggtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagcacctcagcctctaa

SEQ ID NO: 8376 - DNA, 472 bp, Homo sapiens
gttgcccaggctggtctcaaacttcctccttggcctcccaaagtgttgggattacaggcaggaaccactgcgccccacctaaagcactactcttaatcaccacagtgtgcaactttgtttttttaagtatactcaggtaacccaggagtatcattttgagacccaggtatggtactgtatatgtggcctagttgtgtgctcaggtgtctatggatggttctgtctgtctttgtgtgccatgcaggtgagaaaagtgaacaagaaaagtagtgggtctgaattacagctccagggcaggcaaggatagacacaggtgaaatttagagtgagagaaaaagagctgggctcccggaaggaccctccctgccccatcctctcccttcaacaatgagtgtggaaggggatgaagaaagagaagctaaaggttctgtgagcccctcagagagagaatccagagccagagaggatggcc

SEQ ID NO: 8377 - DNA, 6292 bp, Homo sapiens
gagctgcccactcatggttacaaactaaggcatcaaacacaagggaggccccgcccccccaggaccacacctccaggacctggtcgacccagtgtgagtccctaaggcttcacaagaggatccccttcactcagtgacaccagagccaggagttttacctttaggacccaaatgccagagacagtagccttgagggattgggcaggagtccaggcatgccaatgaacagatgagggattgcccagtttttatgagagctagaccttgtcacagataagaaagctctgtctgccgggcagtgtcattcttattttggtgaaggatagagccaccaagaacaccaagagccaccaagcttaggaaacactaggtgagctgggcatggtggctcaggcctgtaatcccagcactttgggaggctgaggcgggcagatcacgaggtcaagagatcgagatcatcctggccaagatggtgaaaccccatctccactaaaaatacaaaaattagccgggcgtggtggcgcctgcctgtaatcccagctactcgggaggctgaggcaggagaactgcgtgaacccaggaggcggaggttgcagtgagccaaaatcatgccactgcactccagcctgggtgacagagcaagactccgtctcaaaaaaaaaaaaaaaaaagaaaaagaaacactgggtgaactgaagtctacatttccataaatgtccaagcccaaaggggaatgctctgagtggatgggaggtggggcttcctgacctagatgagatgtcccacgggactttcctcccagcagatgccagcacctgggactcgtcaggagaatgggatggccacccgcctggatgaagggctggaggacttcttcagccgaagggtcctggaggaaagttctaggtgtgatgcctaaacacactcccattttcagcaggccccaaggccctagaagggctgctgtgtcctcccagctcccatgggagtctccataacagcagtgcccaaagccagtctctgtgagaaatttccccacattctcatccttccccacccagccctcagggcccatgacctctgcgtcttcccaggacagctgggaagaatggggccagagtgaaccaccacagtggggttggagagcaggtgtggatgagagggaggtggggggcagccctgggacaggatacccattagtggtgagaggcccggggggtagtgttccctgtcactgtcctgcagactgcccagggtctgtccaggaggagccaggtcacttggagaagctgagaggagttgcaggggaggtgcctgggaagaaacatcagtctgcgggaaaggctgctggaggattacaacgggacaggaaaggcaagggcatcatctccctgagaactaagtggaaagggctgcagtgcagcaggggagaccagatgagaggaaagcaggtttatcagacccaggattgagcttgcatctggcatttgttgctaacttaccccgattctccccagctacccccggactctgaggaccgtgcggccaggactctcggaggcaccgctgcctccactccagaagaagaggcgccggggcctgtttcactttcgccggccccggagcttcaagggggacagggggccggggtcccctaccactggactcctcctccctccacccccaccccctcccccgactcaggagagcccccctagcccagaccccccaagcctcggcaataactcctctccctgctggagcccagaggaggagagcagcctcctccctggatttggtgggggccggggaccttccttccgccggaagatggtaagtgaggcagggggtgctgtgtcttccccttttcctgccccacacttaacccagtctcctaccccaccccaagcttaatgggagaatgctaggacccagggttcttgggaacattggtcatttcaattctcctctccttgagagtggactaagacccagtggccaagagcatgctgggagtgctatatgcgaatgcaggcgttggaaggactcttcagagggtctctgcagggcttccccgtggctagggactcagtgaggcaggggtcctcctgacaactccctcacagcctggggagcccccttcgactgggaactgctaataaataagagaccttgttctagggcactgaggggtcagagccaggggaggggggcccagcccctgggacagcacagcagccaagggttcacggtgttgcccttcccgggttggaaagagccaagggttggagcttcgatgggaaacgagaggtgagtggagcctgggacaacaaactgtgggtcctgagggtatctgtccaccaccctctccttcccactccctcatccctggtggttcagtagagaaagcagatgctttggcattagaagatgttagctgctcttcagcccccaccacacacttgccgtggagccctggactggtcacttcacctcctgaaacctctccttctttactgtaaaatgaggggttataaaaatacttacctctagagctctgtttcccaaacaatggtgacttgattataacctttgcgactgatttttacctgaattattacttacatagtatttttatttaaattaactcacctttttttaacttaggctagacctagacattatctttaaaatcgcaggctttttgaatgagtcgtgtttttttctactacatgtaaaatacatatgtaactataaagatggaagtatactcatttgtgtaagccatttcttgtgcccctggggaggtatgggtgccactctttgggaaacagttttaagtgtctagggactaatgacatgagaatgacatggagatgctagagcagaagccctttgtcagctgcagtcctgccacagaggagactttcttacaacctgacccactgttctttcagggcccaggcccagaccaggagggcagcacccaggcctggcagaaacggcgctcttcagacgacgcaggtaagaacagtcacattcaaagcccttttggacccctctctcaggggtcaaatttaccttttccctttctcctctctttctcatcccctctctctactccagggcctggatcctggaagcccccaccaccgccccaaagcaccaaaccaagcttcagcgccatgcgcagagcagaggccacatggcacataggtatggaaagcctcttttcaggcagcagtactgaaagcccagggtgtgtccaaagaaacagaagcccatggcccctgtgctggggaatttatggccaaggtggggcagtgagaagtcaacacagtgaaaatgtttaaggatatttacaaagctatatccaaaagagacaaacaacccaatccaaagaaagcttctacagaacaaaagcggcttctccagtgttggcaaacaggagcgatgctttgtggatggctctggcgaattctccagggcaggtgcagcctctggtcaccattggcacagtggcagcctctgtagacaaggctcctctctgcaccttgctgggaagagggtgggcaagtcaaactgccagcaagtaccagctgtgccaggcccacctcagattccagcctcctccagaagtcgtttatcaactcaccctcagctcacgcagaaaggtgccccaaacatgggcaagagctcgcctcggaggtcagaaacctgcagtattagtccttctcagccacccgcgaccttaaacaagtcatttactttctggccccatgaccggaggagtaaaagggaggggattatcccaggcatgacacttcctttctgctggcttcagagcaccttccgcttagggagccactaaagaaaagctggtcagctcagcattcgctcagtccagcagttgccaaaggcctggaccatgaccctccagcaatattgacatagacaaaatctctctgtagatggagacaccccctcagcctctttcactcccaccaccaggctagggcgtaagggctggaaagagctaagagctgagcgggctggtctggcttgagccacatgctccccactgtcctatcccacccattctgcatctgcccctctctcccctgtagtgcagaatcaggctagcctgagacttggagtgcctgtgtccttgcctcctcctccaaggccaacccagcactgggggcatctttgctgattttttccatcccatacacaggctaattaaagcgccccaaagtagggctccatctttcatttaggaaaccgcaatagtcagttgccccactgcacacacacctcacagatccacatgcagacaacactttccagtgtcagagccacaggctcatgttgcttaaaggccactggggcggaggatgagtgtgccagggcacccctccatctaaatcagactttcagacagagttctgggaatgccaggctgcagccttggcagagcccccagggcactgcagcctggatgggcagcatgcctgtggacccagcaggccctgggccctgccccagcaggaaaggggttgggcactgctctgcaagagggacagctaggccagagtcccctccagaggtgatggcctcaggatgatcctgggaaacaagggctaaggagcgtggatgtagaaaggcatatgaaagaccgggtgcggtggctcatgcctgtaatcccaacactttgggagaccgaggtaggtggatcactaggtcaagagatcgagacaatcctggccaacacggtgaaaccctgtctctactaaaaatacaaaaattagctgggcgtggtggcacgcacctgtagtcccagttgttcgggaggctgagacaggagaatcgctcaaacccgagaggtggaggttgcagtgagccaagattgcaccactgtactccagcctgggtgacagagcaaaactccatctccaaaaaaaaaaaaagaaagaaagaaagaaaagaaaaaaaaaaggcacatgaaaggcagagacataggagcaagtgggcttggagggagaaagtcctggcctccagggcttcagtggagagaggagacagggacaggagctatgcaagaatgccttttcctgcagcttctcctctctctcatccccagctgaagagagtgcccccaaccacagctgccagagtcccagcccagcctcccaagatggggaagaggagaaggaggggaccctcttcccagagaggacacttccagctaggaatgccaaggtgagagctggcaagatgggtgggggaggcactttgatgaggcaaagggactaactgacccagcatcttccttcctctgccagctacaggaccccgctctagctccatggcctcccaagccagtggctgtgcccaggggccgccagcctccccaggagccaggggtcagggaggaggctgaggctggagatgcagctccaggagtcaacaaaccccggctgaggctgagctcacagcaagaccaagaggagcccgaagtccaaggtctgccaccctggctgagtggggggctcagggcacctctaggactttgctgtccacatcaggtcctcttccagagcatggaatgagtgacaaccaggagtcacagcctggatgagcatcccagcatgagccccactcctgtgttaggcctgccttgattgttatttcagggccccctgatccaggccggcggactgcccccctgaagcccaagaggacacggcgggcacagtcctgtgacaagctggaacctgatagaagacggcctcctgaccccacaggtgctggtggtgagagggcaggtccccccttcccacctatctgtccaacatgacaccccccgaagccccaacaccaggtggctggctgtccctgcccaggaaacagggctccctggatttgtccccagcaggaaccagtgagccaggaacagactgacaactgccacaacaccctcctcagccctcgacatgtgcctcgcaaggactcagacccctatccacccccagtccccagggccccctgccagcccctgtcctacaggggcaagacggcaggaccaggcatgggggagctggaggcagggactagaacagagggagccacctggagagacggaggctgtcagtgcctgcctcgatacctctctctgcagagagcttctgggtgggggcttatctcctcccccaggagggtggatctctgtccctctatccccagggactctctcccctcttgtatagaataaaaaaacaaaatcatcgcc

SEQ ID NO: 8378 - DNA, 8184 bp, Homo sapiens
ctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgttttatttgatttttctttattttaaattattacatttaagttctttttattttatgctctaggttttgaagtttttctaatttcttaatttttttgttgttttttgttttgttttgtttttgtttttatgtactgtattttcagtgttttaaccaaacagttgtggctactcatggtgaggaatgaccgctaagagtttgggttctttcagtgcatttggaggtcactgctacacgttgatgtttaggaggttgagaggtttgcctttaggtaagttgtggccagggggagtgtcccatgggtaagtggtggccctgtagggtgacggagagctaggggaggcgcaatcagactgcagaattccccgcagccaccatgagggtcaggagcaggccggggacccagcgtggaggaaggtggcccagaagcgtttgtctgatgtgcacagctacaccctgcctggccacatggggttccctgttttctctctgccgggtggtggcagagtcggtgagacaccaggtgcctgtgacacattgggtagacaggttctttgagaacgtcagcacagacttcttgcatgagcggtactcgcttcctccagcgtggggagtgacatgaagagcaagggttttcctttcaaactgggcatagctgcagagccacaggccgtctcagacatttctacaaagccactccgggaggcgggctgcgcccgtgtgagggctctccctcggcactgctcatcttttggggctggacatgcatggcctgggccgctgggacgcggtgggtgtggagcagcatccctggcttccacccacgaaagccaggagcacccccttcatttgtgaccacaaaaatgtctctggactttgcaagcatcccctcggggcagtcagcccaactgagaatagctactatagaggaaggtgtgtcattttgagattccttctagagaaacttaggagcctggtagatgaagcagaaatgtgtcctctgagtgagtggccgtgtccggtactgagaggccccgtgccctgagtctggcggtgaccagagaggctgggcagaggcagaggtcagcactggccatgacttctggaagtcccgtctgccctggtcacttaaaggccagtataagtcagctgtggagagggctggataccccctcgacagctcctccctgggtgagatccttagcattagagtcccccacggtgcgccctctgagagaccacgggaacccacccagcggctgcctgggacaggcacaggagccacctgggtgcctctgaggccttgcactttcccacacctcaaggagggccgggggccacgggcaagctctgccatagcgggtgatcaggtcagctaagacgagaacgtttggggctctttttctccagctggttcagtatctttgttaggaaagaccattggaaagaatgtttgtttcgcattccgcattagtcacatagaatgcgctcctccctagcgagcttcctgaggtagacggctggttgcggtttctcgtaatccgggctgcccccaccctccagaatgtcttggtggcgtccctttctgtgagcagggattgtggtttctttgcgcttgctcatgttcaggggtgagctctggtccagtcaagccacagggtcagcaccttctggtcactccctggccctgacctgagcccggggaggaacgtggggcaggcgcgggtgggcccagcctcgagctcttcagcacagtgatggtgacggggcagcggtggcggcacagccagcccttcttgggtccccagtcagagccctctgccctacctgggctggacttgtttctgaacagccacaagctacagggggctgccgctgtgtccctggcgaggcactggcccattacaagcaatcgtctggggagggcaccagtggaaagccccgttccaagccatttcaggagggtggccctgcttccgaggagccggagtcagtggccggataagcagagccactcgggagtggtgaggcccggaagggttagcccggtgggcggcagaggagctctggcccgcagggtgtcgggcgaggcaaagtgcaaagcattggtgcgcggggcctcaggcagccacggcggagccgcaggccagggacctgcagtgactcgctctccctcctccctgtgtttggccttagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggtgggtgcccacctccgggactctgggctccctcgggcaggaggcagggcttggtttgggtagatgtgaaactaatgcaccaggcgggcagtgcaggcagcagagacgtgttcctcacagcccggaggctggggtccaagatcaaggcgctggcagggtaggttcctcctgcggccactccttggcttgtagacaccaccttctccctgtgtcctcaacaggcatcccctgggtgtgtctgtgtcctcatctccagctcctacaaggacatagccccattggattagagccaccacgtgacctcattttaccataatcacctcttgaaaggcccagcctccaaatacagtcatgctagggggtatctattaacatatggatttggggagacacaactaaggcagtagcctgcgtcaccccacggcacacagccccactaaccagtaacctgcatcgccccacggcacacagccccactaaccagtaacctgcatcgccccacggcacacagccccactaaccagtaacctgcatcgccccacggcacacagtcccactaaccagtagcctacgtcaccccatggcacacagccccactaaccagtaacctgcgttgccccacggcacacaggccagtgagggaaagagaagaggggaatgagggccgagaggaggtccagccactggcttgcttggacgtgggatctctggggactgggcttactgctgacactcccatgcagagaggctgctgcaacccaccccgctccaggccccgcctcagacgtctactgtgctggggttcgacctctgcccagtcagcctgggaagagctgttttctgatcatccccacctagcaggtggtccagctccagcccaccagactcaggttccgagggcagccgtgagcagggcagaggctgccagaccctctcctgaccccaggtgcccctgtgctctcccctaggcatgggcagcagtgacgagtggtctgatgttcaagacattattgactccacgccagagctggacatgtgtccagagacccgcctggaccgcacaggaagcaggtactggctcagcccaggccctggggtcctgggggctcagtatttatccaagtcggtgtctttggtgaagtcttcctctgccaccactgggagaaccatcaaggctgtggcctaccgcctccatccacgaccggcctgcagggcagtgtgggcattgaatggccacggtgggaggtgttggaagagtctgcagacgcagccactccgggctgcccactgactctgctctctctcccgacctgtggatcccaacagcccaacccagggcatcgtgaacaaagctttcggcatcaacaccgactccctgtaccatgagctgtcgacggcagggtctgaggtcatcggggatgtggacgaaggggccgacctcctaggtaagcgcaagccttcccccgcaccgctgtgcctgcacaatgctggggctttctgctgttggttttgtttgtaatgaaaggaaagtcctctgtcagctgtgagctaggaacctttttttttccagctttgttgagttgcgtttcacatggaattgtccctccatctccacaggggattggtttctggactgccccaaggatgccaaaatctgaggcttctcaagtccctgctctgaagtggtgtagtgtttgcaccctcccgtgtactctaaatcacctctaggttatgttgtagatgctgtgtaagtagttgctgttatgctgtgtcgtttagggaataatgacaggaaaaaagtgtacacgtcagtacagacacggccaccacaggcctgtacattttctgtgaggctggttgaatccacacatgcagaactcgtgggtattgagggtcgactgtatcataaaattcacccgcttcgagtgcacggtgcggtgggttacagcgtactcacaggtggggcagccacccccatgatctcagtttagaatgttccgccatccctaaaagaaatccatgcctgttagcctcgccccatcttctgcacacaccctcagggctgccaactctccaggaggttgggagggtgcccgcttctctgctctgtgcccattagcctcgccgcacaccctaggaccattgactttggaggaggttgggagggtgcccacttgcccactcctccgcagacagccctggcttcacctcagcgccacaggtctacaccggacccctgtgcctaggtctgtggcggctgcaaacatcaggacctgcttcctgtcagcacgtggagtctcctgtgctcatggcatctgctggcagctgagcactggccatgtggctctgagccccaggctttcaggcatgacaggcgggcagtaggacagcgcagtctgtccccttgcacgcgtcagggtccgagcctttcgccatggccttgcttcccccagcccgcagggtgagaagctcctggatcccaggctgcctcctggtgtactcctgagctgattgtcttatctggggcagggggacctccagggagcagagtaatgtggggtgctgagcaccagcagggcctcaccctgacagggaggcctgtctcatcctggcttgagtcagaaagtgccccagtagaggccatgtatgagtaacataatattcaccatgttaaccgagttgaagtgttcagttcagtagtgttggacacactgtacttggtggtgaaagatggaatgctccccgagatcaggacggcggtgagggcgcactttggtgctgtgaattttctgtggaacttttctcatgtgttgcaaaaatatatataaaaaatccaaaggagattaatcttcagaaaaatcctgctaaataggggtaatctcttttaatattttgctatccttccactctacataattcagataatgtttatttatttatttatttatttatttcttagacaaagtcccgctctgtcgccaggctggaatgcagtggcgccatcttggctcactgcaacctccgcctcccaggttcaagcaattctcctgtctccgcctcccaagtagctggaattagaggcacgcgccaccacgcccggctaatttttgtatttttagtgcagacggggtttcacaatatttgccaggctggtcttgaactcctgacctccggtgatccacccgcctcaggctcccaaagtactgggattacaagtgtgagccaccatgcccggccgataatgtatattttttagctattttttttattttttgaaaaaattatatatgcttataataatatttaaataatatcagcaaatgccaagaagagagtaaaaaccagagggaacctccccaccatgctataatgattttttttttttttgagacggagtcccactttgtgggccaggctggagtgcagtggtgcgatctcggctcactgcaacctctgccttcccgggttgaagcaattctcctgcctcagcctcgtgagtagctgtgattacaggcatgcaccaccatgcccaggtaatttttgtatttttagtagagatggggtttcacagtgttggtcaggctggttttgatctcctgaccttgtgatccacccgcctcggcctcccagagtgctgggattacaggcgtgagccaccactcctggccgattgttttaatgtcttggtgacacctaccagacaccatggcccatggcccacagaggtatgacacatgtgtacgcagaacacacagtgtcaggtcgcagctgcccttctcattgtgggcggtgtcatttccgtgggtggcagcactgacgggcacggccaccgtcggtccttactgcagcatcaagccgccctcctgccagtgtccccatttatagatgaagaaactgaggccgggcacagtggctcatgcccgtaatcccagcactttgggaggccgaggcgggtggattgcttgaagtcaggagtttgagaccagcctggccaacatggtgaaacccatctctactaaaaatacaaaaagaaattagctgggcctggtggcgggcacctgtaatcccagctactcgggagactgaggcagaagaattgtttgaacccaggaagcggagattgcagtgagctgagatcgcaccattgcactccagcctgggtgacagggagagggactctgtctcaaaaaaaaaactgaggtcagggagggtgagatgacggtgagagctcggacttgaacgcaggtcccacccagaacagcagccctaactctgagcaaggtctgtgctgttcagtagctctattgagatgtgatttccacactgtgtaattcattcacttacggtgtacagtccagtgggtcttagcatgctcggtgttgacagtcacatcgtcttcacccccaaaaggaaaccccgtgcccatgagcagtcgctttgtctgcccctcgtccccagccccaggcaaccacaaatccatgctctgtctctgtagatttgcctgttccagacgtttcacagcaatgggccttttctgcctggcttctttaacgttgcatcacatcttcaaggtccatcccagctgcagcgtgtcagtgcctcctggcttttcactgctgagtagtgcccgttgcatggacagaccacgttgtgctcacctgtttgccctaatgggcccctgcttggtgctttccacctttgggaggctgtgaatcgtgctccagccacactctgacccccgcccggctccaagagatgaccaggattggcagcttcctcaccaaccagggactctgtggcctgcgcatccgcccatcctgttggctgtggtaccctgtgctcaacccgtggcctttgtgctgcctcgccctgctgcacagccaccccctgcagcacccacctagagggcactggccaggagtctgctttcccacgagaccgtgaggcagtccttttctcataccacgatggaggccgagtcactgtgcgctccacgatgaggctgcaagtcactatgcgttccacgccctccgtgcactctgggctctgccaccctactctgcagggtgctggtcatctgggcatcgccgagctcaggctggcacgacaggctgctcttgggagtaacagaccttttggtgcctttccagagccttaaacgtaatgcgtataagaaaggcagggaggccaggcacagtcactcacacctgtaatcccagagctttgggaggccagggcaggaggatcacctgcgcctaggagttcaagaccagcctggtcaacatagcgagaccccatctctacaaaacattttataaaaaaattaggcaggcatggtggtgtgcacctgtaagtcccagctacttgggaagctgaagtgggaagatcacttcagcctgggagtttgaggctgcagtgagctgtgagcacaccactgcactccagcctgggtgacagagtgaggccctgtctcttaaaaaaaaaaaaaaaaa

SEQ ID NO: 8379 - DNA, 466 bp, Homo sapiens
tgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtggatttcccacaggggc

SEQ ID NO: 8380 - DNA, 1623 bp, Homo sapiens
agaaaaagtcaggcagtcctgatgagtggggacctcctgctgctgcaatctgttgatggaaggtttttgaaacagaggagcctgctctctggcaaccaggatggacaaatgagctgggacctgcgcccctctgccctaatcaactcgccccatgtccagctcagctgcagaatgggcatgaactcctgaagacagcaggaaaaggagtacgcccttgtgtggctgccaagcaggggagagcctggagcctgcacagatctgggaaagagcatcatttcagaaacacgtcagctttgcacgtgacgggagggtgcttctgccaaaagtcggcaggtggagagcgacatccctccgtccagcgtctacgtgggcggccctgcacctctctcagcatttttactctgagttcctttggtgatggagaaataaaaagagcccaggtcgggcatctgttgtattccatcgaatctcagacaacaccaattttaagacttttttgtttgttcgttcgtttgtttcctatagaggtaggctgttgctgtgttgccagggctggtctcaaactcctagactcaagtgatcctcccactttggcctcccaaatcacactggaattacaggtgtgagccactgcacccagcccacataccattatttatttatttatttatttatttttgagacggagtcttgctctgttgcccaggctggagtgcagtgacacgatatcagctcactgcaagctccgcctcctgggttcacgccattctcctgcctcagcctcccgagtagctgggactacaggtgcctgccaccatgcccggctaattttttgtattttttagtagagacggggtttcaccatgttagccaggatggtctcgatctcctgacctcatgatccgcccacctcggcctcccaaagtgctgggattacaggcgtgagccaccgtgcccagccccacgtaccattattttaggaatcttcaagaaagaaaaaactgctgcaaattaaactataatgtgacagtgattgtttaagacctactgaaatttcagaaatgttaacatgaggaaaaaaatgtacgtcttagaattggtatactaggaccggccgggcacagtggctcacgcctataatcccagcactctgggaggccgaggcgggtgggtcatgaggtcaggagttcaagaccagcctggccaagatagtgaaccccatctctactaaaaatacaaaagaattaactgagtgcagtggcaggtacctgtaatcccagctacttgggagactgaggcaggagaattgcttgaacctgggaggcagaggttgcagtgagccgagatcgcaccaccgcactgcagcctgggcagtaagagcgaaactctgtctcaaaaaaaaaaaaaaattggcctaatagggagtaagggaattaatactcactgagtatgtcgctggtgctgggagctgtaccagctattaccgcactacctggtgggaatttcacagcaaatattcactaaggaacttatttttctgtttcacaaatgactaatactcagagaagttatactatgtgccttgcattgctgagcggaatctggaatccacgcagctgatct

SEQ ID NO: 8381 - DNA, 1232 bp, Homo sapiens
  misc_feature (1180)..(1180): n equals a,t,g, or c
gataatgtgagcaatctccagccacatacagaagtatagaagaatctcacaagtacaatttgagttaaaaacaaaaacccagacctaaagatatacatactctgtgactccaaatttaataattgctcatagaagtcaaatagaggttaccctgtaagaatgggttggtgactagagtgagcacacccagattctggggtcctagtcatgctctgtgtcttgacctaagtatacaggtacatgtaagtttgtgaaaatgtaacaagctgtatgatacgatttttctaatattgctcatctgtgtttgaaacatatacttcagaaaatgttaaggaaaaaatagaaaaggaaaagaaaaatagaaaacctaaataatctagtacttattaaagacttgaacccgtcataaaaagcctttccacaaattaaatactaagccaagcagacttactaaattctaccaaaagctaagaagctatgtcaattttatacaaacttttcaactaatttatgagcattaatttgatacccaaacctggaagggactatataggaaaggaaaatgataaagtcagtcttaattatgactatagattgcaagaacccttaccaaaataggagcaaattgaatcaaacaatttttttaataaggcaaaatgtaacaaccaagttgggtatattcctggtatgcaacactgctgcagcatttaaaaactaatcagttatggagctagagggaagatggcagagtaggaagctctgggaatctgtctccccacccagacgacaactgcactggcagaatctgtctgatgttactatttcggatctctgttcaccatttttatcaggttgggaactctgaagtctattgaaggcttatgacttccaggggaaggtttgaaaggttaatttcagctcttaacatggtagcaactacctgttcgtctaccctcagtcccatagcatgtagccatgtacacattttcaagcagctttgcatagggtttgtgggagccagtgtggacaataaggattctgtcctccaaatagcaggaatctttgctctgatagctaattactgcttctgatcatggaggtgcagccatacagtgagccattgttgcaaaccccactgccactgttacaagcccctccacttgaggctgaagtgacttanagatttaaagggccattgccttcagtggtgattagtgaggagaaagaaaaaa

SEQ ID NO: 8382 - DNA, 1232 bp, Homo sapiens
gataatgtgagcaatctccagccacatacagaagtatagaagaatctcacaagtacaatttgagttaaaaacaaaaacccagacctaaagatatacatactctgtgactccaaatttaataattgctcatagaagtcaaatagaggttaccctgtaagaatgggttggtgactagagtgagcacacccagattctggggtcctagtcatgctctgtgtcttgacctaagtatacaggtacatgtaagtttgtgaaaatgtaacaagctgtatgatacgatttttctaatattgctcatctgtgtttgaaacatatacttcagaaaatgttaaggaaaaaatagaaaaggaaaagaaaaatagaaaacctaaataatctagtacttattaaagacttgaacccgtcataaaaagcctttccacaaattaaatactaagccaagcagacttactaaattctaccaaaagctaagaagctatgtcaattttatacaaacttttcaactaatttatgagcattaatttgatacccaaacctggaagggactatataggaaaggaaaatgataaagtcagtcttaattatgactatagattgcaagaacccttaccaaaataggagcaaattgaatcaaacaatttttttaataaggcaaaatgtaacaaccaagttgggtatattcctggtatgcaacactgctgcagcatttaaaaactaatcagttatggagctagagggaagatggcagagtaggaagctctgggaatctgtctccccacccagacgacaactgcactggcagaatctgtctgatgttactatttcggatctctgttcaccatttttatcaggttgggaactctgaagtctattgaaggcttatgacttccaggggaaggtttgaaaggttaatttcagctcttaacatggtagcaactacctgttcgtctaccctcagtcccatagcatgtagccatgtacacattttcaagcagctttgcatagggtttgtgggagccagtgtggacaataaggattctgtcctccaaatagcaggaatctttgctctgatagctaattactgcttctgatcatggaggtgcagccatacagtgagccattgttgcaaaccccactgccactgttacaagcccctccacttgaggctgaagtgacttaaagatttaaagggccattgccttcagtggtgattagtgaggagaaagaaaaaa

SEQ ID NO: 8383 - DNA, 1233 bp, Homo sapiens
gataatgtgagcaatctccagccacatacagaagtatagaagaatctcacaagtacaatttgagttaaaaacaaaaacccagacctaaagatatacatactctgtgactccaaatttaataattgctcatagaagtcaaatagaggttaccctgtaagaatgggttggtgactagagtgagcacacccagattctggggtcctagtcatgctctgtgtcttgacctaagtatacaggtacatgtaagtttgtgaaaatgtaacaagctgtatgatacgatttttctaatattgctcatctgtgtttgaaacatatacttcagaaaatgttaaggaaaaaatagaaaaggaaaagaaaaatagaaaacctaaataatctagtacttattaaagacttgaacccgtcataaaaagcctttccacaaattaaatactaagccaagcagacttactaaattctaccaaaagctaagaagctatgtcaattttatacaaacttttcaactaatttatgagcattaatttgatacccaaacctggaaggggactatataggaaaggaaaatgataaagtcagtcttaattatgactatagattgcaagaacccttaccaaaataggagcaaattgaatcaaacaatttttttaataaggcaaaatgtaacaaccaagttgggtatattcctggtatgcaacactgctgcagcatttaaaaactaatcagttatggagctagagggaagatggcagagtaggaagctctgggaatctgtctccccacccagacgacaactgcactggcagaatctgtctgatgttactatttcggatctctgttcaccatttttatcaggttgggaactctgaagtctattgaaggcttatgacttccaggggaaggtttgaaaggttaatttcagctcttaacatggtagcaactacctgttcgtctaccctcagtcccatagcatgtagccatgtacacattttcaagcagctttgcatagggtttgtgggagccagtgtggacaataaggattctgtcctccaaatagcaggaatctttgctctgatagctaattactgcttctgatcatggaggtgcagccatacagtgagccattgttgcaaaccccactgccactgttacaagcccctccacttgaggctgaagtgacttaaagatttaaagggccattgccttcagtggtgattagtgaggagaaagaaaaaa

SEQ ID NO: 8384 - DNA, 262 bp, Homo sapiens
gaaggaatacacacagctttgaaggaatacacacagctttaaatgttaggaaagaatgttgaaaatcaaatattaggaaagttgaaaatctaagattttgagaaactgaaaaagaaggcggggcacaacggccggcccctataatcccaacacttcaggaggcctaggtgggcggattgtttgagttcaggagttcaagaccagcctgggcaacatggtgagactctgtctctactaaaaatacaaagaaatagccaggcat

SEQ ID NO: 8385 - DNA, 262 bp, Homo sapiens; identical to SEQ ID NO: 8384

SEQ ID NO: 8386 - DNA, 1020 bp, Homo sapiens
ggacgggccgagcgggtcggggcttgccgtttgactggaattgccagaatggcggaccgagccccacgacaacctacctccctgggctcctcgccgcagcgctgcggctcgcctccctctgctcctcctcctccgccggatcgcggcgagcggatcgaggactgcctagcgcccctctgcccaccggtggttggaggccgcggcggctgcgcgttgagtcgtttcctgccggttgacctgagcctacttcgcagtagcaggaccgctgctgtggagctggtcgcaggcggtgtgtgccggtcgcctagtcaggagaactagtcctcgactcacggtgagggaatggaccgacacgggtattgtaccgctgagggaaaggagcgggactccggacctccaggaggtagggagtgaggccagtaggaccggcgcgcctccggggggattcctcccgggcgttgagttgccaacctgggacccgaggaagatcggcgtggtggtgtgctttttgttgttgttaaccctcctcggatttctcgaatttcacaccactgtccatatgcgatgatgtttgtttgcccttgacgcacttactcatggatggtacttcttcagcctcgttagacagcctggtgatggaggatgaagaaaccatgtgcttttcattcagttctggacttagtctcccttttcttccttcagcaagttatttttgttagttccttatcaaaaagtgtacataaaaattaggcaactccaaacatgcctccagggttaatgtgtgaaataataagataatatatgtaaagtggaattagctcctaggcatagggaaagtgcagaatattgccgtgttgtcatttacagttctgttgatgtcgataacgtttgtgggtgtaattggtagtgttctgtccctccaaggagttaataaaacaaagcaaacataggcctgttaggtttctgtggctactgaatatttgtttctcaaaacacttgactgatatttgataattgaat

SEQ ID NO: 8387 - DNA, 774 bp, Homo sapiens
ctcactatgaagatatttatgtatgttcccataatacttttcagatcccaatgtctgtgtttatccttgacagaaataatagaactgctgtcttcttccaagttaaacaaaactttggagctaaaagctagctaggtcaagagaaacaaaatctaatcctcacccaattgagagactgaatatacaaagaatggccaaacctaaccatgacctcctacccataacctcttcagtaatcggccagaagggtcaggacttaatctttaaccggcagcttccctatttcttgcccctgcttccagctctgggccaatcagagaaagccaaatgtgctcctcacaccaatcgcgtaagaagccctgcttctagtatagccctcctccaacttcccgatgccaacatcctccaatcagagccaacctgaagtttctcccttttttcagtatatgtaaagcttttccactcccctgcctgcctatgagtctgttaaatcaagtgatgggtcgcggctgactcttgccagctctgagtaaatagcctattctcatttggtggtcgttatttctacacagccggtgggaaggtggtggagaatagtgaagactattcttaaggttaaaaagaaggttcggcttacattttttttttattttaaatttacagcatggcgtctccagcccaggttttaaaataccttctaatgtaaggaaatagccctgcaccttgtgcccatcctagagagaaaatggtttcttaataaaaaatgtatgaggc

SEQ ID NO: 8388 - DNA, 815 bp, Homo sapiens
gaaatggagaagcttaaggcaaagggtgactctccggcctgaccctcactatgaagatatttatgtatgttcccataatacttttcagatcccaatgtctgtgtttatccttgacagaaataatagaactgctgtcttcttccaagttaaacaaaactttggagctaaaagctagctaggtcaagagaaacaaaatctaatcctcacccaattgagagactgaatatacaaagaatggccaaacctaaccatgacctcctacccataacctcttcagtaatcggccagaagggtcaggacttaatctttaaccggcagcttccctatttcttgcccctgcttccagctctgggccaatcagagaaagccaaatgtgctcctcacaccaatcgcgtaagaagccctgcttctagtatagccctcctccaacttcccgatgccaacatcctccaatcagagccaagctgaagttctcccttttttcagtatatgtaaagcttttccactccccggctgcctatgagtctgttaaatcaagtgatgggtcgcggctgactctgccagctctgagtaaatagcctattctcatttggtggtcgttatttctacacagccggtgggaaggtggtggagaatagtgaagactattcttaaggttaaaaagaaggttcggcttacattttttttttattttaaatttacagcatggcgtctccagcccaggttttaaaataccttctaatgtaaggaaatagccctgcaccttgtgcccatcctagagagaaaatggtttcttaataaaaaatgtatgaggc

SEQ ID NO: 8389 - DNA, 5728 bp, Homo sapiens
ggcgaattaaccttagcatatgatagttcttttagtgtttcccaccacccttttcagagtaagcaattagacgtctagagtttcttttcctctatctctttgggtaaatagcaaccagtggtgcccgccaccacgcctggctaattttttgtatttttagtagagatggggtttcaccatactggccaggctggtctcagactcccaaagtgttgggattacaggcgtgagccaccgtgctgggcctaccatttagtgttctttttttttttttgagacggagtgttgccctgtcacccaggctggagtgcagtggcacacagtctctgctcactgcaagctctacctcccgggttcatgccattgtcctgcctcagcctcccgggtacctgggactataggcgcccgccaccacgcccggctaattttttgtatttttagtagagacggggtttcactgtgttagccagggtggtctcgatctcctgaccccgtgatccgcccacctcagcctcccaaagtgctgggattacaggcgtgagccaccacgcccggccaccatttagtttttaggttatcagacatctgagtccatagccaatttggattctgcttaaggtgcaggtaattgctttgatgggtttaggtattgggagagttgtcagctgcctatttcccatttgacccctcgagtgaatccctgaatctgtctcaggttggtgattgattgctcagcttgagcagacagtacagggccactgtgtgggtgaacctggagcatctcagactggtctgttaggggctgttgtctgaggtaagcacagaagagaaggcacagtgacccttgtcagctccttaatacttggatcctgatgagctccagccagctcttcacctttccagaaagtccagtgtacaggtgcatagaagcagtcaaatgccggatcatttgttttcctgattctttgatttgaacatactgaaatgttgactagagaatatctgggtgaccaacaagaagcagtttatgtatttttttgagagggagtctcgctcttgttgcccaggctggagtgcaatggcgcgatctcagttcactgcaacctctgcttcccaggttcaagcagttctcctgcctcagcctccgaagtagctgggattacaggcatgcaccaccactcgtggctaattttgtatttttagtagagatggggtttctccatgttggtcaagctggtctcgaactcctgacctcaagtgatccacccgccttggcctcccaaagtgctgggattacaggcgtgagctaccacgcctggccaagaggcagtttttgaattccaaaattatggagtgatatctgggagtcagccttcatcagtgatgctgcttgtgctttctccagcttcttgggagactgggcaccaggagacttggaggttcttccctatcttacctactcccaagtatgcatgtttttgaaaaaaatatttaagatttctagagaagatcacaatcttctccagtgtctgtgtaatccattgtggagcagtttattacagctgacctactgtctcctgtctgttttaggagcggtgacttaggttatcaccccttagtgttttcctgtcatctgccttctcatctccacctaaaatttagtttttggtaaaagatcatgctatctaaccttgtcatcattgcaaaacaaacttatttatgtttatcatgatgctgacattagcaagctgactcatggtttaatgttagtgtttcttactactggtcactggctgacagtcggaaaagtgatgccctatttttttttttttttttttgagatggaatcttgctctgttgcccaggctggagtgcagtggtgccatctcggctcactgcaacctcttcctcccaggttcaagcgattcttctgcctcagtctcctgagtagctggaactacaggtgcatgctaccacgccccgctaatttttatgtttttagtagagatggggcttcactgtattgggaaggctggtcttgaacctctgacctcatggatcctcccgcctcggcctcccaaagtgctgggattacaggtgtgagccactgggccctgcctttttttggttttggttttggttttgatacggagtcttgctctgttggctaagctggagtgggggggggctggtctcagttcactacaacttttgcctccgaggttcaagcgattctcctgctcagccacctgagtagctgggattacaggcacccgctatcatgcccagctaatttttgtatttttattagagaccatgttggctagactggtcttgaactcctgacctcatgatccgcccaccttggcctcacaaagtgctgggattacaggtgtgagccactgcgtccggtcctgtctctgtttttatctgaaattatgttagcctttgcctagttatggtgaattaaccttagcatatgatagttctcttaatgtttcccaccacccttttcagagtaagcaatttgacgtctacagcttcttttcctttatctctttgggtaaatagcaaccaatttttcctgctactttagatagtaggcaataacaaaatgtattcatagctctcagtaatatttgttctattgttttgtttttgaggtgaaaggggggaccctaccctcagaacatgagggaataatatttacgtggctcacaaagaccagtgagtacatcatatgcatctctcacaactccccagaagagggcctccagcacgagtctaggctcagccttttctgtccctccgagaactctatgaattgctgccaagtgttttaattttcctcagaatttctttgtaatgttattgagggttggaggtccttttacaaattttggaaataagtaaatcaaatgagaagaccatgcttccaaacaatcattctgtttaacagatccccttgatttaatgcaattatgaatgcgttagtggtagtgtagtttaagatctttcccttgaatgtacaggctttaaagaaacgaacctaggagtgtatttcctatcaagcaaatgggttctaagactttacgctttacacatcattgattatagcgctgtgcttttcccgtgctaggcaatggatcacttggagtcctttattgctgaatgtgatcggagaactgagctcgccaagaagcggctggcagaaacacaggaggaaatcagtgcggaagtttctgcaaaggtatgcttgggtggcttcggtgtctggtgtgttcttaaaaatactggcttgtcaatagcttttttttttgagatggagtctccctctgtcacccaggctggagtgcagtggcatgatctcagctcagtgcaagctccgcctcccgggttcatgccattctcctgcctcagcctcccgagtagctgggactgcagacgcccgccaccatgcccggctaattttttgtatttttagtagagacggggtttcaccgtgttagccggtatggtcttgatctcctgacctcgtgatctgcctgcctcagcctcccaaagtgctgggattacaggcgtgagccaccgcgcccggcgttgtcaatagctattaactgaccctcagcactgattgtgtggacagtactctctgccttactccagttaaggatagagggctgtgatcaagcattcatgtgtcatggaattctcatccctcaggagctgctacctctgtctttttattctctccattttcgtcctctgtacatggtttatcattattttttaattttaatatattcttcgctgagtttggtggcttatgcttgtagtcccagcactttgggacaccaaggtgggggcagactgcttgagcccaggagttttagacctgagcaacatgaagaaaccccatctctacaaaaaatacatatattagccaggcttggtggtgcacatgtgtatcccagttactcaggaggctgaggtgggaggatcacttgagcttggggagattgaggcttcaatgagctgtgatcatgctactttgcttcagcctggataacagagtgagaccctgcctcaaaagaaaaaaaaattattgtcggtttgtttttttttttaagagacagagtcttgttctgtcgcccaggctggagggcagtgtcgtgatctcgactcactgcaagctccgcctcctgggtttacgccattctcctgcctcagcctcctgagtagctgggactacaggtgcccaccaccacgcccagctaattttttgtatttttagtagagacggggtttcactgtgttagccaggatggtctcgatctcttgacctcgtgatctgcccgcctcgttttcccaaagtactgggattacaggcatgagccactgcacccagccatctttttttttttttttttttttttttaataaagatggagtctgttgcccaagctggtctggaactcttgggcttaagcaatcctcccgccttgtcctcccgaagtgctgggattacaggtgtgagccagcatgcccagcctctgcatgttgttttaaactttaatatctccacataaaactggaaagaattggtaaggaaatggtcaaactgtggtacatccatatcatagaatgaaaaggaggtagatttatatgtaattagactgagtgccatttacatcactcttctgtttttctcttcagtggaactaagcctctccttgttttttcttttcagtgttgtaaaagcatttcttaggatttatgcaattgctaatttgaccaacggtgctattttgtttcagaaggtaaatcctagtaattaggtattttggttacagcttaaatctgtacatttaaacctaggcattttattaccatacccagaagaaaaagtcataaagagagacagcctagacaatgaccaatctgtgatgatccttggaagcatgtcggaagtgacaaaggtgccactggtttcattggaacataggactcgtttatggttacagtctcaatgctggcagtaaggatgccgtcattgttaagtgtggatctttagttcttccacttattttcagactggaaatggagcaggagaaacccttgttgcctttgcattcactttcattttcagatgtctgcttacctcattctttctcctcacaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggttggtgagataagtgccttagggcaagagaaatcttagtaatttggcagcgttgaccgttggaattaattgagcccatgcttgctcccattttttaaaaaatttatacattttgggcccagcacagtggctcacgcctgtcatcccagccctttggaaggccgaggcgggcggatcacgaggtcaggagataagaccatcctggctaacacagcgaatccccgtctctactaaaaatacaaaaaaattagccgggcatggcgccaggcacctgtagtcccagctgctccggaggctgaggaaggagaatggcgtgaacccgggaggcggagcttgcagtgagctgagattgcgccactgcactccagcctgggcgacagagcgagactctgtctcaaaaaaa

SEQ ID NO: 8390 - DNA, 111 bp, Homo sapiens
gcgcccggcccctctgcggctctttggaggtgtttagcgcacgtgcctagtgcagcacaagggcacctgtctgctgtgacagttctgactgacatcatgggcttttctcag

SEQ ID NO: 8391 - DNA, 3415 bp, Homo sapiens
ggtgacacccagcccaggggcacccccttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacacctccattggtgtggccaagctgcccccattcctatccacccctctccccaccccgtcctgtccatgcgcttccagggccccacggtccccaggaggacgcttcctggccaaagccccaagcctttggtgagaagccaattcccacttgacagaaggcgtccatccattcatctcattggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaattgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaaccagaaaagtcccctggtctgtcccttctttggggagcagggcctcgacagctccagctcccttgacctaccttcctccccgcaccccgcccccaccttgtgcccctgtgtccagccccccagggggcctgtgtctgtgtctgtgcctgtgtctgtgatggggagccgcctcgcacccctgttgtctgcttgtctctttgtgtctgttatcctgggcaggatggtcattctcaaaaaccctggggtcctgggccagagacaggcagggcccagtccaggggccccaggcctccccagtcccagtgtgcgagccccacttggacacaagtgttcagagaggtccccctctgccacttgacagggaccttcaaacctcgacagtgatgcaaggacacagagagtaccagataggtagcagagaccaaggcgcagggtgcttcagatgagcaagagaacccagtcgaaccagataccccaggtgggccggagggaccccagaccttcagagggctgccctggtgttctccacagtgcagtccctctgtattcccagagtgggatcggggctttcagccccaccctgatgcctgccctccaggatggctggtttagtctgggtccatgtcccagacccctctattctgctccaggacagcaggacttcaggtcttcctgggggtggatataggagaaaatttctgcctggcacacacctggctccaaccactgccaagtgatcactcttaggcccaggggaacacaatgactatcattactgatgcagacctggctgtggagagcagctaatgtgtggcccagagagcctgtctgtgtggagcacgtagtgcacagaatacgtgagagttgctctggcaggggcagaatcctcacaggatcgcctgggaggtgaggtgtgtgtgacccactggatgggagggcaatgagtgtgcacatacaaatggggcagtgtgcatgcaacacacttaggggaggagtggccccagaattcagcacgcacacaacacacaagggagagaacccccagatgagaaaataggaaggagcaatcatttgtagatgggtgaaaaaagaatgaggttcaagggagcgtgcaccaggtgaggtgagcgtgtgtgctctcagggaagggcccaggatcccatgcctgggaggagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtcgagacaccatcccaggtgtgtgtaagagagagagagagaacagggaggatacagaagtattgcagcccagatcccctatcagggggacagctggtgggcaaagcagccaccccacagccttgtggctagagtacagtggggtagaccctccagccccaatagccctagtacccagctggcagggttgcccacccctgctgtccacctgctccatcctctagggttccacaggcccctgaccgcacagggaggctggggccagcctggtctcccaggcctgaggacatgcctcccaccaaatgtcccctgctccagtcccactcctgtcaccccacgctctgcactggggagaaaacgggaggtgctcgtgctggccctgggtgggagcggggagtcctggtgagaccccggtgagatggaccatcctgcccccgtgggggatcccctttcccacatccgtgctgtgtcattgttgctctgcttcctttcaatgtgtcagtgcctggggggaggggaggagcaccccctcagccccctgaacctgaccaaaagccatggctgttgctcccccctttgtatgatgcaaatgctgaaatgtacaaaatcaaccatgacaacaaagaaaaagaccttgtacagca

SEQ ID NO: 8392 - DNA, 395 bp, Homo sapiens
aaatcaaccgcagccagagttgggactgggcttggggttccaggatcactctgcttccctgccttccagaatcaattcttcagccccaggggctgagtgttccccatggaccacccccccaccccccgcacacacacaccatctctgacaccccttcccccgagcccctctgggtgccgcttcctgagaatgctgtcaagtcgcacggtgggcagcaacctgtcctcattcattccccagacactgagggagacctactccccacgggccacgtgcagaagcctggggtcccaaagaaaggacaccactcagcattcctcccagacacaggcacttcccaggccttggtgaggagtcagaactgttccggaaccccctccacccttaccctcacc

SEQ ID NO: 8393 - DNA, 636 bp, Homo sapiens
aggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgcaccccactcccaagtagcttgaaaaagggaggacagtctttccccagcaggggtcggggggccccctcaggaagcctaaggtcgtgctagtgtggtgacccccatacattcctccctgctccccactgccaggaggaccactgtccccagccagccaaagtaatgacacattccagccctgcccagcatgctgacctttggcctctaaccctcagtgggcccccaggtcagggcaggggcactgagtggcctggctctgaggaagggagtcaggggaagcctgtcccgggaaggcccaggctgagaggccctggctctggccaggctgggatctgggtgggaggctggggctcttcttcttcca

SEQ ID NO: 8394 - DNA, 2392 bp, Homo sapiens
gagggatggctcacgaggcttggacctggtggagggtgcccggcagacgtgtgagagggacggttcacaaggcttggacctgccatggagggtgcccagcagacgtggtgtgagagggacagctcacgaggcttggacctgctgtggagggtgcccagcagggggctgagctctgaggggtgggtgctcagtgcacgggtgcccccagtgtcctctgatcctgtccggtgcctcccccaacccccacacccatgcagaactcccaggtcacatgcacgtatgtccagggcatgggggtggcgtgaagaggcctggtcagggcctttaggggctgcaggacggaatggccgcctggggagcctgtgtggctgtgccgggcagccatcctgcattcccacccagcgcgcagtctccacctcggccccagcaaagcgctaagcagccggagagacagccagggcggcttcctgaaggatgtgggatggtggactccggggtcgagggaatacgcaggttcctgtccctccgggagacctagagaagctgcacacccaggagctttccatgacccgggagcatgagtgaatgggggttccagtttgctgaactttgccgtcttgtaagggtgggggctgacggccgaccctgggaggaggtgacatcgccgggggaggttgtgggcaacggtggaggaggagagacgggaggggaccatttgggatggaggggcctcttcagagttttaaaaggcgtttgtggggtggagttgagtgtgctctgggcttggacacttgccgtggtgcccctggctggccgaggagactggctctggccaggggccccgtcctgagaggtcctcagcgtctgactctcggccaggcgccagcaaggaggggccggtccccggggctaccaggcaggcacgtgcacatcgccatcgccacacgccaactccgcctgggttttacaaagtcgttgccttaatgcatgtggacaggaactccctgaggtcgccccatgccccctggctgtgccaggtacggacgccctggaccctgcgaacaggtggggcgggcgaggggcccaagggacgggctccagagacacgcgcagggcaggaggggtctcacggaggggtctcgcactgaggcgcccagagctggtggtcccgctggacgccatccctctgcccgggatccacacggcccacgtgtgcccgccatgcccgcgccccacgccattgcagtctgccatcctctggccgtgacggtggctgcagcttccccatttgcgccgttgcctctggctgtctgcacttttgttcatgctccaaagaacatttcataatgccttcagtaccgacgtacacttctgaccattttgtatgtgtccttgtgccgtagtgaccaggcctttttttggtggatgtgttaccccgcacacttcaatctcaactttgtgcaccgtccattttctagggatagacgcccagggaatgaactctagttttctaacagattagctgagatattaacttactcacacggacaggttgatgccagagccgtaagaatgcgccagtgcgggtttgcgggggacttcgggtgtggggtcctgcggccgcgatggccgtggaaggttctggggatccctgctgccacggggacgagttcggacgccaggtggacctgtgcactcagtaaaacgcagtgattcaacctggacggtgtgtggcctcctcactcccactgtctctgggcggccggtctgagggccggggacttctggtcgatgctggggctgagtcgggtgcggtgctgtggaccgggtgtggggacggatggtccctctcctcagggcacgaacgagctggggtgttgtgaaacagtggggctgggggccacagtgagtgaggagcaggggcggctgggtcctagggctctggccagaggaggggccgctgtggggctgctgtggtccctgggctctctcttggggcgccgagctctccctcccctctgaggcctgcagccacccagaaagatgctggggcctgggcctgccgctggggcacctgtggtccatcagctcgcccgggcaggatcgccggtcaccatgtgtccacttgggtacctcctgttgttggcctggcccccgtctgcttgtctgtctccctgcccccactccctgcccaaatcttcctctgctcatctctggcctctggacaagccctcctgttccccacgctcgctgaggccctcagctggggggctccgtggcgatcttgacatcctacctggctggccaggtgacgagcgccctgtagggtgatttatacccccacacagggtgcaggtgtccatccacgttgcccccttcctgccgtgatccc

SEQ ID NO: 8395 - DNA, 454 bp, Homo sapiens
aagctgcctggggaggggctacaaggagtaattgtggctttaggggtcgtggtgatgctggaatgtcaagcgccgtcgtggggtatccgactgtccgggctcctggtccgcagtggcagagcgccaggcagagcccaatcagggtctcgtgctgcccttccctcccacagcctggcagccatccagaggaggggctctaccagatgccaaggtgccccggtgtctgtatgggtgtccggttgggtcctgtgtttggtctgccctggaggtgctgggccctcctgggatgggtggctcagcctcgaatcccaggccccagcccaggcaggtgctgctgcctgttgtggtttcctggcccagcttctccttctccctctgcataaaatcacagtccgtgagtcttccagctgccaccacggctgggacacgctgggggagggctcctcccatgcct

SEQ ID NO: 8396 - DNA, 31140 bp, Homo sapiens
ggtgctcgtggtggcaaagaagtctcttgcagaggagcagtatcaggactttgaagtaagttgttctgggacctttccattgcctttgcagccccacctgcctcccagtcactccttccaccatccctcatcctatgcgagccattctgatgtcatttctgggcacactgggttcactgttgttgaaggcctttgcacttgccgttctgtctgcctggaactctcttcacccacagagccccatggcccatttcctcgcttcttttgggtctcagctcaaaagccacgtcctccaagaagtcttcctggaccacctgtctaaggctccttctcactttccatccatcataccatttcactttgttcattgcatttgtcactgtcatcgcgtgctaccatttggggccaaaaaatatgtctaggagttgaatctggagaggccagaagaatataaacttgaccctgttcatatatttttttttaacattcatcttatccatctcctttcgggaataaaatatttttgaagacagggactttacaagtctggtttgttcttcttattcttgttcttcttcttcttttttttttttttttgagacagagtttcgctcttgtcgcccaggctggagtgcagtggtgtgatcttggctcactgtaacctccgcctcccaggttcaagggatccttctgcctcggcctctggagtagctgggattacagttgcccgtcaccatgcccggctaatttttgtatttttaatagagatggggtttcaccatattggccaggctggtctcgaactcctgacctcaggtgatccaccagccttggcctcccaaagtgcagggattacaggtgtgagccactgtgcctggcctggtttattcttatatccttagtagttaaagatagtccttggcatatggtatgccttcgggaaaatttggcataaatcattctcttggagccctaatttcttttctctttttttttttgcacatttattctgagacggggtctcgctatgctgcccaggctggtctcaaactcctggcctcaagccatcctcctgcctcaacctccttgtagctgggattacaagtgtgagccaccgcatctggttcggctccctaatttcttttcttttttttttttttatttgtgacagagctttactcttgttgcccagactgtagtgccaatggcacgatctctgctcactgcaacctctgcctcctggattcaagcgattctcctccctcaagcccccaagtagctgggattacaggcatgtgccaccatgcctggctaatttttgtatttttagtagagacacggttttgccatgttggccaggctggtctcaaactcctgacctcaggtgatctgcctgcctcggtcttctagagtgctgggattacaggcatgaaccaccacacccggcctccctaatttctttaagctgtaaaaatgttggggttgaaccagattattgacttgcttattgtcatcccatcccatagattgtgtgttccctgaggggagggtcctcgtcttgtttactgccgtgtctctggtgcctggcctaaatccagcgtgcaggaatgcaagggagggaggcgggacacgcttcgtggggccctgccctgctccatgcggggaaactgcctggatctctctttaatatatttgagttctttgtaagccattatttaacaagcattttagccccgatcaatgctacctgccttttaattttaaaagcatgtgcttcaagcgggcccattagatgactggttttcctccaggtttttgctaacatgataaagagaagaagcggcagtttgggttgatggtcttcagaagctcgacttggtctttagaaaacctggtgacccacagtttggcttacaaagtgcatgttgtgtatgggagaacttactgtttttttgagatcttggttgtgcccgtccctgagacaacccaatgaggttggtgctgttattgccatttcgtggccacggctcagagaggttaagtgacttgctggaagtctcccagcaggtgagtgtggagtgtagggtgggactcaggtctgtgcagtgtctacatggaggacttgtgaggaagctggaagcctatgtcacccctgtggggtccagctcacctgctggggtcccccaccccgtgtggtggggatcgggtgtggcccttccactcttggcactggccagtcagcctggcctctcctcaccctaagcagtgactgcatctgctggtgtgtcccaggcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtagggcgggctgcccgcagggaagggcactccagggcaatgccagttatccctcagcagtgcagggagatcacagggggaaagggtgggaggagcagcagaggacaccaggagtgccttatctgcaatgggccacaggcactgtttctgcccctccaactgtgattttttttttttttttttttttgagacggggtctcgctgtgtcgcccaggctggagtgcagtggcatgatcttggttaactgcaacctctgcttcctggattcaagcaattcttgtgcctcatcctccctagtagctgggattacaggcacgtaccaccacgcctggctaatttttatatttttgtagatagagggtttcaccatgttggccaggctggttttgaactcctgacctcaggtgatctgtctgtctcagtctccgaagtgctaggattacaggtgtgagccactgtgcctggccctccagccctgattttggaagacatcttgtgtagcgtttgcctttactgtaccgatgactcccctgactccactgggctccctggtgctcaaggccgagcagtgtccagcgtgcatggctgctgattaaattctagttgagtgatcagcacgccggtctgtctgccgtgtggccaagtgagtgagtgaccacccagcagagtgaccgtcagcgccatcacactgtcgtattagcattttgcactctaccagtggcgacccaaaaaaaaatactaggagttgaatctggaggggccagcagagggcgcgtgaggacctggtcctcagtggaccaagggaggtgtgaacaaccaaactcattggcctggagctcctggaaacgtgtgcctgccaccggcctccactcaaaagtggctctctgctgcatcctggggcctgtcctttcagcagggccatggcaggaggacaggttagatgccaggcaacattcaggcccactggggactcccacccctgcgtgcctgtttccttgtaaacccaattctgtcgcttgcatttggctcacaggcctggttcgtcataaggaaatcaccaacgggaccttgcttccggaagtctggccgctggaggcccatttctgcttcatcgtggggtctgcagtggggccctggccattcctaagacttctggagtttccattttctgcttccatctttgtcctggggtttttctccttctcaaaactatgttagcccaagacgagatattttattcacagagtgtgcatgtgacttaccattctagtttcctgttagatgacaggaggaggggagtgcctgggatggggcaggttagttggtaattaaagtctaagatacgatcttgcacaggaaattttcttttcttttctttctttctttctttttttttttttttttgagacagagtttcactctgtcgcccaggctggagtgcagtggtgcgatctcggttcactgcaacctccacttcctgggttcaagagattctcctgcctcagcctcccaagtagctgggattataggtatgtgccaccatacctggataattttgtatatttagatatttagtagagatgggttttctccatgttggtcaggctggtctcgaactcctgacctcaagtggtccacctgcctcggcctcccaaagtgttgggattataggcgtaagccaccgcgcctggctgcacaggatattttctaaatcagccccttgtatggatgtagaaactgaggctaagtgaggcgtctccattccccaggttctcacattgggaagcagcagagccgggactggagctggggtcttggacccttcctgtagtaccttgccttcatcacagcatgggacattagccatgtcgtgcacctgatcgttcttttcatgcttttctggaacttgaacttcccaattccttccccagtgtttgttctcttacctcaaaccctgagaactatgactaaacgaagctcaccaaaaagaatattatttttaggacaggcgggatattgagggaaaacagacccagctaggggagagggcccgggaggctcagccctgagaggtgcccggtgccttccttctgcccgtctcactgcctgggtttccatcctacctctccctttacttcttctgtgacccttggcaaatgactgaagctcttagcgcttccatttccagcctccagaagctgtcatgaaggtaacagagagctcagcgtgggtgctgggcacgtagtggacactcaggagacaattgtcatgatcttctttcctatactttccctcctatccagattttctttgaccgatagccccaagactgctcccagctgggagcaaagagaacaaaagggttaatgaggtaaaatcacagagcaggaagcacattccatgaggactctaaagacccggattctgggcctggttaggacaagaggtagctgtgtggtttggggcaagtcatctaccctctctgagcccacagcagagaaatgcagtgtgagctaatgcacgatacggaagaacctgactcatttacggtcagcgttttataagctgagttaaaccccagaagggtctgtcttgctcatccaactacatagaaagtccacagcgtcaaaaatgagtgtttcctgtaggacagggaagtgccccctcacctgtacagcctttcccttcttttaggatatttatcactttaagaaaaatcctcagaaggggaattatgcggtccaaggaccgagcttcatagtacctcctgtagtgtgtggccaaatggccctttctagaagcatctgccagtttttgctgctaccagcagtggttgcttggagtcccagagcccttcagccagggcgcttgctgtgttgtgttggggacagcatgagtcggcaggaggtaaacggaacataccaagttcagctccatgttgttggaaactcagctgttgcagatgacaggccggcctcaaaaactaataaacaggacctctgtcacgccatgatttcaggtttggatgctgacaggggacaagctggagacagctacgtgcacagcgaagaatgcacatctggtgaccagaaaccaagacatccacgtttttcggctggtaaagtgtcctctgcgttagggccatgtggggatgatgttcgatttgtcctataacctcctaaccttgagtgggccccttaagaagggaggggcagcatgtgaattacctagggtggggagcatcaaccacggttgctttggatgggatgattaatgacccaggcgccggctggagagtttcttccagtagtggtttgggagtacctccttctagccctgtgctaatgccatgctcttaaccttttgggggtcgtggtccctttgagaagctgatgaaagtcaggcactccccccgaaagatgcagatccactcatacacatgaaattatgcatgggattcctgggatttcacggaacccctgaaagtcaagtccttggataagaaagaaattccaggccacagatactggtccatctgccctcctgagaggggaagcatttaggaccattgaggagccttttgaaggaggtgaactggatgggcaaatgagaaatcgcccgcccttgtggcagacattgaccaagacaatgtgcacatcaggaactgctgccagtgaggactgtgctaggctttattgcattggggaggtagggggaccgggtcctctttggggcaggatatagtaatcccactgatctgaaaccagagccacgatggcaaaccactggagggtctctagatgtttgggggtctcgccctcaccccgcctttggtccatagcacacagaagcttcaaaaaatccagggatttttgaaatagcatagtattgtatagaggcaggtacagtcagttctcatcattcacagattctttgtgaattctcctcctcccaaaatttatctgtgacctccaaatcagtactcttgatattttcactgtcatacgtagagtggcttaaatctctccttttttttttttttttgagatggggccttgctcttatcacccaggctggggtgcagtggtgcaatcttggctcactgcaacctccgcctcctgggttcaagcaattcttctgcctcagcctcccaagtagctgggattacaggcgcctgccaccacacctggctaatttttgtgtttttagtagagacgggtttcaccattttggccaggctggtctcgaacccctgacctcaggtgattctcccacttcagcctcccaaagtgctgggattacaggcgtgagccaccgcgcctggcctagagtggcttaaaattttagctgcctgagacacacattcccacctgaggctgaacaagctcacgcactcccccctcctttcagccccgtgtgacgaaccagtgtcgtttttgcagtccatcgagtatccggttttttgcatttttatgctttttgttggcagtttgtcgtttaaaatggccgcacacagcgcttctttgctggcttgttttctggaacttgaacttcccaacatccataagtcacatcaacaggaaggctgttgatgtgacttatggagcgaatgcgtgtgttagatgagcttcctgcaggcatgagttacagaactggtggctgtgagctcaatgttaatgaatccaggtgtctttaagtagaaacgcacataaaataaggttatatatttatgaagatattgcaaccaggggcaaaaacctaaccctgtatttcccctacaggtgatggtttagtatttgctaattcagtgttcacagtgactttagaaaacatagctactatgaataatgagaattgactgtctgttctagaattcagggattgcaaactaatgacctatgtgctagccacctgtttttctaaacagcaggtattttgttttattggagtgtagacagaccggctcgtttgcatatggtgtacgactgcttttggattacaacggcagagctgagtggttgtgatggagaccatgtggtcctcaaagcctacaatagttaacatctggtcctttacagaaaagtggcccagtccctgctaggtgcctggctctgcatacctgggctacagcatactagccatgtgcctttagtcaggttagcagatgtcaccatgcttcagtttccttaggtgcaaaatagagcttcttctttttggcacctcatagagccgttgtgagaaataaatgagaaaaatccaccgaatgcatcatccaacacctggccgaaaatgaaagtacaggctttttttttttttttttttgagacagagttttgctcttgttgcccaggctggagtgcaatggcatgatctcggctcaccgcaacctccacctcccaggttcaagcgattctcctgcctcagccttcccaagtagctgggattataggcatgtgccaccaagcccggctaattttgtatttttagtagagatggggtttctccatgtgggtcaggctggtcttgaactcctgacctcaggtgatccgcccacctcagcctcccaaggtgctgagattacaggtgtgagccaccgtacctggccccccccccccttttttttttttaaaagacgagtcttgctctgttgcccatactgccagtgcagtggcatgatctcggctcactgcagcctctgcctcctgggttcaagtgattctcctgcctcagcctcccaagtagctagaattacaggcacccaccaccatgcccagctaattttctatttttagtagagagtgggtttcaccatgttggcaaggctggtctcaaactcctgacttcaagtgatctgcccgcctcagcctcccaaagtgctgggattacaggcatgagccactgcgcttggccagtacaggcatttttagtcctgggggaaattgtaggtggtggttggcacatgggctctcttgattcctgcagagtcaaccaataggattccatttggtgctgcctctggtggcaggggaggggagggacccttggctggggtggccgttgtcttcatgtgggctcctggaagccactgtttgttgttctatcatgtccggagagcaatgcctccttccccatctctgttcccttccaggtgaccaaccgcggggaggctcacctcgagctgaacgccttccgcaggaagcatgattgtgccctggtcatctcgggagactccctggaggtgagcttggggacccctgagagccagtcctcccagcagcctgggtcttacccggcttcggcaggggcactgcaggctcggcagcgacctccaccaacgcaccacctctccctccaccaacgcaccacctctccctccaccctgcaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggtaggcgaggctcaggctgtgctgctggccctggcctgccggtgcaccaggctccctttccctaaggatatttggacactgctgctctttcttcaaattccccaggcccctttgttcaggtcatgatttttctccacctctcagactttggctctttttgttattatttttaatatttcccttggagagtagataagcacgtgccaggcctctactcctttgccagtggctcaagagtgcagccttccagggggtggagaccacacactgtggggttggatctgggttcaaatctttccactggcctttgccagtgggtgccccaggtggcttctttcacccatctgagcctcggtttgcttatggtagaatgggaataataattgtggcttccttaaatggtgtcatgaagactaaaaggggtcacctttttttttttttttaagacggagtcacactctgttgcccagcgggagtgcaatgacacaatctcagctcattgcaacctccgtctcccgggttcaagtgattctcctgcctcagcctcccgagttgctgggactgcaggcgtgcaccaccacgtgtggctaatttttgtatttttagtagaaacggggtttctccatgttggccaggctggtctcgaactcctgacctcaggtgatctgcctgcctcagcctcctaaagtgctgagattatagtcgtgagccactgctcagcctaaaaaggatcacctttaaaatgtgcttgccacgctgcatggaaagcgtccagtaagagcactacaagttgctgctgatggtaatcctggggtatcccggcctccgaggaggacaggtggtggtaaatgcctatgtggacacagtcccactgctgctgctcagtgccgggacccttggcaagccgcctgggctctctgacactcagccactctgcctgtgaaacaggatcttggtagtcaaggggttggagagatggaatggacggggcaggccaggcactcagcaagcgctccgtgaaagacgagagtgcggtaaagacaagcatacattcttggttaaggtaagaatgaaacatcttttctctctggtctgtgtggctcgcaggggacggaggcaatgacgtcagcatgattcaggaatctgactgcggcgtgggagtggaaggaaaggtgagagtgtttccctctgctcggctccacttgctgtagtttcttggttctttttccctcaaagacacagctttaagccttctggaaattccagataaagaatgataaaacataaggaatcatgtgtcacagttaccttgtgtcactgggaagatagaggtctgtattgctacatcttacagacagatgaatgttggctttttgtttgccacgacctgaatttaaaaaaagaaaaagtgtttctaggcccggtgtggtggctcacgcctgtaatcccagcactttgggaggctgaggtgggtggatcatcacttgaggtcaggagtttgaggccagcctggccaacttagagaaaccctgtctctactgaaaatacaaaaattagctgggcatggtggtgggtgcctgtaatcacagctacttgggaggctgagataggagaatcgcctgaacccgggaggcagaggttgcagtaagccgagattgcgccactgcactccagcctgggcaacagaacaagactctgtctcaaaaaaaaaaaaaaaaaaagtttctctatattcttagggtatggtaagtatacttcagacttctctgggacagtcagcgttgtcagtaaaagcattagttatcctgctctgtgctgatctcttgggcgctatggaagagtgtggcttagttcacttctcaccaaaaggccttggcaggtataatttttaaaagttggtgtgttaggaaatattttttctgtctttttctccttgccaattgtgcgcttgcctcttacagtttactcggccctaatttgtgacctctaaatgacaagaggcaagaagatgggtcaccgagtttgttaggactgtgtgtgaagggctggaagcggtggctcacgcctgtaatcccagcagtttgggaggctgaggcgggaggatcacttgagctcaggagttcgagaccagcctggcaaacatggtgaaaccccgtctctactaaaaatacaaaaattagtgagatgtggtggcacatgcctgtaatcccagctactcaggaggctgaggcaggagaatcacttgaacccaggaggtggaggttgcagtgaatcgagattgagccactgtactcttgcctaggtgaaagagcaaaactccatctcaaaaaaaaagaaaagaagtgtgtttgaagtataggagtgccaaggcccggagggggcagcagagatgctcccctgtccatcctgttgcatagcttcatgactttggctgacccatagggctttttttccccctctttaccaccctttctggttctctggttctcagcaagatgacgatgatttaaagttgtagagtgaaatgatttttgaatgagatatatcagaagtctgtatagattccctgaatacagtttttaagaagcatgtttttgagtttaatggcattctctaccagttcttaaaaaattaaagcattttcccttctattaaaaatggtattctggttcctttgtttcttgggatataaaatagtgctcactataaaaaattaaaagaatctaggccaggttcagtggctcacacctgtattcccagcacattgggaggccgaggtgggcagattacctgaggtcaggagttcaagaccagcctggccaacatggtgagaccccgtctctactaaaaatacaaaaattagccaggcatggcagtgggtgcctgtaattctagctactcgggaggctgaggcaggagaattgcttgaacccgggaggcagaggttgcagtgagcggagattgtgccactgcactctgggtgacagagtgagactgtctcaaaaatatatataacataaaataaaagaatctagaagtaaaacgcatcttttcttttaggtaactgcatcaaatgagtaacactggttattctctcaacattttttctgtgtgtatattactggttatgagtgtgtatatatttgctatctatacaaatatcttacacatgtatatatatgtaattttcatgtatttttttaaattgaaaacacactgtacattttgttgtgcagcttacttaaatctgctacatcatggatttgttcctacatgagagcatacagagccatcacttcttactctgactctacctttttattttgaaaaatgtcaaaagttgaaatacaacaatggaaaagttgaaatagaacagtgagcattcatctacccttcactttggccaattgttactatttgctacattatctttctttctttgaatcagtagaaagtaaattgtatgtaatgttacccctaaatatttcagctggatctctttagaacaaggacattctcccacacaaagaaagtaacatcataaccacgccccaccccccgccccgcccccccaggcacccccaccccatgtaacatcgatacaatgctactatataatattcatgctcaaccccgtgttaacattgatatataatggtactggataatattcatgctcaaattcccccatctgtcctctgagtgtcttcacagcttaagtaataaaagctccaggaaggattgcaaatcacatttattagcatgtcctcatgtttctgatcttctttattgtagaacacgtttctctctttttgtttggtttggttagcgggtgttttgtttttcatgtcagtgacatttttgaagcattcaggacagttgtagtgtctcacggcacacagttcttgaacccatcagattgattcggttccaattctggtttggcatgagcactgtacaaggggaattggtgttcttcctgttgtgtcgtatccagaggctctcatgtccctctgtccctttattgctggctgtcactgccttttaaaatgagagaattcggccaggtgcagctgctcatgcctggaatcccagcactttgggaggctgaggtgggcggatggcttgagctcaggagtttgagaccaaactcggcaacatggagaaaccccatctctaccaaaaataactaaattagtcaggtgtggtggtgcatgtctgtgctcccagctgctcaggaggctgaggtgggaggatggcttgaacctgggaggcagaagttgctgtaagccaagatcacaccactgtactccagcctgcgtgacagagtgggacccagtctcaagaaaaaataaaaattaaaaaatacaaaatgagagaattccattatatggttgcactgcaagttattcccacttctgtgagtgtgcagagctgtgtattcaggaatatcctatctaatattgttagtagctctgggtttttgcctcttgtttaattagctcttaagggaactgaatgttttaaaatatctatttttaaatgattctttgctacttatggggtgggctgaactcccaaagtattagatccacttgacgtccaaattataactatatgtgattcggaatggtttttatttaaataaattccccttttaaaatcaaatttagacttggaccaccaactgcatatagcttgaaaccaaagaatttctttcttgaagttcttcaaagatttcctacaatgtcttgctttttcagtgaaagaaaatgtgtttgccctgacctcttgtgcttctgatggtgcctaattttattggattttaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggtgagtggacagctggcccctctgcacatgtgcctgtggctataccatgtaggtgggtgggcagctgctccctctgcacatgtacatgtggctatgtaattatcatggaaaaagcctgggaattagattatgctttggagctgtcacccctacctcgccagtttaaatcccccacctggctgcattccagctgatagaccttgagccagtccctgaacttcttggtgctcaagattcctcccctgttaagcggtgctggtcattcctgccatgtggtgaggatgtgtgcgttagcagtggtgacatccagtgcctggcatggggcaagtggagtgtacatgagttattttaattgtgggtacgttgttataatttgtttgctggagtgaaagacgcagagttaaatgctgaatgactattcaggccctggtttttcaccttttgcagaggtaagggccatcagagaacaaccactaaagaagaatgtactttgcttgtgtgcctcctgtaccttaggcatcaggctaagtgttgacaatgcagtgtctcacataagcctcacaatagcctgagcccattttacggatggggaggctgaggctgaatatggatgagaaatttgtggtgtcccgcagggattcagtcagctcaggcaggtggacctcaaagcctgcagtcacaatctgagtaccttcttgatacactcgtcatggagggcctgggaccgtgtccacttgcaggggtcagcatgacacttggcactgagattgactcagcatcacggttctgtcttccagcagagcctagtaggggaactgagtttaattattatgatcacgaatacccttggaagttaacatcttgttcccatcttgctttttcataaaaggattctagagtatatattttctcaccttctctctcacaaacttcttcaaaatctgtcatcataggccaggcgcagtggctcatgcctgtaatcccagcacattgggaggccgaggtgggcagatcgcctcaggccaggagttcaagaccagtctggtgaacgtggtgaaatcctgtctctactaaaaatacaaaaattagctggacatggtggcatgcacctataatcccagctacttgggaggctaaggcacgagaatcacttgaatctgggaagtggaggttgcagtgagctgagattgcgccactgcactccagcctgggcaacagagtgagactccatctcaaaaacaacaacaacaaaatttgccatcagtctgtagcaattaagtgtggagtagaaaggaggccaaaggagggaaagaaaatatttttggtattaaaaagctattgattgtcaatcttcctttttgggcattgaggtgaaaatgctcccagttgagtggtgagaatgtaggtacagtagatcctggaactcacgtctccttctggccataccattaaggatctgtgagaccttgagcaaataactttactactctaggcctcggtcttcccacctggaaaacggggatgatgagaccctccttgccctcggacagggccactgtgaaaaacagagacgtttttaaggcatcagtgctaaggcatccttaccgtgattagtagaagtgaaataaggtaatatgtaaacatcaggtgatattttaatttgtgagaatgtttaatcatacttgaaaggcggtctgccttgtacaatgtatcaggtagtgctgctttgggtacatgagaattttccgtccactggctacaccccagttttttgggggtgattttatgttttaaatatctattgcaattgtgagtaggggagcctgaaagtgactttcatcaaaatgatctaaacccaaacagctgctgtggttcaccagaccacatctgtacttttatgttaactcaccaattgaacaggataatgctgtggctttaatgattgggagattaatcagcccgtccttggactcatacacaaaagctggccgggatgagctgacttcttcaaaaactggatgttactgttaacattgatgtagaaaaagaattccaggatgaggcattgttctttgtgctaaagaaaatgcctttaacccctgtccactgtgctgaaaatggccgagagcaagtcccagttagaattgcaccgggacatgagtctgtcagagaacacagtgtttttatttttcccaaagtgctcttgtcgagatgaagactttgtggttaggatgacccttttagaggaaggggctcctgatactggtctggaaaataaacaacagattcttgacatttttacaaccatccttcctaagcagcggcacagcctgggtgaaaagtcactggaaaagtggcttttccggcgcagccagggcgaactggggcttcctgtggccatggcgctcaggatcacctgcgctctgagctctgtgccgagaaagcacgtgtttcttacatgctttctctctgtgtccattgaaggtgctctggggagctagccctggtctgatgctatttctaatgactagggtatctctgccttgctttcttctgctttctaaaagctttcaggcagcatttgtctctggccttccttcagctttatatgaatggatatcagcttggagaccgtgtttcctctgttagcccatagaggtccagagatggagctaacagagcttcaagcctgattggatctccccagcctattcatcattaccagcagctaatattttccaaagcaggaagcagacatttccgcgagggtttgtaaatatcttcattgcttttgtctaattgcaaaaataatctgtcaccatgctcttttcaaaaatttccccaaataccgaaacatgtaatataagaagtgaagccttttctgccatcccagcccccgtagacacttcagaggctctttttctgtatgtgtttccatacctacggcactttggttagcagcgtgcatgcctacagaggtgaggattccgagctgtttagaagtgtggccacagagctgtggccacagctgggcttgagtcccatagggctgtttacctgctcagcctccccttctgtaaagtgtgggtgatagtagggcttgatcctgtgggctgctctggagatcagctgtgctcatgtacaaagcattcctgggtcctggaacttaataaatattcacaacaggctgagtagaccctggagctgtgatacatcaccctacccgggaatgattcctagatttgctgcttaggaactgtgtgggcttgggcaagccacgtaccctctctatgcctcactttctgctttgcataatgaggatgatgagaatcgtacctacttcatagggttgttgttgatgttgtgagaatgaaatgagcaaatccatgtaaagtaccttacagcagtgccggcgcgggtgttatgtaagtatcaggtgttatttttattctgtaaatgtaagggattttgtcatgacttttggtgacatcctcctctctccttggcacaggctgtcttttcctccgtgttttactttgcctccgtccctctctatcaaggattcctcatcattgggtaaggaaatcctgccaaggaattaattgtttacaaaaccttcttcaaatgctgcaacagagagaagaaacgtggtggaaaaattcttgggttcccaagccacattggattcccagccccagcgaatgcaggcccagcaccatggtttagaacctccttcaattaacaaggttttgagctgttaagcccttaaccagatggaggaagtggagttggagatgtgtgtggtgtgttgcactttgccatttgtacctggtcttgaaaaaatactccagagttatcagttgattgaggagagcaaggtggaaggtttgcagacttggtgatttcactggggtcttaataaaaaggggtgggggatctgaaaaatgccctcctggcctgaactgagcccagtagaagtcccatccttggagctccagggagggccagagtccactgcctcggggatgtgcaagtaacagagcttggctgctgtgccacagtgacagagatggtgtcacttgggcctttgcagcctgcaaacccacccccattactgacctggaacttcaggatgatccttctgaccttttcagagaatgtgctcagtctctgaatcacccaggtaggtggagtttggttaccgagtgccctagatacagacacatgcagctgaggccacttctggttatgaggagacggcgggtgcgggaaggtcagctgcgctctggagagtctcacagagtccgctttccatcctactgtgttggctgatgagttcagcctgagaggaggcactagaattctgcctgcttctaactggaaaagcgggctgtctttcgtcgggttctggaagagtacaagaacattacagaatatagtcaggggttccctgagctgtgcgccgtgcgaccttccgtggtctggtcccatctttcccgtgggtcctcatttcctcttccgtcgccctcagccccagccccactggccttatggctgttcttcagacatgacagccactcccgcctcagtgcctttgcactggtggttccttctccctggaatgctcttcctcctgggattggcttggctggccctcaccttttgtgggtgttcactcaaatgttctgttcctcagcctctaaaattgtaccatcaccccctacacacacacacacacacacacacacacacacgtcttatttcctctaccccattatatttttctctttagcacttctctaacacacatagagtttacctaatttatttgtttattgactcgctgaccgggatgaaagctcttcagggcagacatttttgtccatttttgctcatgggtttctggtgcttacagccagccccggagcataatagacaagcagtaaatatttgttagaggcatggttgggacttgggtgccggaggctggcacagcacatagctcctatcgcgtcagccaggtcttacctatggcggttttctctcccaggtactccacaatttacaccatgtttcctgtgttttctctggtcctggacaaagatgtcaaatcggaagttgccatgctgtatcctgagctctacaaggatcttctcaaggttctgttagcttttcagtccctccttcctcctttcctcctttgcttttcccttccttccctccctccctgctttttttctttgaatttatttcacacagaccctccaattctgatttgaacacacttgaactggtagcttttttacttttggggggaaggtgtgggagtttacattttttcttaaagcagtaatatattcactggtataaagaacgtgaaaaagtacagtaatagataaactgaaaacaagccaactcacgacttgcaaaaagcccctgacagttccgctttgcagttgcaacttaacgtttgctcccagagatgttcttgtgtacagttccaaaaagtgtgtgtggtggcgtgtgcctaggcaggtgtataattttatttgtcttcagggttttttacccaagggaaggtttattcccatgtaatgttaattttaatgttaattctttttttttttttttttgagactaattctcactttgtcacccacgctggagtgtagtggctcgatctcggctcactacaacatccacctcctgggttcaagcgattctcctgcttcagcctcccgagtagctgggattacaggcgtgcaccaccatgcctggctaatttttgtatttttagtaaagaggaggtttcaccatgttggccaggctggtctcaaactcctgacctcaagtgatccacttgcctcagccttccaaagtgctgggattacaggtgtgagccaccatgcctggccaattctttttttaaagaaataattcctccaatgtgttcagatgtgtgcgagccactttattgatgaagacagatgggttgccttatctcgttagcgggagaataacgtgaaagctgatggcatgctgcgtgagccccccgcgaaaccggctctaacctttctctgtctctcattcagggacggccgttgtcctacaagacattcttaatatgggttttgattagcatctatcaaggtaaggatgagtggagacacctgtttgtcttgtgctctggtactgactcagggtgtccccttcttgcctgtagaacaagaagagaagaaacgaatctgaaatagcaggaaggagggtggcagtgggacccaggggagaccctgctcaccctgtataaggacttgaacatcagacatgcacagtgctgctgtgtgagaaatgaggtagtgaagccagaggaaggcagtggacagtaatcaaagcctgtggggctgctccactcatgaggcaaaaagcagatgctttctgggatgttctgaaaccttttctgagagtcaggtcaagtcgtagttttggaaaaacatgtttacctcagtggcctccagaggggggtcttcccagactgtggaggcgttgtaagatgacctgttggaatataagaagaaaatagcaaaacttctgtttgtatttatttttcctaactcttttaaatttacatatatatatttatttatttatatatttttgagacacagggcaaagccaccatgcccagaatccttttttagtatttctatttttatgtatgttttgtagtgcacataatagattttatatacttataaaatatattttatataatatgtagaaacagagtgagaccctgggtggcggagggtctcactctgttgcccaggctggagttcagtggagcaatcacggctcgccgtagcctcgacctccccaggctcaggtgatccccctacctcagccttctgagtctgggaccacaggtgtacaccaccaccaaatcagtttccaaatcagttcatttcttcccaatggactgtgagccacgagtccctgcaggtccagcaagatgacctcatgctgtgctgtggatcctgtcgggtgctgacacaggctttaattcctgtctagaaacctgtttctagttcagcatcttagactacaggtgtacaccaccacacccggctaatttttgtattttttgtagagatgaggtctcaccatgttgtgcaggctgatctcaaactcctggactcaagcaattctcttgcctcagcctcacaaagtgttgggattacaggcatgagccactgtgcccggaatcctcactcttttttagtatttccatttttatgtatgttttgtagtacatataatatacatgtgaaatgatcctaatatttctatatatctggacaggtacacatatataacttacaaataaacatgtgtatttggggattattattattactattctgagatggagttttgctcttttgtccaggctggagtgcagtggcgccattttggctcactgcaacctccgccttatggtttcaagcgattctccggcctcagcctcccgaataactgggattacaggcgcccacctaattttagtatttttagtagaggcgggggtttcaccatgttggccaggctggtctcgaactcctgaccttgtgatccgcccaccttggcctcccaaagtgttgggattacaggcgtaagccaccgcgactggctggggtttattatttttttaaaaaataaatttactgttcatgtctcctattggggtttattcttttttttttttttgtaacagagtcttgctgtatcacccaggctggagtgcagtggcacgatctcggcttactgcaacttccacctcccaggtttaagaaattctcgtgcctcagcctcccgagtagctgggactacaggcatgcgcttccacgtccagctaatttttgtatttctagtagagacagggtttcgccatggtggctagtctggtcttgaactcctggcctccagtgatccgcccgcctcagcctcccaaagtgctgattacaggtgtgagtcacgacatcattttattttttatttttttgagacaggggctcactctgtcacccaggctggagtgcagtggtacaatctcagctcactgtaacctccatctcccaggctcaagtgatcctcccacctcagcctcctgagtagctgggactacaggtgcatgccaccatgcctggctaatttttgtattttttgtagagacgggctttcaccttgttgcccaagctggtctcagactcctgagctcaagcaatccacccaccttggcctcccaaattgtgggttttcaggcctgagcccccgcgcctggccgcgactccatcattttaaatattatatttaactttctatttctttcatcaactctagatactcccctccctgccttacttccttttttctccctttttctcactttgtagttaaagattatttatcctacaaggtcaaagaggaaaatcagaaaaccataggttcagacctgcataaagcaccagtcattaacctcatgtaacaagtgatgcctttcatgtctaaatgaaaactgcggaaaggagccaggtgtaggcgagcagcgcacggctttcgcagggagggtgaggggaatacccttctctggtgtttgcagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcggtaagacccctgaatgcttaaaccccgtccgtcacccccagtgaatctggcccagaggtctcactgccgtatgaaggaaggggggttcccagcgctcggcctgggctcttcctccagcagtccttcccgctcagctgtccacgttttcttaacaggtgttctctagggacaggtggtagttgtgcctcagggtgtgaaattgaggacagagggcgtgattgcagtagacagtgtttttgtttttctttttgagtcggagtcttgctctgtcaccttttttgggccacaaaatctttttgttcccatgaaatcttaatctgaagtccaatctatgaaactgataaaaggggacttgtgatagcaaagtggcagtgctgggaggtgccgagccccagaaccttgcccgtgcagccctgccttgctgctgtgtcctgatagagctcctgagggactccagggatctcagaatacaatctgctgctcctcacagcaaaccaagtgctgaaggtactcgccagttccgtagacgtgggagcacctgccgtgtgccaggattatggtggcagatgaggtggacgggctcgccagggagctgcccttctcgttgggaacacacgataaacacacattaagtgagtgtgagcacaggaatatcagatgtgatcaaagttaccaagaaagaaaaatggggtgaggtgctagacgcccaggcacaccccaaataaaaaatgttatggaggccgggcacaatggctcacacctgtaatcccagcattttgggaggcagaggcgggtggatcacgaggtcaggagtttgagaccggtctggtcaacatggtgaaaccccatctctactaaaaatacaaaaatcagcagggcgtggtggcacacacctgtagtcccagctacttgggtggctgaggcagaagaatcgcctgaacccgggaggcgaaggttgcagtgagctgagatcacgccactgcactctagcctgggcgacagagtaagactccatttctaaataaataaataaataaataaataataaaaaatgttatgggaatgtagagatgggggagtgtcagcaccatcctaatgtggggtggtggcagatttctctgacctcagtagtgattccaggtactcttgggcttgtccagcgtcagccactgtctctagatggacaagcctggtttcatcactcttccatgctgacctcacttgctttgccatatcagttaatttcttcccaattgattgagccacaagtccctgcagggccaccaagatgaccccatgctatgctacggaccccatcgggtgctgacacgggctttaattcctgtctagaaacctgtttctagttcaactagaacttgcaacacgggcacggttcagatgatccagcattttctgtgttgtgctgtggatagattctgaactctaatcttggtttcccccgcacggggcaaactcaagccgctatggctttggaacctcagggccaggggtcatcctgaaagtctagctggtttagcagacagtcctctttacacctctttcctcctcagtaggagcatttaattttctgtctgtgttattcaaacaaaaaaccctcaagagtgatactgtttctcctttatcagctgggggagcagggcccggaggctgcttctctgctaagaagctcatgtgtgttcaggattgcaggatagactctctctgggggaaactttcagttaatgacaaccccctcacgccccatcctccgtgggaaacctgcagggcccaggctctctagcaatggcccatcccttgctcctttacctcaggccttctcagtgggggtggtgtggaccccaccgcctggggaacaaacagtggtctttggtggggtgtgaacaaaccctaaccttttacgtataaaggagatgtatatataatattataaacagatacacagtatacctgtgacattaacatgtcatggaggtggtcaattaggagaagaagaaaagtctaaaaatgttccttaaggggcaataacaacaaaaaggcagagaaactcgaccttaccctggaagcatctttgatcgcggctcttttgccagcttccaaagctccttaggaaggttttagtaaaggtaaaagaaacatcccctgaaaagtaaaggtttcacagttgcagccccagtttctagaaaggatttgtgagcatttactgtgcgctccaggaactaaaggagcatccctgtgaacagtggagttttaaagcagtttcacccttgtcactagtctctagaaagcgttttgtgagacctagtatgtgctcaaaggcttgggcctgaggtggtcacagagatgtggcccctgctcaggaagctcagcttgtttgtgatagggacacaccacaggaccgggtcagaggtgtaggaaaaccacagggtgagttgagccttgggcctggcacttagtaggtgctgcctcagtggcagctgcatttcagcatcctgtgctcagaaagtggagaaggggcttattctggcttctgctatattgaaagccacaaactgtcactcctctcttaagaaaacctcataaccgggtttataatcctgcagcaggaaaggcagtacgcccgccccccccaccttccatcagagtccctgagggtcagcttaagcctttctctgacaagggggtctgaacactttgcaccatgacccagactcatcctgtggctttctgcgaccatcactggaagcagagggtgcatttgaatgtcattttctgctcgccagtggccgggacttagaaagactctccaactgttagacaacaccaaatcaaaagcatctctgagttttcttcccctgtaattttctttccttctttttttctcttttttttgagacagtgtcttattctgttgcccagggtggagtgcggtggtgcaatgttggctcactgcagtctcaagctccccgggctcagatgatcctcccacctcagcctcctgaacagctgggactataggcatgtaccaccatgcctggctagtttttgtattttttgtagagacagggttttgctgtgttgcccaagctggtctcaaactcctgggttcaattcttctgcccgccttggcctcccagagtgctgggattaaggcatgagccactgcatctggtggcccccatagttttcttctcctgggtgttaaaagtagcatttcactgtcaggaagctacagaagagagagcgaggaaaatcaagctgcggcgctgtgtgctcttagccatggtaccttcccttacagtccatggagaaagagggccaatgccaggaggctgtgggtttgtgacgggagatgactttccctttgatagttgtgacgcctgtttctggaccccatgcaccttccggaatattcctgcctgctcactgccgtcttcccctttccttgcagatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagtggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtgtgtgtgtgtgtgtgtgtgtgtgtgtgtgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagatgtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccatttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttcccctccccccaccccttcctttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttctgccttgggggattattttaatttgtacagaaacatgaattctggtatcaaaatgaggactttttattataacgctcctattttttctttatttcatggtacatgaaatgtaaagaaaactctttccagttcagaaaattattttgattttggcaaaaaaaaccccaaatcaatgcatgttatttattattttgtactattgtccatcccagacgtgtcagaatttcaaaaggtgatagatataaatggaaaataagatgaaa

SEQ ID NO: 8397 - DNA, 573 bp, Homo sapiens
atttgctaaagtctagagacattctggttgtcaccatggagggtgtatgactggcatctagtgcgtaggggccagggatgctgctcaacattgtacagtgcacaggaggggccctgcagagcaaagagttatctggccccaaatgttcacagtgacgaggttgagactccctgttctagtccttatcttccctattctttcagtggaccacagtttgatgatatctgcagtcccaagtgtaaatctaaaatcatagcatgtgagtctattccagttgaaatagtaataactttcaaaacaaaggtcttaaatccatttgatctttctttcatcattgaaaatcttccaagtgctttgagttttccttttactttctgtagcctttgcccctaaatgaggccccttctcgcttttcatcttcagccaactgaaaaaacattggtgtctgttaagtgcactttgtacactgtctgtcatgggaagcgggctttgccgctgaaagagggtgttcctttcagtttctcattccttccggcctccctctctaggatgaatcaactggagaaattacgt

SEQ ID NO: 8398 - DNA, 498 bp, Homo sapiens
atttgtctgtctgtatttgtaaaagggcccggaggtataagctcgtgtgtctcaggaagcaagttatgcctccgcctactataccaaatactataccaaatggtgtaattagtggctgtctgcagtgtgagctgctggttccctctttttggttctcaatggaaagggccatcctcagtatatagattagaaagataattgtaacttagttgtgttatctcatgacagcagcaaaaggaaggtatgtggtttcaaaggtagggaccgaccatgctttcccttaaacgtgtgctatccctgcacgaccttaagcctctgcatttgcctgcagtgaacttccgtccatgtgcggacactcctccgccggagccgctagggggaacttgaggactgaaagacattgctgtttcctgttttccacaaccagccggaccccacgtgcccaactgccctgagtttcaagactgtgctttcatagcttcagaatttatttcatgg

SEQ ID NO: 8399 - DNA, 18214 bp, Homo sapiens
ctctccgcccccaccccctgtcggcgtctgggcctcgtccccttctctctgtctcccttgcctcccccatcacgtcccctgacaccgacaccccattgctcccacagtctccccagtctccactttggtccccagcgctgtctgcccgaggtaagatggggagggggcggcccgcggagaaggggaggggcgaagcatcctgaatcccgagataaacaaacccggggagggggcagccgcgactgaggggcctgacgcgggaggagaagaatggggggctgggcctgggggaggtggcaggcgctgggcgcacacaccggggccctctatgggtaacgggggtccctatggttgcccaagatccagttgcgcggaggccacccggggccctggaagctcctaggggcttggaccctggagcctgccgggcaccctctccagctgacctctgcctccaggatttgcctgaaggctgcccccaactctgcacccgccccccgagggccaccgaggaccatgactaagacagatcctgccccgatggccccgccaccccgaggagaggaggaagaagaggaggaggaggatgaacccgtccccgaggcccccagccccacccaggagcgccggcagaagcctgttgtgcacccctcggcacctgcccccctccctaaggactacggtaaccactgtccccaccctggaatctggcctggagcgttgggtggccggggagggtgggctgtgctctgctggtggtgatggtgggagaattctggggaatttgaaggtggtccagaggaatcttggctgcagagcacccctcgttaattcattcattcacccattggagaatggaattgtaatactcctagtctttgactcatgacacatcattccatcatttagtcattcaacaatcattttttgaaagcggctgtggacctggctttatgctaggggctggggccacagcagggggcaagagagacccagtctttgccctgagacaactcacaggcctcagtaacagccacacaaataggtattaaaccataatgtaatttttcacatttaggtttatatgcaagaaagaaaaatataatgtaatataaatatgtaattacaagacattatgaaaattgtatttaccataaacaagctgctgcaagagttttttaagacattgtttccctgaggaggttacagttgagaagactggagggtgagttggggttaactaagagaagggtcaggggaaagggctcccaggagaggtaaccgctgggtaaaggatctgaggtaggagggtatggagctgagagggcggcctcttggagaaactgaaagtgtctaatcattgaccgagcgatatttatcgagtgctgctactctgtgacaagccttatgctgggtgccggagatttaatcctaagtgatccaggcatgatcctcccttgcaggagagaaggagagactaaacaagtgaacagataaataaatcagaaatcagataaattcagattggagcaagtgctatgaaagaaagaaaaggtgggctgggcatggtgtctcacgcctgtaatcccagcactttgggaggctgaggccagcggatcacctgaggtcaggagtttgagaccagccatggccaacatggtgaaaccccatctctactaaaaatacaaaaattggctgggtatagtggcatatgtctgtaatcccagccactcgggaggctgaggcagtagaatcgcttgaacctgggaggcagaggttgcccaagatcgagccactacactccagcctgagtgacagagtaagactgtctcaaaaaaaaaaaaaaaaaagaaaaaaaaaaaaaagaaaagaaaaaaagaaaaaagaaaaagaaattaaaggtggagatacgataatgactagggggcagctacctgcaggggtagtcagggctgctctttctgagtaggtaacatttagtttgggacccagagcatggggaggaatcagccataagagagctggaaaaagagtgttccaggcagacagcagcaagtgcaaaggccctgaggcagaattgaacttggaacagaaagatcctggagctgcattcagggaatgatcgaggttgaggtgagaggttggcataggccagatctggaagggccttcaaggctacagtgaggactttggttatattctaagtgggacaggggagaagagtggcaaggggagggtgtttaagagcagaggagtggcaggtctgatttgtagtttgaaagctccctctgggtactgggtagaaggggatggagtgcagccagagttggatgtaggaggggaatttggaagatatgcaggctgggaatccccggcagctgtgaggttcagaaaccaggttcagagagtcagcgttgccaggatagagcaagacagatggcatccatggacatgtcacccactagaggtagatcagggagactacaagttgacttcagtctaatagaaaaataagaaagttggctaggcacagtggttctggcttataatcctagcactctaggaggccaaggtgggaggattgcttgaggccaggagttcgagatcagcctgggcaatggagcaagaccccatctgtacagaaaatttagaaattagccaggcatggtgggtacctgtagtcccagctactccagaggctgaggtgggaggatcacttgagcctgagaattcgatgctgcagtaagctaggattgcaccactgcactccagcttgggtgacacagtgagaccctgtctcaaaaaaagaaaaaagtaaaaggaagttatctggggcctgaggtcgggggggtgctgtacctcagaaaactggaaaatctcctttggaaatgcagctggaggtggctggggcctctgactcagtgggaggtcggagggtataggctgagccctccaagcagtcttgcttgtagagcgggagaggttttgtcccagaatgtgaagaaatctggaaatgtggtcgaggacagggagaaggctaaggtggactccaagaggaaatcatgtatctgttaaatttgtacattaattcaacagagattgactgagcacctactgtgtgccatgtgctgtgcctggccttggggataaaggagtgaatgaggcagaatagaatcatagcatttagatcctagtgagggaagaagagaggaaatgaaggagggagaaagaggagtaaacatgtcaagtagtgatatgagctatgataaaaataaataaataaataaagggctgggcatggtggctcacacctgtaatttcagtgctttgggaagccaaagtgggaggatcacttgagcccaggagttcgagaccagcctgggcaacatagcaaaacgttgtcactacaaaaaaaaaaaaaattgctgggcatggtgatgtatactgtagtcctagctaccagggaggctgaagcaggaggatcacttgaacccaggagttcaaggctgtagtgagctatgatcatactattgcattccaacagaccctatttttttttttttttttgagacggactccaggctggagtgcaatggtgcaatcttggcccactgcaacctctgccttccgagttcaagcgattctcctgcctcagcctcctgagtagctgggattacaggcactcaccaccacgcccagttaatttttgtatttttagtagagatggagtttcaccatgttggtcaggctggtctcgaactgctgacctcatgatctgccagccttggcctcccaaagtgctgggattccaggcgtgagccaccatgcccagccaagaccctatctctaaaaaaaaaaaaaaaaaaaaaaaaaaaaagagtaggagatggagaagggcgggtgccgatttagacagtgtggtttgggaaggcctctctgaggagatgacatttgagcaaagatttataaagctttgtgaagatgtgtgggaagtctatcctgagtgagaagaacagcaagtgccaagaccctgagacaagaatttgcttggcacgtgggagggacagagggagcccagtgtgggaaatgagggaaggggaataagtgaggggagagggctgagaactgaggggctggatgtgcagagccctgagggccgtggggaagactttggtctgtactctggatgggttgggagctggaggagggttctaagccaagaagggctatgatgtgactgcagttctaaaaggagcatgccggctgattcctggagacaccttctatgtggcacttccctgggctgtgtataatctgatcattcatgtagtcgttcattcaccacgcactgagttcctgccacgtgccagggccctgtgctgggtgctgacgtcacagagagcagtactccttagagtcgagtgggaagagacagaagtgcctctaggcaccaccctggctgggcacaggttgattcctgctcatggatacattttattttattttcatttttatttatttatttactttttttgagatggagtctcactctctgtcacccaggctggagtgcagcggcgccatctcagctcactgcagcctttgcctcctgagttcaagtgattctcctgcctcagcctcccgagcagctgggattaccggcgcccaccaccacgcctggctaatttttgtatttttggtagagtcagggtttcaccacgttggaccaggctggtctcgaactcctgacctgaggtgatccgcccgccccggcctccaaaagtgctgggattacaggcgtgagccaccgcgcacagcctctatttttattttttatatttccagagtcagggtcttgctctgttgcccaggctggcgtgtagtggcacaatcatggctcactgcagccttgaactcctgggctcaagcaatcctcctgtctcaatctccttgagtagcaccaatgcgcaccaccacacctggctaattttaaaactttttgtaaagacaggggtcttgctatgttgcccaggctggtcttgaacttatgggctcaagcaatcctcctgcctcagcctcccaacgcattgggattacagatgtgaaccactgtgcccagtcatggatacatttgatgtggactgcatggtatttgaaacaattgagagagttttattaaaaaccaggacttctggctttatttatttttgctctggagattcagccaaacttcactcatactctcacagggcaacagtgggtgaggtcagtagcagtccccctggacatgcagactccaaggtactgcactctctgtcaggcttttgtttcagggggtggagtttgctgctatatgggaattgcctgatcttccaacttttcaagacacactgggcatcgagatttttatgtgaacccacctgagtttgaaacctcatgctggccacacagaaaatgcctgtgggttgactgtggcccatgtgccaccagcttgagaccctgcattagaggctctaaaaggcaaagacctacagctcccctactgaggctggaaggagggggtcagttgcgtggggtgaccttggacctcttgccaccccagctttcaccttcttcgatcccaatgacccggcgtgccaggagatcctgtttgaccctcagaccaccatccccgagctgtttgccattgtgcgccagtgggtgccccaagtccagcacaagatagacgtcatcggcaatgaggtgagaacactggggaaaccagggggagaggggatgcggttccccacatgtgtgggtgaccctccctgctcccctggtactcacagattctgcgccgaggctgccatgtgaacgatcgtgacgggctgaccgacatgacactgctccactatgcgtgcaaagctggggcccacggagtcggtgagggccccctacccccaagtcataagccccaaagcctaggcccccagacccaacacgctgaaaaccacccagaactcaggccccatctggaacccgaagcttcggatcccaaagtatagtccctgaagcccagggtcctccccgtgcactgggcccatgctctggaatgggggttccaagctgacccggcctatcgcgcaggggaccccgcggcagccgtgcgcctctcgcagcagctgctggcgctgggcgcagatgtgacgctgcgcagccgctggaccaacatgaacgcgcttcactacgcggcctattttgatgtgcccgacctcgtgcgtgtgctgctgaagggtgcgaggccgcgaggtgaggaggagagccctggctgggagggggcaaggacctgggtgagggacgcggagacccaggtgaggccaggctgcgaggggaaggaggacggtgatctgaggagatagcgggaggttggaggcgtgggagagggggctcagggactaccactctagggagggtcggggctgccaagggagaggggggctccgaggtgggggcggggctctgcgtcggaggctctgggacctgcaagttaagagatgagccccgaggtgggaggagggctggggtcccacaggcgctcacccggaacccctcctcttgcccacttccagtggtgaactccacgtgcagtgacttcaaccacggctcagccctgcacatcgctgcttccagcctgtgcctgggcgccgccaaatgtttgctggagcacggcgccaaccctgcgctgagggtactgccacccttgcccagaacccgttaccctcctgctcccttcctcccccacttccctccagcaggtctctgcgtttcccgtgactccccaaatactacaaatgccgtctgtacattcagcaaatgcaataacagctgaaatatgcctagtgttcattacatgtcaggtgaagtctattataagccttgttttacaatggggaaactgaggcagagattaagggatctgcccagggtcatccagcctatcccatggcagtgcataacagcatttcaaggtcatgaggaaagttgggctaggccttctgtgaatgagagggttggtcctctcctaagccctcaatatgatctttgacctctgacctatgcattaccaggctccatccacaatgctaattaccctgcagccgtccaggcacatgtatgttggggtaacatggcctgtgcccctgagaccctgcctctccccattttccactggcccagagtttgactcctgactctataccacaggagcccactctcactctctctaattttttttttttttttttgagacagagactggctctgtcatccaggctggagtgcagtggtgcaatctcggctcactgcaacctctgcctaccaggttcaaacgattctcctgcctcagcctcccgagtaggtagaattataggcatgcgccaccacacccggctaatttttgtatttttagtagagatggagtttcaccatgttggccaggctggtctcgagctcctgacctcaggtgatctgcccacctcggcctcacaaattgctaggattataagcataagccactgcacccagcccacaggagcccattctcaatgttcatctcccacatgtcctcattacaggcttggggtctccagagattgcctccctgagggcgtgacctacagcactgaagtgtggccctcatccctactgcctacacccccaggcccaccctcaattacttgacacacccccagccctgggtctcaggggtgggtttccctggggatgtggtctgcacctttctgccctgccccttctttttttttttttttgagacggagtctcgctctgtcacccaggctggagtgcagtagcatgatcttggctcactgcaacctctgcttcccggattcaagcgattctcctgcctcagcctcccgagtagctgggattacaggcacacgccaccacacccggctaatttttgtatttttagtacagacgaggtttcaccatgttggccaggctggtcttgaactcctgacctcaagcatctgcctgcctcggcctcacaacgtactgggattacaggcgtgagccaccttaccccgccttgccctgacccttcttattcccaggttggcccaggatatgacctagtcttacccctgcatcacccagactggtggtctctaggggcagggcctccatgggggtgtgacctgtgccactgagtccctgccttcttttcccattggcccccagaatcgaaaaggacaggtgccggcggaggtggtcccagatcctatggacatgtccctggacaaggcagaggcggcactggtggccaaggagctgcggacgcttctggaagaggcagtgccactatcttgcgccctccccaaggtcacgctacccaactatgacaacgtcccaggcaatctcatgcttagcgcactgggcttgcgcctgggagaccgcgtgctgctggatggccagaaggtcaggggctgggatgtgtgtttgcatggtgggtgggggtgggactcagccccttaatcccttggagctgcgtcctcgggcagagtgcagtccctgccctttgtctacttgccgccctaactatccacccagtacttgattttatctcagttgttccgtgggtgtctcctttgagcctcaccctgtgctgagctctccatccagggtgggaaacaacccgtcatctgacagtgacggccgagagtggtcatggctgccatggggaggggtgagcagagtgatctgcgcagctctgtgcacctgtggctccccccgggtcttgtggtcctcgatcaggcccctctgctctcagagacaagtctggctaggcaagtccaggccagagtgattggggtgtgatggggaatgtacccaaattgcagatgtggaggagcaagccagggaaagaaagggagaaaggagtctcagcttgggggagcgggtatcacagctgagagggcagagagaatcttcatttatccagggactccaatttcactcatttcccggtgtcccttgggctccatacgggacccagtctgtccttagggagggagggctgtgtctgcccccgccctgctgtcatggggctccacttgtaatgaaggggagacagtcaagaaagtaaacctatggttgagatgatttctgggctgggcacggtagttcacacctctaatcccggcattttgggaggccgaggtgggaggatcacttgaggtcaggagttgttagagaccagcctgggcaacatagtgagatcctgcctctattgaaaaaaaaaaaaaaaggtaatttctggtagcaacaagggctgtcaacaccattacatgtttggatttagtaaattgtccctggctgaatgctggagtggttttagctggggtgttctgagaaggcttctctgaggaggtgatgtccaaactgagataggaaagaacttcctttgcaaagataaggaagcagaggatgcagtaggtatggagacccagaggcaggaaggggcagtgttgacgaggggagttatgggaagggcggtgaggtggagaggtcagcaaggctgggtcacagcagacctgtaggctactggaaggagtttgaattttgtttttgtgtttttgagacagggtcttgctgtcacccaggccagagtgcagtggcacgatcttggctcacagcaacctccacctcccagattcaagctattctcatgtcttagcctcccacgtagctgggattacaagtgtgtgccaacaagcctgggtttatttttattattatgattattattattattattttgagatggagtcttgctctgtcgcctaggctggagtgcggtggcgcgatctcagctcactgcaagctctgcctcctgggttcatgccattctcctgcctcagcctcccgagtagctgggactacaggtgcccaccaccatgcctggctaattatttgtatttttagtagagagagggtgtcactgtgttagccaggatggtcttgatctcctgacctcgtgatccgcccgcctcagcctcccaaagtgctgggattacaggcgtgagccaccgcgcctggccttttatttttatttttagtagcaacgggtttcaccatattggccaggctggtctcaaactcctgccctcaagcgattcgcccgccttggctcccaaagtgctgggattacaggcataagccactgcgcccggccccatccagaaagcattctgctgtgcacgatctaatcatatccattgcacaattcagaaggaaggttgggttgactcttcccattttacaagccagactataagaggctccaacaggtgaaaacctttatctgaagacacggaatactaatcactgccccttagagaagcagcatagcacagcgtcatgaactcaggctcagggacttgcccaggtaaatctcagctttgcaacttcccacctgtggacctggagccagtgattctgcctctttgggtgtcaatgtcttcatccgtaaatggagataataatagtaaccaccttagggggctggttgaggtttaaattaattaaaatgcgtaaggccattagaacagagtccagcgcatactaaatgctctttgtgtgtgccaggcactgttctagtccctccaccaacactcttaagatcagcactaattgtcggggcgcggtgcctcacgcctgtaatcccagcactttgggaggcagaggtgggcggatcacgaggtcaggagatcgagaccatcctggctaacccggtgaaacctcgtctctacaaaaaaaatacaaaaaattagccaggcatggtggcaggtgcctgtagtcccagctactcaggaggctgaggcaggagaatggcatgaacccaggaggcggagcttgcagtgagccaagatcatgccactgcactccagcctgggccaaagtgtgagactccgtctccaaaaaaaaataaataaataaaaataaaaaaagatcagcactaattaattagcctattatatggaccaggaactgaggcatggagaggtgaatgagcctcccataatgataataaccacactcactaaagtctcactgcagctaagcaagtttacatgtgttaaaaatgtttccgccaaatgtggtggctcatgcctgtaatcccagcactttgggaggctgaggcagaaggatcgcttgagcccaggaattcgagaccagcctgggcaacatagtgagacctcatctctactaaaaatgaaaaaattaaccaggcatggtggcacacacctatagtcctagctacttgggaggctgaagtgagaggatcgcttgagcccaggagttcaagaccagcctgggcaatcaacatggtgagacctcatctctactaataatgaaaaaattaatcaggcatggtggcgcacacctgtagtcctagctacttgggaggctgaagtgagaggatcacttgtgcccaggagtttgaggctgcactgtgccagggtcgtgccactgcacccctggcatgggcaacaaagtgagaccctgtctaaaaaaaaaaaaagtttccgccagatgatcactccatgaggtggcttactatctctattttacagatgaaactgaggctcaataagtcccctgaccaaagttacagcatgataatagctaacaggctgagcacagtggcttcacacctgtaatcccagcactttgggaggccaagatggggaggatcgcttgaggccaggagtttgaaactaacctgggcaacatagggatactccatttctatttttaacaaaagtttgttgttgttgttgttgttttaattagccaggctttggtggcgttcacctgtagtcccagctactcgggagactgaggagggaagattgcttgaacccaggagttcaaggttacactgagctatgattgcaccactgcactccagcctgggccacagagtgagaccctgtctctaaaatagaaaaaaaatttcaataacgaatacttgctgatcctttacttaataccaagccctgttctgagggctttaatttctctataacagccctgtccaacagagctttctgtaatggtggaaatattctgtctgtgctgtccagtaaagtagctacaagctacatgtgacaattgagcacttgaaatatggctagtgtgactggggaaatgcatttttaatttagtttaaatgtattgatttgtatttttatttatttatattttttcttgagacagagtcttgctctgttgctcaggctggagtgcagtggtgctatctgggctcactgcaaccctcctgggttcaagcaattctcctgcctcagcctcccgagtagctgggattacaggcgtgcaccatcatgcctggttaatttttgtatttttagtagagatgggggtttcaccatgttggccaggctggtcttgaactcctgacctcaggtgatcctcccacctcggcctcccagagtgctaggattataggtgtgagccaccgcgcccggactaaatttatttatttttaaatttaaaaatcatctgagtcttctttctaaggtatgtatttatttatttttgagacagggtcttgcttgttgcccaggctggagtgcagtggcaccatcatagctcactgcacccttgaactcctgggctcaagcgatcctcccacctcagcctcccaagtaactgggacaacaggcttgagctactgcacctggttaccttttttctttcttttatagagaatagggtcttgctgtctttgttttttggaacagattaagattagagggtctcgccattttcacccaggctggtctgaaactcctggcctcaagtgatcctccagccttggcatcccaaagtgttgggattataggcatgagccaccacacccggccttagtttaaatttaaattgttggccaggcatggtggctcatgcctgtgatcccagcactttgggaggccgaggcgggtggatcacctgaggtcaggaattcgagaccagcctggccaacatggcgaagccccgtctctactaaaaatacaaaaattagccaggcgtggtggcatgcacctgtagtcccagctacttgggaggctgagatgggagaattgcttgaacccaggaagtggaatttgcagtgagccgagatcgtgccactgcactcgagcctggcaacagagtgagacgctgtctcgaaaaaaaaaaaaataaataaaataaataaataaataaatttacattgtcctatgtggctagtcactattcactatatgagacagggcaactctttaacaatcctataaggtgagtataatttctgttcccatttcacagcaaaggaagttgaggcacacagaggttaagtcatgtagccagcaaatggtgatgtgtgacctggggtttgggcccagggcggcctcatgcaacccaccttgctgcccgtgtgtgggcactccacgttggcctcccagcattccttccttagccatcgcctcccttctctccccagacgggcacactgcggttctgtgggaccacggagtttgccagcggccagtgggtgggcgtggagctggacgaacctgagggcaagaacgatggcagcgttgggggcgttcggtacttcatctgccctcccaagcagggttagtccgacctcgggcccaagaggggtgtggctgggtgtccactcggcagttctgatgctgctgactgggaaataggggatggaggatgggggccgagggcagaggcttggacaacaccaggctcggattctgtacccctaggtctctttgcctccgtgtccaagatctccaaggcagtggacgcacccccctcctctgtcacctccacaccccggaccccccggatggacttctcccgtgtcaccggcaaaggccgcagggaacacaaaggtcagagaggggatccctgtggtgggaagagccagtttggggatgttgtgtgggtagctcagcttctgtgactcagtttctcctcaggcccaaactccagttttggaagacaagctctgagttcctgacttctgtgactcagtttcccctttggctcagtactggcaccccctagttcttagaaggacctgtgggttccctgccctctgtgacttagtttcctctcagacccaaaggtctcccccagttttagggaagaatccttggagatcctgtcttttgtcatttgatctacttttttttttttttttttttgagtcaagagtctcgccttgttgcccaggctggagcgtggtggcacgatcttggctcaccgcaacctccgcctcccgggttcaagcaattctcgtgcctcagcctcccgagtagctgggattacaggtgcccaccaccacatctggctaatgtttgtatttttttctgtagagacagggttttgccatgttggccaggctggtctcaaactcctgacctcaagtgatctgcccgcctcggcctctcaaaatgttgggattacaggcctgcgccactgcacatggcctgatttactctcggacccaattttcccttcattttaaaaggacagtttctgggttcctgacttctgactcagcttttccttatccaacatatcctcagctttgagaaaggattttggggttcttcaggttctctgactcagtttcccttcaggcctaaagccccttcctaattctctggcatctgggattcagtttcacttcaaacgaagaacagggttttctaccttggggttttccaggtggcacgaggttcccaaagctggcctcagccccactacccacctcctacaccttctacccttaggcaagaagaagaccccatcatccccatctctgggcagcttgcagcagcgtgacggggccaaggctgaggttggagaccaggtccttgtcgcgggccagaagcaggggatcgtgcgcttctacgggaagacagactttgccccaggtgaggatggggactctgggccgggaggcaggcagggccttgagaaatcctgacaccctcgtgctgcaggttactggtatggcattgagctggaccagcccacaggcaagcatgatggctctgtcttcggtgtccggtacttcacttgccccccgaggcatggggtcttcgcaccagcatcccgtattcagaggtgagcccaaacttccagcccaaacccagggcaccacctggagccctgatcccccctcagatggcctcctcctcccagaccagcaggacagtgtggacacccccgagcccccagccctttcctcatagatccctggggcccagctctcagtcagaccctggccttttgtggctctgacttctccccctccccgtgtctcctcaggattggcggatccactgattcccccggggacagcgttggagccaaaaaagtgcatcaagtgacaagtgagttaggggatgatatgttgggaggagtgtacgtttggggatgggaggaagggtcatgggttctcaggtatatactggtgacagtctctggtatttaattggggacacagggtccaggaaaatgatgagacaaggtccacaaaaagataggtgctagaggatatgaggaaattagcaacaaggctcttcggggacatgaggttgagcagatactggggacagggatagtcactgggggacatggtgggaattatggacaagaggcccagatgggtattgggaatgtaggatccaggtggggactggagacatggggaggtattaatgagaaggggtctggatgggtattgaggacacaggtggtctgtcatcccctcacttgacatcctgccctcctcttcagtgacgcagcccaaacgcaccttcaccacagtccggaccccaaaggacattgcatcagagaactccatttccaggtgtgtggccaacccctgtcccctctcctatgtgacattcagggagagggatccataaggcagttggacccagaggtctggagctctggtcagggctggaaagagaggttaggaaaacttgtgacttgtaagcatacccagaaacagtctttagggtgtagggccccgcactgaattctagtgaattccactttcgggtgggccggtaaaggaagcagaacacccttcactccatacgagcctcagaacaacagctagagaccgggcggggtggctcatgcctttaatcccagcactttgggaggccaaggcaggcggatcacctgaggtcaggagttcaagaccagcctggccaacatggtgaaaccccgtctctaccaaaaacacaaaagttagccggacacaatggcatacacctgtagtcccagctactcgggaggctgagacaggagaattgcttgaacctgggaggcagaggttgcagtgagccgagatcgtgccatggcactccagcctgggtgacagagtgagactccatctcagaaaacaaacaaacaaacaaaccacagccagagaggtagaggcagaatccagaaaggcctgatagcaaacactgggggaaaggctgggggtgatgggtgcagatgtccccgctgcctgcctaagggcgtgaccctgtcatcctcctttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttagccagccctcgatcattgaggccccattattaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatcacccaaccctggatcagaaacctccccattaacaaacactgccccttaagtcctcttgaaataaacataggtcacacccccaaagcaaaagagtaacagacattcatgtcattgttccccatttaacatcagtcctctcaagatgtcgtgaccccatggtcaccctgaagcccttagattccaacccctcaatcagagacttccttcattaacaaagacccttgttcttatccctcaagaagaaacccaccataaccagcccactgtcacccctaatttacagacaccaaaacagtcctggaagtgctaattacaggaccccccaagtcttcctaccctctgcaccctcaagaaacccccagtgccttgtatgaagcccaccccacatggcccacagctcctgtgctggccagactcccagaaaattctctattttttaagtaacgacttccccctttgggggaccccaaaatttggaggccccattctaggactctggggatcccaaaccctagagtacacacgtcccaaactcccctgtgccctcaagtcctacagcccctagaagaccccaatgccgtaactcctaggacccccaaatcatggaatcccaaatccccagggaatcccaaatttgaaaatccaatcccaagtccccaggaaacccaatcatgaggtccttgtgcctggtatggaggagactgcagtcaggatatgcattccaggctcccagacacctcaagccctattcacaggcaccaggaaaccccacacaggaattcccatccctggaaactggagaatttcaatgccccgagtccatgggtttcaagacaccaaattccaagagccccagccctaagggaaccccaaatcctaaagcctccatctctaataaatggaaggccccaaggccctgaggggatctcaaatcctggaaccccgatttcaatctacgttctagtcactggcctcaaaggaccccacagcacctgggccagaccaacagctcgagggagaacctgaaggcccagggggtccagggcggacctggggccccgaccaccaaggacagctcacgactgccccttcactgcatgtccccaaactcagcatgactcctgtcctcttcaataaagacgtttctatggcc

SEQ ID NO: 8400 - DNA, 5095 bp, Homo sapiens
gttgaatttggaaattggaggggacgctggtggacggtcagttttggggagtgctgggggtagagatggatgtcaatagggctgaaagtggggatccgggggagcccagagtaggagtccgaggaggctcagagcttggagtcctaaaaggctcggagtcggggatctgaatggttcagggagggaagaagatttgggagtcagcctcagagctaaagatctcagggtgctggagtgaaggggcgctcaggaggggaaatccgaggggcgtccaaatggggggatccgaggaggctgagggtggacatgtctgaggaggctcagattggggtcacaggagtgcacagaatgggattcggtggggggcgggggtcgctgagtgttgatagccgggctcacagttgcaggtctgaagcggggtctcaaggtgtttaaaggggctctggagtgcagccctgggggctatgtgtagagcttttgagaaaggctccctgtgtgtggggccagagaatgttctctgtgggaggattgagaaggcatatgtgtagttggatgggcccttagtggacagagtaatgggggattattcttggggctcattgtgtccgggcatggaacgtaggggctctctgtgtggcttgtaagatgctgaagactcagattttagagaccaagtgcgtttcagaagagggctgaggtgaggcctggcctgtgatggggtggaatgctgcatcatggtgttagggcgggaggcctagtgacttcagtatgtcctcccctccctacaggattgggtgcaaggagttggtgttgatggaggagcaggacgccagagtcccagccctggaaccgttcagagtggagcaggttgtcagaactcagggtgcagagggtgaaggaggcaggctgattcctgagttcttgggttgggactgcccccttccaccaaattcattcttactgtcagagtccattctggaatggcactggtcccttgactttagaccctgacctgtctgaggacatcctgagcctgtctccaggcataggggttgctctgtgatgatatgtcctctgtgtgggttgaagggccacaccttcagggggtctttctatcctaggcaccacctgtaatctactatgtccctgacttcatctccaaagaagaggaggagtatttgcttcgacaggtgacctcagtgccctactggtctgttttcccactcttcccatattcctccccaatgtccatcctctgtatgagagcccccaaggctgcagtgaagaccccgacagaaggaacaaggaagttacagagctcatactccctctactgagatagcccaatcctgctagcttagagaatagggggttataaacataggctgagatagcccagttcagatcattgagactggggagtaaagaattttgtattcagatttctgtgctgagatagcccagtaaactctttcctgtgctaaaatagcccagcatagacccagagcacaataaggttaccaaatacagaccatctacgctgagatggcccagtctgcattctgttcttaaggtttggggaaagaagaattttcaaagctcagagttcctgccctttgcagccccagtgcctaagttacagagcacagatcttccctgtgttggagtaacccactgatcttgagtccaggaaaaaattagctacagaacacagacttttttgctgagatagcccattccagacctttgcgttcttggcattgaaaaatctacatattatagaattcctgggctgaaatagcccagtacagctccataaccatgaagggaatgagtagattatcaactagagctagacttgttggactgagatagcccattctagatcattaggatcttggcagtggaagattttcaaagtactttctttgctgtgctgagatagcccagctttgcatactccctcccccaggcaataggaacaagtcggttgcagaactcaaactgtcctcagagagcccaggaatcaggaatttttgtttgtttgttttttgagacaatcttgctctgtcgcccaggctggactgcagtggcgtgatctcggttcactgtagcctccgcctcctgggttcaactgattcttgtgtttcagtctcctgagtagcttggattgcaggcgtgtgacaccacaccgcctcccaggttcaagcgattctcctgtctcatcctcccaagtagctgggattacaggtgcatgccaccatgcccagctaagttttgtatttttagtagagacggggtttccccatgttggccaggctggtctcgagctcctgacctcaagtgatctgcccgcctcggcctcccaaagtgctgggattacaggcatgagcaaccaggtttggcacggaatcaggaaattagaatgcagactatttgctgggctgaaagagccctgtccagccccagaactctgagtagattgtgagacccacaactctcagaccacggttgtgcagccctgattcctaaatcctggtagacacaggtgggctttggggccaaaggcgttcccaggaaaaaaggcaaaccacaaaatcctaggaacccaccgccccagggaatggtcccacagacacagatgacccatttccatcccggaggtaaaggcccctatgttggtctaggtgggaggatcatagaggggtgatcctgagaaaggagtgacccccttcccacctcttaggtttttaatgccccaaagccaaagtggacccagctctctgggagaaagttacagaactggggtaagtatccctggctgggggcaggagtgattctgggatgtaggctggggcaggggactcaggtccaatagacttaagacatcagagggtccctgacagctcaaggggccccaagagccaggaggattctgaaggggtcagtggaggtcctgagggattagggatttcctgatgagttgggagtatctgaaagggacctgtggtctggagaagtgaggaaacctctgaaggacccagtggctatctccaaacggtcaggggtccctgagaggatcagggtgcttccagccactgtggaatccctaatgggggatctattgctataggggggccctcaggaccccattgccttccccaggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatggtaaccacacaccctcggcccgtgtccccccactcagacttctgagctgtgctggggcaggggactctgtacccaccctcactcattaggcagccacatctcccaaacaggcattcacctccctgtccctggcttgggaagcccccctttgacccagagggtgggggttgtggactcctgccctgcccagccctggtgcccactccctagccccacgaggacggaccactgtactacccgactgtcagcaccatcagcctgggctcccacaccgtgctggacttctacgagccgcggcggccagaggacgatgaccctacagaacaggtgggcccccagacactgccccagctgcttgtaggcacttcaacctcgcacatcctccaagatgacctggtcccacatgccttcggggtactcctggcactctcccagataccttcccttgtcccctcatggggtgtacccacttcctcccagacacccaacccatctgcttacagggtgtctgtcccacatgccatgattttcacaggctccccgatgccccaacctgctgaatggatacccctgactccccagcagacactgatatccttagataccccaccgccattaactcggggggcctcacctcctcccagatgctctatctgcccctgctcagggtgccccagacgtcctgctactccaggaatgtgatttggggtgcaggacacccccagattctccttgaccccttgacacaatttctctgagtgatgcatttctagcaccccagtgttcacagaaacgcccctgaacacgccgacccactccttgaggcttgccctcgagccctgcatgctcctggatgctctgacactccctcagctgtgcggttgtcctctaatgtcctgatgtccttgggaacccccactgcctctaacctctgcctcactctctcctcacctggtcctggcttcagccatgctctctcagcccagctctgcctgtatttcctggggactgcctattcctgggtcccagccccagcctcagcccctttgagatcccagctgcagctcccaccggccgctgaccctttgacgcccccatctgccacctagatcctgccccctcccgagggacggcagagccctcgccctccctttccagcagccccagcccaggccccagcaattttcactcctgaaccaccaaagcctccatcattgtgagcacacttgctcttcagcttttgcccctggggactagctgatccccggaggctaccgacctctcgcccacccccaccccccgacttcttgagccctgctgaccctcaacccgccctgcagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatctttccttg

SEQ ID NO: 8401 - DNA, 465 bp, Homo sapiens
gtgaggtgcagcaggcagacccctctgagggaaagagggctccaaagtgacaggtgttcatgggtccctgtggctgcatgttggaggaggacggggacagcaggtaagaggctgctgccgtagtgctggtggcagaagaagaaggatggaccaagatgagggcccagggtagcggtggggagagtgagatcctggaaatcttttggagatggagctactggacctgtgcattagaaggatgaggtgttcaaggctgtcacccagccccatccaggctgggatgatttgaggcagagcaggctacagctccaggtgggaagccaagccatgacaatggagccaggaccctgggctggcttcaggaggcctccgtggggaagatacaggttctgagagagttggaggggtcaatcggcagatctgtttcccagacactgctacaggcatgtagcatggtgattaaga

SEQ ID NO: 8402 - DNA, 2631 bp, Homo sapiens
ctggaaaggattcttgtagtgtctgccatggaacacagacagacctatgggaacacaggggaacctcttttagaaaacttgacaagcgagtaagacttggatcttttccgaagagcacaagcccgggcttcagaggatttggagaagttaaggctgcaaggccaaatcacagagggaagcaacatgattaaaacaattgcttttggtcgctatgaccttgatacctggtaccattctccatatcctgaagaatatgcacggctgggacgtctctatatgtgtgaattctgtttaaaatatatgaagagccaaatgatactccgccagcacatggccaaatgtgtgtggaaacacccacttggtgatgagatatatcgcaaaggttcagtctctgtgtttgaagtggatggcaagaaaaacaagatctactgccaaaacctgtgcctgctggccaaactttttctggaccacaagacattatattatgatgtggagcccttcctgttctatgttatgacagaggcggacaacactggctgtcacctgattggatatttttccaaggaaaagaattcattcctcaactacaacgtatcctgtatccttactatgcctcagtacatgagacagggctatggcaagatgcttattgatttcagttatttgctttccaaagttgaagaaaaagttggctccccagaatgtccactctcagatctggggcttataagctgttgcagttactggaaagaagtacttctccgctaactgcgtaatttccaaggcaaagagatttctatcaaagaaatcagtcaggagacggctgtgaatcctgtggacattgtcagcactctgcaagcccttcaggtgctcaagtactggaagggaaaacacctagttttaaagagacaggacctgattgatgagtagatagccaaagaggccaaaaggtccaactccaataaaaccatggatcccagctgcttaaaatggacccctcccaagggcccttaaagcgacctgtcattccgagccagcgaaccccagcagtaggaatccgtaccttagggatctgtcggtcatttctgttgctcttgtgattggcaagtacagtatcctttgggaaggccatccccctcaggactgtcctggctccgatctttgtgtacactgcagacactggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcaccccatgaggttgtattgtgtcttctaagcgtggtactagtgcttgccacctggtcaccagacctccaaatatggctgccaccaccaggacctttccagttactccttatatgtgtgttctatggaggggcagggaagaggtggcacttgtgattgtgtgtagattggcagggggtccattcactttgggttccatcttgctttaaatttctttccttcattttgattaagagacctctttttgatctgtattgggctaaccagagccaaatacttttgaagagtttcccagggactagtcatggtaatagcatataattgatctgaatgagatggagagaagaatgaagaggtggtggttctgggtttgatttgagttcacctgtgggcagtgggcagtgtcttggtgaaagggagcggatactactttttgcctcactgtaaagtacccactagtaaatatttcattctctctttactcccactttttacgtttgcagatgccaaaataatgtccacttctccctttcatgctgcatgttaactggttaattatactgcagaaaacttttcacctccactagtctgatacagtacatctgtacttccatataccttgcactgattttgtctgaatgccctgggagaagttgaaaatgactgaaagtgacttccgtatctcagcccatgactcagcaaggcagaatggccacccctgccaaggtttgcttctcttttcgacagtgcctcaccctccctctaggattaaagtgcttctgcttttccatgaactcctcctccatttcctttttgggatttgtcaccatccttctattctctggtcttctatttttggtgttgttcaagtgaaggaagagatgttccctctaatttctctctagcccattataacctgctatcttcgggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgagggagctaattttaagcatgttcagtggcagctcccctccagtttcagtgtcactgttaaaatttatccaaaagcaacttcactaggggttttcttaaggggtaaaggccttttacagaagctaaacccttccccacatgtggtagaatgtgctcttctgtatctactcctcaataaagcatgttctctgctaaaaaaaaaaaaaaaaaaaaaaaaaaaaac

SEQ ID NO: 8403 - DNA, 2631 bp, Homo sapiens; identical to SEQ ID NO: 8402

SEQ ID NO: 8404 - DNA, 5441 bp, Homo sapiens
gaagtgtcaaaggccagggacatccctgttgtcatcgacgcggtgagttgacttctctcctcctggctcggactcccggaaggcctgtgcagtgagcacggctccttgttctgtgcaggatggcctgtggctggtcgctcagcagccggccctcatccatggctaccggaaggctgtgctcactcccaaccacgtggagttcagcagactgtatgacgctgtggtgagtcagtggaccccctggagggtagatgcaagccctgttcgtcctgaagagggtgaaggacgagctccatgcttctgcccagcctgtccctgtggacacacctgcaagtaatcgctgtgcctctcccagcggatggcgcgtcttcccattaatgcgcttggattggatgaacgatggtgtagtgggcttgggacaggcagggactcgggtcagtcagcccctcctgcagtgcactctggacaggtcactttgtctgtgtcctgagtgcctcatctgtaatgtgatgatggcatcagcttcacggggttgtgaggatgagatgaggaaacctatgtaaagccgtgagtccccacatggtaagtgtcccatcaatgttagtgcccagtacgactggaatttgtattactcctgcaaagctctcagaacccagtcttgggtggtcctccttcagcctgctctgatgaggtagaggatgggcactggagcaggcaccgtgtcagcacctgctcggaggactcactgcaggtgatatcctgggcatcctcccacctacatggcctttaacaggtgcctgggtgatccctttagacacgagagcatgagtctcatggcggatgggacagggctatctgtcgtcgtgtgtctgaggaagactttgctttttctctgtcttcctgtgttgtcatagctcagaggccctatggacagcgatgacagccatggatctgtgctaagactcagccaagccctgggcaacgtgacggtggtccagaaaggagagcgcgacatcctctccaacggccagcagggtgagtggcggctgccctctgtgcatgggccagtgccaggtcagtcagcatggccacaccgagcatgagccctggaagacctctcccgtgcacacccgtgttcacacacattcacacagggattcctgatgagctcgtcaaccacactttcttcagagtccatgttttgacttttcactgttttgccaggggaggtgacagtggtgagggcaggctttcgagccgtgggccttacccgttggttgaattcccttgcctcagttatgagaagcagtctggcgggagggtgcctgcaacagcagggcacagtgcagggtcccgcgtctccagctgccaccttcatctcacctgtggcatccaccatccatgcagttatttgggtattttattgcatttcattctcttttatcaaaatgactggaaagtgcagaaagccccgaagctgatgctggtagtggaatctcaggcactgagtgtggcgagtctcaactggccactcccacggagcctggggaggcttcagcaagagccaagtgagagcagggcagaggccgggcccagcgccagcgaggcatctggggagccgtgcccttgttagcgctgaaaatggaagcccctccattcaggcctggacagatgatgggcagcgaatgtgctcacctgctgagctgtggggctggactaggtaccaaaatcagggtagaacactgaggcgtctgtgggcgggtgtgtgcacatccacacttgtacactcacattcacatgcacatatgtgcacacgcatgcaattcatacacatgcacagttgtgctcacagcctcgcacgcccttgcacactcgcacttatacacatgcatggtcatgctcacagcctcgcacacgccctcgcacactcatccacacacagctgtgcacaaggaacacagagcagatgttctcagagggactctgacacctttgagatgagggttttttaatcactggaaggctctcttgggtctaacaggttcagagaatgtaacacctggttttcaaaacatttttcaaagaaatagagaattcccatacacaggcatacgtgacgttatgaggccggtggaggcctcgctcggtgttgccctgtatggttgagctgtggtttaaggtgaactctggagtgtgggctgcaggtgagggctccgtccctgggagctggtgggaggagctggaggctggcgccgccctgctcagagctgcctgcttgggctcgtctgaggcggttccgagctgcaggtgtctccaccaacctgctgtgctacacagcggggtctggggcagcctcaccactgcgtgtcttggtttcctcttctgtaaaacagaggctgcctccaacccttggaacaaacagggaagagccgtagcaggcaggatgtgagtggagcctcaggctgctcctggagggtgtggctctgcctgctgtgcggccttccacacccgtggctactgtcacattcacacacatggccatgctgacacctgctctcacttctgccctgtgcagtgcttgtgtgcagccaggaaggcagcagccgcaggtgtggagggcaaggggacctcctgtcgggctccctgggcgtcctggtacactgggcgctccttgctggaccacagaaaacaaatgggtaaggccacgtcttcatttattctactttgaaaccgtctgatttttctaagctgtttcagtagctcatgcgttgaataagtagccctggaaacactgacaatgaactctaggcttcactggagagatctcggcacagacgaaccctcttggcagaagcttccaccccacacttgggcctgggcctgtccatcattcactgtggatggggcctggggcaggggtggtcttcagagctctccagagagttccgaggtgcaaccaaggcccagcagcacgctgttctgggaagttgagtggtttattctgtgtaacacagaatactaagatagaaaacagacagggtcaaggcttacttagacacttgttcttaaagatgtgaattttctttaagagacagcagaattctaggaccagggcccttggcccagttctgtagtcagagaactttatgaatgcaagcagttcccatacctctaagcatctccatttctcttctgtgagcccatcaaggtggtggctgcaggtgctaggtgtggcagacccgggcttctggagggtgggcagggctgtcatccagtggcctcatgtgtcctcattgccgggatggcagagtctgggaccatcccccaaactaggtgtgtccacatgaatttgagagccgaggaggtaggggtgtgggcaggagtcttactgttcattctgctgtgttcactcgagttgcctccacccctcccccaggagatggagccctggtagcaggaatccacattctcagacctcagatgccctctgcacctgggcactgagagcacagtcaaacagggctaagcagcttgtgccgcctggctttccccgggaacacctggcccactgtgtgccctagccctggacctgtctccgagtacatagacgtttcctgtgtgcctcctgccagggagtagtggagggttaatggtggttttcgctgtgataaacctgctttctcctcaggggcatatcagacttgaaattgacaatttggggtcctgagattgaaacaggagtcaaaaccagagcccagggtagctgcggcccccggaccacgacgcccacttccccacacctcctgctgtccccctctccgcaggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccacgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagaatttctcggcctgctcccagatcggcgaagtttctacttgttactctctctgccgacgcccttcattccccccgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcgtctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaa

SEQ ID NO: 8405 - DNA, 10166 bp, Homo sapiens
gacactgttggttgccttactttaatgctgacctagcagccccgacaggaagctttaacataaagccttgaccctgagaagcatgggtgcgtcttgtcgtgagcaggttcatggctgtgctccatcctcagcccgctgatttttggtcttttgtcctttgatccagcagttcccacgtggatgttgtactgcttctgtcctggagaagaagagtgaggtccaactctgagcagacaccacgtcatgtggcacagggggctgacaggcgtaatcaggttcagggtgcctgttccctcaccggcctgtcctaaaaagcttgccaggcgcttagaaagggccccactacctccagcagaaggccaggagcttcaaggcacctgcaggaggtggcgggggctgagcaggacccacgtccccgtgctcagcgtcccctgcagccaacttggcccctccctcacggccctcccacctcattttttatgggggtgggtttctctactcagaagcatgggcagggcgcagtggctcacgcctgtaatcctggcactttgggaggctgaggtgggaggatcacctgaggtcgggagtttgagaccagcctgacccacgtggagaaaacctgtctctactaaaaataaaaaatcagccgagcatgggagtgcatgcctgtaatcctagctactcaggaggctgaggcaggagaatcgcttgaacctgggaggcagaggcagaggttgtggtgagccgagatcacgccattgcactccagcctgggtgacaagagtgaaactccgtctcaaaaaaaaagcatggtcacgggggatgtctgggcctctgatggccccacgtcctgttgacctacccggctcctggggtgatgtccctgaccttggtgcggcactcaccttgatgttgatgccgtgggcagtcaggccccggcgcagggtgtcgcatgcttccagcaggggctgcctttctaggagctgctgccgccgggcgtcccccgtggcctcgggcatggccagcgcaaactgccggaccttctgccggaaccgcaccagctcgtccaccacaccatgcaaggtagcctcgctgccgtctcctgaaacgtactgaagccagcagggcgcggttacgtcccccggagactgtggattgtggatgcccccctccccaccccgtggttgggctctgggccgacacccacccagccctgggcttccctgattccctgcagctgggcctctttctgggtctggcagggatgggtacagcccgcgagcgctgggctctgggcaaggctccactcaactctgagcatctgtcgtccaagcaaggctgagtgatcctcactcgggagttggaagaaagggctgggggctgcatgccgccccgccctgaacacaaacgctccctggcttccagacctcacgcaattgtggccgaggtatcaggagcaacctgaggatgaggctggggggcagcgactgagcgcttgcacacgtgtgtttcggcaaatggtctgagattcacagcctcaggtgctgaggacgggatttgcgcagaaggcctcgcgctgtcctcccactgagaacagatcctggggcggtgtggaaggggcagctgtacctatttgttaaatccatgtgtgtaaaataagaaacagacacaacatttgaccttggtgtcaaactacttaaacctcacacacccctcagttattgcttccatgataaaagacagtttttgttattacagaaatatgagcccagagtgggcccagacattgggccttgcggccagaggaaggtgaatgagatatctttgacaagggctaggcagagcttggccagatcccacttttcttactcaaaacagactccggaaagccacccctaaaaatgaacatgtacattgcaaaaacttgggtcatctcacaccagtcgacttttatgtgattggcaacagacgccggactgctggaaaggggaactaagtctaccaggtgatcaacaggtatacaaatgagccaaacttggaaaagacactatagttctctgttgagagccagcgagacatgtttggcccagagccaggccttcagcacacctgcttgggccccagtcccaagcggcgggaccctcggggtgctgggcagctggtctagagtggcagcccccgtccaggcagcagcagccgagccacaccccaaaagagccagagcgccttgtgctgagaattctacaagggtgtccaaagaatgacagggatgttcagggacacagcgccagccccaaggggcctctgtcagccacatacaaagtgatggtggggactttaagaataaggcaggaaacctcaaatctgtattgatagaataaacgagtttcaggtgagcctgataaggaagaggacattttcataggatccaagtctctttgcaaaaatgctcttgagttacaacggaagagaaggaatgtggagaagcctggcagcgtccaccttcactgcacagccagggtgagcctcgctgggaaggtgcaggtgactcgtgcctgtcggggagcccgtcctgtccgtacaaaacatgtgccaggcaagggggctcaggtcgccaacttgccctcaaatgggtcaggaaaaaatgttctcttactgtgcctgtgacttctgcacattctgagagtctttgaacataaacgtgtgtgcagagctggcgacattctgttgctgagatggactcatctctggttctgcgcacgagagtttgccaactgcagaagtagaattgtgcaattccaattaataagtattggctctgagtgtgtttatttttccaggaaagtaacatgtttttaaacaggtaaatacattagtgtggcatcataatgctctattccaagttaaaagggtaaaggttattgtcccaacatggagaaaattccagaattaagcatttaaaataataggacctacctgttgatttgccagagaaattccaacagtttcaaaaaactgttcaaagtaagagatgatggcaccaaacacagcaggacttctcggcccttcaggttcctgtaagagatcatgtcgcagaagctccttaaaagcagtcttgatggcagtgggcaaacggaattcaatgtcaaaagacaaaggcttcagcaggtcacttcagtctggcctttctcctggcttctatggagggaggacacagctctggcatcggctacctcactgcagaccatacaactataggtgcatgaggaatctcttgtgcctcagtttacccatcagtcatgtgggtggtgactagctcatcaggcttcgcgggtgaagcatgaccgtggagtatggcaggtggcgcatggtaggtggaggctgagtgggcactgggctgggtttctcagaaaacggggaaatcctggtacgtggctcacatcagttaccaagcacagagacccttgggtgacactagccttagtttgcaggtgccccagaattgcaaagcttgggaaggaaaagcgcaggacaaaagccagcctctttacttgtcccgccccttgccacaagaggcccctgttgccctagagctgggccagcctggtagtgccggcagcagctgcggtgaaggcaggaggccgcggacgggctgaggaggaggagctcccgtgcaggagcagcctggctgctggacctgccccagcccggcctggctgccttcagtgcggggcagcctgttcctgcagccggctgtgactcaaatgcccgcccccctcagaggcgagccctgcgcgtctgcagtatttggaccgaaggcacccggcaagggcacatggcaccctgccccacctgctggtgctctgaaacccaacactgcacgcagccagggatggagacctccacagagatgctcaactaacagagcatgtggccagaacccccaggtgtttccagaggtgggagaggcacaaacagcctcggcttcccgggtcatcaaaggtcacggggctcctgacgcagcgcctcccagggcctggcaggggaccctcagacgtgcaggaaccaaagcctgccgccgccttcacggtctttgtcccacctgccaaacacttgcagtgacccacgagtccaggctcagacccctgggtgcttggtgtggtcatcacactggggtgcagattgcataacagtgccttggggtaaatgggtctttccttaaaaagttccccacaaaagctctctctgtgaaagggccatgaatgcagtggggacatgagatgtgtcccctgaggatcaagcacacagaatttctcagcctcaggggctcctgagagcttgttccccaggtggccctgaggcccgggagggtcaagccccaggctgggtgccatcccgtgtgtcagcggcagactcgggctccatgagttcctccacagaagctgcgggaggcgaaatcagcagagatgccacccagccgacatgagaaaaacccaccagaggacccgacccatgcccctggcagcaggaccgcaaggccacctgttcgttgagctaccttcagggacgccctgagctgtccattcccgtggtgtgcaaggcccaggatggcatcaaccaccctgggtgtgtcaaagtcatctgccaaggccgccttcacggccctcttggtgctggagagcctgagggaagaggagagaacagtcacagcagagggagctccactctccccaggcggcccccacaccagtccttccccagggagagacgctgggggctctaatctggggactttctctaggtcatattcccaaagacttgagttcctgagtagcagaaaattatgtaacatcaactgcaaactgtcatgttaccccaagaaaaagtcccagagcagaggtcacctgtgacacttaaaatacaagacacacgtgggcattttcatgatggttttaaaaatcaatagatattgaggggagtggcaaggaagactcggtgggggagagacggcacggctgaccactcacaaagagaggctggggaggcccagcccggggctcccggatctcagcctcccgtggccactggctgcctaccctgctgaagtggcaggggtgggttatcaccaagaccatccggaagactctgcacgccgggatgaatgtgcagcgctgcccaggacacccgtgggtggggagtggaggcgatgctgtgggcccaggcctgtgtgttttatagattttggctcctcacagtcaggactgggagggatgagcagctccgctcctcgcacagggaacccgagcccaaagccactctgagcagggggctcagagcctgagggccccaggcacacttcctgccagcgccgtctccctgggatgtctcgggagcccctgaccccacacctcctgtccagcacccagtgtcctgtggcctctggggagcccctgaccccacacctcctgtccagctcccagtcccctgtggcctctggggagcccctgaccccacacctgcacctcctgcccagcaccctgtctcctggggcctctctgggcagtccctgaccccaaacctcctgtccagcgccctgtctcctgggggcccctcttccccttcaagagcccaccagcagcacccagcaggccacaggaggggtgccacgccgggtgctaggcgggcctcttacctctcccacagcatcgcttccctgacggagccgcaggccagctgccccttcatgtaggcacgtgcgtcctccaggaaagagcccagccccaggagcagctgctgagcttggagcatggcgctgtcactgtagtcgatggctgaggaggaagagatggtcactgaggcggtgcccaccatgctgtgcccctgccctggtccagcagaatcagtgttttctgagggcactgccacccagggaccacacggagagcgggacatgtggctctcacgccctccagtgaccgcgagtccctaggcccactggacacagaccacagggtctgtcccagctcagtggcacctgccgtgggagaacaaggtggcagtggagacatgctcccagtgcttccagccaagaggtgcatttccactgacggatggatggaggtgcggatgaatggctggctctggaaagaaggagccccgccctggatggatggaggtgcggatgaatggctagctctggaaagagggagccccgccctggggtcagaggcacctctagggaaggcccccccgagggaaagtgcctgtgtgtgatgggacagcccaaagggggagggaggagcagtccccagacctggctttagagtctgtgggtgtttcttaggccatctggatgaggagcccaaagtggaagggaggagcagtccccagacctggctttagagtctgtgggtgtttcttaggccacctggatgaggggccagtgtttctgtttacatctgttcatttcttgtggtttctagtctactgcattctgatgggtaagacaacaggagtgaatcgctttgcaatgatcacatatccttggatatcagcaaagccagccacatatttctagaaccttctcgtgcctactctgtttcccaggctgtctgagtccacagtccatgcttttgaggagtgctgctttaaacagctctttgaaaaccacaagaataaaaagagcctatctggacacatatgctcaaaattacatctcaacatgcctccaagtcctgacttcaaaacgagaattccaaaatcagacatggcttcaagctggaagcaacacagtgaaaacctcccccagggctgtctaatatcttacttaacatttttcctttttttctaaattcactttcagtttttgctttgaatagcttgatagaaaagagaaaaagccagaaacccacaaagcgatctgacaaaatttaaagataatattcggggactgatagagttgatgcatgggaggctgttagaataagattaccattaatgacacagcaagatgaggcatccagatggggaggggcagacagatgcccaggatggagacgccttctgcctcaaggtcaaggacagctgcatttctccaaagaggattctgctctacagatgggagacgcttctccaaagtgtcagcgcagcacagactgcaagggatgccaccaccgtccccctccatcttcccaaaggtgaagaaacaatgtctgggaagatcctgaactcccacaccattcgtggatggaagctcagacagcaagcgacggcccagctcctcatggccacctccgacctcggcggggtggggcagtcgtgtccactgtggggatccacgtcctgactaaccttgtgttcctagaaatccctcaccggcagatcggtgcctcctgaatcccacccaaaattcccactgggaatgtgttcctgaaagagctgcccaggcttgagaaagcctcttttcagaccaaacttcgtattcaaagctcaaaaagaactgcacacaattaggacagtcatacaagatgctgcccctaatcctgccacaatctgcgagaagggaggcggggcttccgagggcaaagtgcccctgggaagggatctgcagggaacagctttgaaaggaccacagcccccagccacgaggggagcaagcacgagccggggagagagctctgcgctcgcacacgggattcatctccgccgcctctgcccgtttccagcaacacggagccaggcggaaacagtttctccagcccattcgcctccccgactcttcctctcacggcacggctgggctgctttcatcacgcgtaagtgcacaccacacacagatgctgcacgaggccaggcgagcacgaggctggcgacacttctttctcaagctcgtgcgcccgtgagcgcaggtcccctgggccgatgcactgcagttccaccgaggggagaggttcagaccacgtctcagaaaacctgagtttgcagtagaaagccaacgacgtggcgtcagagccaggataaagacatggcccaaggtagcctttcggtggtcaaaggtgcaggtgtctgtgtgcccctctcacgctgacagagctgcaggccgggtgaaattctgcaggcacagcacaggggagggagatggatggggaccagcccaggggctcacccaaacccaccaaagctttgtgtgtgacataaagtgtgctggccagatagattcaccccatgggggaatgagaataaactatgtttcggctgcatgtccccactcccatcgtcttcattaaaaaggtgaaatcatcaatttggagcaagagagctaagtaggagggacaagaagggggagagggaggtggcatgacaacagcagcgacccagggcctcggcagtgtcaatggagcagaggggacaccagaggccagaaggacagcaaccctcgctcaccaggaaggaactgtcaccatctccagaggacactggccctgctcctgcagcactagccatacactgggaccttattgccagttaggtggtcaagccaggcagggcagtatcactgtccccagccctcacttgccaccagggatgcagctctggataacgactttttttttttttttttttttttttttttttttttttgagacagggtcttgctctgttacccaggctggagtgcagtggtgcgatctcggctcactgcacctccgcctcctggattgaagtgattctcctgcctcagcctcccgagtagctgagattacaggtgcatgccaccaagccaatttttttgtatttttttcagatggagtcttgctcagccacccaggctagagagcagtggcatgatcatggctcactgcagcctctgcctcccaggttcaagcaattctcctgcttcaccctcctgactagctgggattataggcacacatcgccatgcctggctaatttttgtatttttaggagagatggggttttaccacgttggccaaactggtctcgaactcctgacctcaagtgatccacctgcctcagcctcccaaagtgttgagattacaggtgtgagccatcgtgccaggccttttgtattttttgtagagataagatctcactatgttgcccaggcgggtctcaaactcctggactcaaaacatctgccagcctcggcctcccaaagtgctgggatcatacacgtgagccaccatgccaggccagtgctagacaactcctggccaagagcctagcccggggcagcaggcaactgtgcagcatgggaggaaccgtcatcacccatccaggagaccttgctctgctacacaccgttcggggaagtgctgcccctgggcaggacaggcagggtcacgtttgagggctcccatgttcaggggccgtgccaggctggccccttccaatctcccagttcacacagcaggaagccgaggtgctgcgagttcacgacttgtccagacccagagagaaggagtggagaggactcgagcttgacgaggaagcccacatccactgtgggccgggcccagaccagcactgggatccctcgtcctctgggttcactctcaacccgaaccgtaaggcacacagcagcctcactcaacaaggttctgcttattctctggcctgcattttgctgttttcagtcctgtcagaatgactgtctccgagctggggggggagtccactccacgtgtgctcggctcacctgagcggtagctgctccgcaggcagaagaaccggaagacatcgggggaaaaggtcttcagaaagtcctggtaaagcgagagacaggcagtcacgaggctttgcttttacgcttcgcactgttcagagaatatgttactttctacaattacataagttatctctacctatcaagaaatcaggaaccttgatgaaaatgagccctccaaactcacaattaccacctgtttcctggtgatttcctcactgaactttccacgttcgatctcagtatttgtggaaagagcaagaagagaaagccggtttgcactgaaaatccgcacctgcgcaggctccaggaggagtgtgtcctgtgctcagcctgggctctctttctgcacgacagggacgtgggacagacagcatggagcgatgctgtgctcaggaagagaccaggtaggtggcgggag

SEQ ID NO: 8406 - DNA, 493 bp, Homo sapiens
caggacccagtacaccctccgcagccgctggcccgggtgctaagtccctcattgccccgggccagcagggctggccggctgctccgagtgcggggcccgccaagcccacgcccacccggaactccagctggcccgcaagcgctgcaggcagccccagttcccgctcgcgcctctccctccacacctccctgcaagctgagggagtgggctccagccttggccagcccagaaaggggctcccacagtgcagtggtgggctgaagggctcctcaaatgccgccaaagtgggagcccaggcagaggaggtgctgagagcaagcgagggctctgaggactgccagcatgctgtcacctctcattttgtttaatgttttctattttaatgttttgtattatcaggtgtctgtcaagtcaggatcactttacatgctactgcagtgtataatcttgtcacaatgtattggctcataataataaaaaccaccaaatatta

SEQ ID NO: 8407 - DNA, 1496 bp, Homo sapiens
cccaacttctacattctaggatgaacccacaaaccacctggacatggagaccattgaggctctgggccgtgcctcaacaatttcagggtgagtgtgccttcaccctgaccactcctcccaggcctcggtgcctcttgtgtccccctgagcacctcctgccctcctgtctttcagggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagtttcgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtctcctttgcctcatgtctgctgctccctgggcagtggttgcctcctactgagggctgtggactctcggattggcgttttcctatggcacttgtatccctcacgtgtaggaagcaatagcagcaccagccttgcctctagaagagacattgtcaagctactggggcatggaggtcatctgcctgcctgaccttggggtgggctgagccagtggaatgaagggcagtgtattggcatcattgcggtgctgttagccctagcctgggctcagcctcagctgaaggggtcttgggttctgtcgtcacagcccccactgatgggcagttgaactgattgtgtaacctggcctcacacgtggccagctgctttctccagtcatatctggctccggcttgccctgcttctctgctctctagactcagcactgaagagaagccatctttgtcctcactttgcttgggtgattgcatgttctttatatttcctctaaccatataggaggggcctgggaaatagggaatttaggacagggtctaacaggaaggcatggaacactttcttttcaaatgaagcaatctttaagaggggagagatgttgaacacaggtagtatcatttataaatattatttcttgaggagttagctgttatatgtcattgttatgcagaggacgttaaaatagagacatttgagctgagcacagtggtacgcacctgtagtcccagctgttggggaggccaaggtgggaggattgcttgagcccaggggtttgcggccagcctgggaaacttagcaagaccacttctctcaaaagaaaaaaataaaacagacatattgcgttgctctcagtgacaacaaa

SEQ ID NO: 8408 - DNA, 3981 bp, Homo sapiens
tgatacctgagtggtaggagtacaagccctttctaattttcttctgaacatgatattactcgtgtaggaagttatttttttaagtaataaatctagtctacctcatctcttctcccaggcctgagctgaagcctgtggacaaggaatcagaggtcgtaatgaagtaagtgctgggccagtggggctggtggggaattgcttgcttccagctgcccccacatcctcacccctacctcctgcaggttccctgatgggtttgagaagttctcgccgccaattctgcagctagatgaggtggatttctactacgatccgaagcacgtcatcttcagtcgcctctctgtgtctgctgatctcgagtctcgcatctgtgtggtaaggctgctgtttctctgtgctgcgagctgggactctcctgtctaagtgtgtggtgtggattggcccagatcctcaggctgtaaagggacgaggtctgtggaacaggagtgagggcccgggctaaggattttgcaggacttacactagccctgtcctctggccgcacagcgctgctcttcagggaggaagagcctagtgtatagtgttttaaaaatacttaaaaatacttaaagcagtgctttaccttattggtctcggttctgagttttctaaacctggagacattgaggagagagcatgggcttcagggtcagacttcggatcttgactatgccatttcctagcttggttaccaagcagcttcctaactcttaagatggcgctgacatctacctcacttggttcttgggaaaagtaagtccccagcacttagcaaatactcaagtattgctcaccttagtatatgcatttttctgtagagttagagttccttttttttttttttcggagacagagtcctgccctgttgccccggctggagtgcaatggcacaatcttggctcaccgcagctttcgcctcccgggttcaaacagttctccctcagccccacaagtagctgagattacaggcacccgccaccatgcccagctaattttttgcatttttagtagagatggggttttaccatattggccaggctggtctcaaactcctgacctcaaatgatctgcctgcctcagcctcccaaagtgctgggaatacaggcctgagccaccgtgcccggctagagtccttaaaaatatttttttggttgttgaaggagtcatcgggactggggactgcctgggaccccttctaatttccttctcctctgtgttacacacagcggtgctctttttattgatacataattgtacatatttatggggtacagagtgatacttccatgcatgtatacaatgtgtaatgatcaaatcagggtaattagcatattcatcataaacatttatcactttatgttgggaacattcagaatcttctagctttttgaaaatgtacagtctatcattgtgaactgtagcgtccctgcagtgctgtagaaccctagaacttattcctccattcctcctatctaactgcaattttgtttcagttaaccaacctctcccgaacccctctctcaattcccctcctccccccttatccttcccagcctctagtaaccacaactctgctctctacttctatgtgctcaacactttttagtgcccacatatgaatgagaacataccgtatttatttttctggcacacactgtatgacattttcatgtttcttaaggttggagagaatggggctgggaagtctaccatgctgaagctgcttttgggggacctggcacctgttcggggcatcagacacgctcacaggtcaggcccacccgcacccctgcccccatgagcacatttgcaggcacccatgctgcctgcgctccttcgtggccattgcctttgtctgtttttccacctcggcttctgcctgcaggaatctgaagattggctatttcagccagcaccatgtggagcagctggacctaaacgtcagtgctgtggaactgctggcacgcaagtttcctggtgagttagggatttgagtcgggggaagagtttgagtagggaagagggctgaggctgaccccggcagctaggcctgccttggggtgcgtgcagagcagccccgccaagcctagatggaaggacatggggacttggaggtgtggctggagggcacagggagggtgttgggccaagaagccacctgatctggggagtccttttccagggcggcctgaggaggagtaccgtcaccagctgggtcggtatggcatctccggagaactggccatgcgtcctcttgccagcctgtctgggggccagaagagccgagtggcctttgctcagatgactatgccctggtgaggcctcattttccagagctcttcccctcccatttccccttcttgcccagtagaaaactgtatcagaaggctttattttctctcaccgcaccccttcactgcccaccttcctggttctgccttccagccccaacttctacattctggatgaacccacaaaccacctggacatggagaccattgaggctctgggccgtgccctcaacaatttcagggtgagtgtgccttcaccctgaccactcctcccaggcctcggtgcctcttgtgtccccctgagcacctcctgccctcctgtctttcagggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtctcctttgcctcatgtctgctgctccctgggcagtggttgcctcctactgagggctgtggactctcggattggcgttttcctatggcacttgtatccctcacgtgtaggaagcaatagcagcaccagccttgcctctagaagagacattgtcaagctactggggcatggaggtcatctgcctgcctgaccttggggtgggctgagccagtggaatgaagggcagtgtattggcatcattgcggtgctgttagccctagcctgggctcagcctcagctgaaggggtcttgggttctgtcgtcacagcccccactgatgggcagttgaactgattgtgtaacctggcctcacacgtggccagctgctttctccagtcatatctggctccggcttgccctgcttctctgctctctagactcagcactgaagagaaaccatctttgtcctcactttgcttgggtgattgcatgttctttatatttcctctaaccatataggaggggcctgggaaatagggaatttaggacagggtctaacaggaaggcatagaacactttcttttcaaatgaagcaatctttaagaggggagagatgttgaacacaggtagtatcatttataaatattatttcttgaggagttagctgttatatgtcattgttatgcagaggacgttaaaatagagacatttgagctgagcacagtggtacgcacctgtagtcccagctgttggggaggccaaggtgggaggattgcttgagcccaggggtttgcggccagcctgggaaacttagcaagaccacttctctcaaaagaaaaaaataaaacagacatattgcgttgctctcagtgacaacaaa

SEQ ID NO: 8409 - DNA, 8690 bp, Homo sapiens
gtctcacagcgactgcgcggacgggttcctgagtggaacatggcgacttgcgccgaaatcctgcggagcgagttccccgaaattgacggacaagtcttcgactacgtgaccggtaagcagaactgaatcggccggctggggagaccgaagtggaggccgggggaaagtctaagcgagcgtcgtgcccgggactgttgccaggcctctcctctgcatgacctcttgtcccgggggctggttgggtctggagcctggactggggcctctgtctggggactgaaactgcttgtgtgtccaccctacccgataccttcctcgttctaccacgccctgcccaggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctgtatgtgccagggagtaggggttgatgggggcgaagggacggcgaacggtccggagacaagaggtgggggaggaagatctgatggccatagagcttttccctcaactcctaactctgcgctttctatccctacccacatagggctgagccacaaagccagggaaatagccaggtgctactggacgcccctatccagttgtcaaagataacggagaactacggtgagagtgaggggaggttgaactaactgcccccctgtgcttttctccgcccccaaccatctgctgcctgcagcttagggctcctacgtcttttccacaggacaaggttgtaggagctagttgatgtctttaccgagggcagaagagcccatgatgggggtggggaggaggttggagggttctccctccaagctcttgggtagggtaggaagcataagagcctggagctggacagacttgctttcacccccagttttgcaacttgctaaccagctgcatgatcttgtaagagttggttatctgtccccagcctcgtctatgcctctgtatccttctacgtgagttttgttttgttttgttttgttttgtttttagtgcagggaagataatagccatctatctgcagtattataaggttttgtagaaaacatctgtgtctctgcctggttcctattagtcactcaaaatgttagtttcccttccctcagggagaaggtgactgcttttcttatcgcttacagactgtggaaccaaacttccaggactgctaaagagggaacagtcctcggtgaggaggaggaagcaagggaggggactgtctgtgatggggttgggagttgactgtctaattggagtatcttttggggggatttctgactatgtcttttcctgagcctttgagtctgttcatcatgggtaagttaagagggtttactcgagatgttctctcttggggttcctttctgagcctacacccgagagtgaagtcgatgtgtttggacccttagacagtgaatgcaaagaagttagagaaggccgaggctcgacttaaggcaaagcaggagaagcgctcagagaaggacacgctcaagaccagcaaccctctgtgagtgggggaagcatggctcagaagagagcagagcagcttttgcctggacagaaggtggtggggagcactaagagctgtccatttctccctttaaagagtcttagaagaggcatcagccagccaggcaggcagcagaaaggagagtcggttggaatcatctggcaagaacaaatcctatgatgtgcgaattgagaactttgatgtgtcttttggcgataggtgagggaatagtggtggcaggggttggctttctttttctaattagaggacaatttggagaggtgaaacggggctataaacaatgttaggtttgtcattaaacttgctgtgcacctatttctagagcatctttggtctcctttctccactcctgcagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcaggtgaggactcccggctagggagtaactagcagccgctgtcgcttacagagcgcctgccgtcctggaacaatccataatttgcatgtacatcctagtaatcagcagagcttagaacttggcactctgggactcagaagcccttgttctttccacagtgcccattgccctttcttgttctttccacagtgcccatttccatagtgcccaaggtaatgagcactgtgcaaacccttcctgtattctcttcctcttccagccacaaggtagccaatggcctttccaacggtatagggtgcaggacatcctcctagactgcccccgcttaggccaattgctgtttctcctccctccagggcggagggctctgaagctgcagagctggcagaaatctatgccaaactggaggagattgaggctgacaaggcacctgccaggtatttaaagctccccctccctccttcagatttcctttcccttctgtggactgttccaactgagttcttcgatttcttctctactagggcatcagtcattctcgctgggcttggctttacccctaaaatgcagcagcagcccacccggtgagtgacccttgccattcttggctttgaaccctgttgtctcagccccttcctgccctgatgaacacccacccataatgtgactccatcattctttagggagttctcaggtggctggaggatgaggctggccctggcccgggccctctttgctaggtgagtctcctgggccagtgtatgaagccctatggaagattggtcttagctcttgggaggtggcatgagttgctgacctaaaacctcaggccatgtattctttttcataggccagatcttctgctgttagatggtgagtttgaaatggggcaccctgactttaggatgggcaggggtggtagcatccaagttcctagttctccagcccttcaatcccaagtgtgtgctcccctgcttctccagaacctacaaacatgctggatgtcagggccatcctgtggctggagaattacctgcaggtgagtgcctgtgggtgctggagtgtgttggggaaaggcggcctccaagatacctgggggcctgagaactgactgccctcccaaaccgggcctgctgtcctgtgacccctcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggtgtggggcctggcagggctgggggtcccatcccaggggttccagagtgggggatagtgggggaatttgaccaatgcctacactcctccacctgcaggttttcattgaccggtttcgctacaatgccaacagggcctctcaagtgcagagtaaactcaagatgctggagaagctgtgagtacagcatccttggccagggcctgactcctgttctcttcgtctccttccgcatttgcacgccacccttgccctaccattctaggtctccccttcgctagaagccaactgtgacttcctcctctgctgggaagcagagtattccacactgttcttggagggctaatcttgactagcacgtggcaaccactaatttactttctgtttctgcttctacgtatctgcttattctgggcatttcatataaatggaatcatacaatatgacctttgtgcctggcgtcttttacctggcgtcatgtgtgaggctcatccatattgtagcgtgcgtcagagcttcatttcttttcgtggctggataatattctgttgtgtggatatacagcattttgtttattgagtcatgaggggccatttgggttgtttccattttggttattatgaataatgttgctgtgaacattggtgtacaaatttttgtgtggacatatgttttcagcttgcttgggtgtatacctaggcgcagaattgctgggttacctggtaattccaaattaatgttttgaggaactgtcaaactgttttctaaagcaacaacatcattttacattcctaccaacaagggatgagagttccaatttctccatgtctttggcagcactgttattgactttttttttttagttttagccatcctagtggctgtgaagtgatagctcattgtggttttgatttgcattgccttaataactaatgataatgtgcattgggagtttaattttgaagtgccctttctataagtgctggcaggaagcttaaaatcataaagcttagatgtttgcgacgtggaaacatatcacaatatagtaactggggataaaaagtcacaaaaagcctaattctattttttagcatacagtaaatgagaagaatggactctaaagtaatgatacctgagtggtaggagtacaagccctttctaagttttctctgaacatatattactcgtgtaggaagttatttttttaagtaataaatctagtctacctcatctcttctcccaggcctgagctgaagcctgtggacaaggaatcagaggtcgtaatgaagtaagtgctgggccagtggggctggtggggaattgcttgcttccagctgcccccacatcctcacccctacctcctgcaggttccctgatgggtttgagaagttctcgccgccaattctgcagctagatgaggtggatttctactacgatccgaagcacgtcatcttcagtcgcctctctgtgtctgctgatctcgagtctcgcatctgtgtggtaaggctgctgtttctctgtgctgcgagctgggactctcctgtctaagtgtgtggtgtggattggcccagatcctcaggctgtaaagggacgaggtctgtggaacaggagtgagggcctgggctaaggattttgcaggacttacactagccctgtcctctggccgcacagcgctgctcttcagggaggaagagcctagtgtatagtgttttaaaaatacttaaaaatacttaaagcagtgctttaccttattggtctcggttctgagttttctaaacctggagacattgaggagagagcatgggcttcagggtcagacttcggatcttgactatgccatttcctagcttggttaccaagcagcttcctaactcttaagatggcgctgacatctacctcacttggttcttgggaaaagtaagtccccagcacttagcaaatactcaagtattgctcaccttagtatatgcatttttctgtagagttccttttttttttttttttttcggagacagagtcctgccctgttgccccggctggagtgcaatggcacaatcttggctcaccgcagctttcgcctcccgggttcaaacagttctccctcagccccacaagtagctgagattacaggcacccgccaccatgcccagctaattttttgcatttttagtagagatggggttttaccatattggccaggctggtctcaaactcctgacctcaaatgatctgcctgcctcagcctcccaaagtgctgggaatacaggcctgagccaccgtgcccggctagagtccttaaaaatatttttttggttgttgaaggagtcatcgggactggggactgcctgggaccccttctaatttccttctcctctgtgttacacacagcggtgctctttttattgatacataattgtacatatttatggggtacagagtgatacttccatgcatgtatacaatgtgtaatgatcaaatcagggtaattagcatattcatcataaacatttatcactttatgttgggaacattcagaatcttctagctttttgaaaatgtacagtctatcattgtgaactgtagcgtccctgcagtgctgtagaaccctagaacttattcctccattcctcctatctaactgcaattttgtttcagttaaccaacctctcccgaacccctctctcaattcccctcctccccccttatccttcccagcctctagtaaccacaactctgctctctacttctatgtgctcaacactttttagtgcccacatatgaatgagaacataccgtatttatttttctggcacacactgtatgacattttcatgtttcttaaggttggagagaatggggctgggaagtctaccatgctgaagctgcttttgggggacctggcacctgttcggggcatcagacacgctcacaggtcaggcccacccgcacccctgcccccatgagcacatttgcaggcacccatgctgcctgcgctccttcgtggccattgcctttgtctgtttttccacctcggcttctgcctgcaggaatctgaagattggctatttcagccagcaccatgtggagcagctggacctaaacgtcagtgctgtggaactgctggcacgcaagtttcctggtgagttagggatttgagtcgggggaagagtttgagtagggaagagggctgaggctgaccccggcagctaggcctgccttggggtgcgtgcagagcagccccgccaagcctagatggaaggacatggggacttggaggtgtggctggagggcacagggagggtgttgggccaagaagccacctgatctggggagtccttttccagggcggcctgaggaggagtaccgtcaccagctgggtcggtatggcatctccggagaactggccatgcgtcctcttgccagcctgtctgggggccagaagagccgagtggcctttgctcagatgactatgccctggtgaggcctcattttccagagctcttcccctcccatttccccttcttgcccagtagaaaactgtatcagaaggctttattttctctcaccgcaccccttcactgcccaccttcctggttctgccttccagccccaacttctacattctggatgaacccacaaaccacctggacatggagaccattgaggctctgggccgtgccctcaacaatttcagggtgagtgtgccttcaccctgaccactcctcccaggcctcggtgcctcttgtgtccccctgagcacctcctgccctcctgtctttcagggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagtttcgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtctcctttgcctcatgtctgctgctccctgggcagtggttgcctcctactgagggctgtggactctcggattggcgttttcctatggcacttgtatccctcacgtgtaggaagcaatagcagcaccagccttgcctctagaagagacattgtcaagctactggggcatggaggtcatctgcctgcctgaccttggggtgggctgagccagtggaatgaagggcagtgtattggcatcattgcggtgctgttagccctagcctgggctcagcctcagctgaaggggtcttgggttctgtcgtcacagcccccactgatgggcagttgaactgattgtgtaacctggcctcacacgtggccagctgctttctccagtcatatctggctccggcttgccctgcttctctgctctctagactcagcactgaagagaagccatctttgtcctcactttgcttgggtgattgcatgttctttatatttcctctaaccatataggaggggcctgggaaatagggaatttaggacagggtctaacaggaaggcatggaacactttcttttcaaatgaagcaatctttaagaggggagagatgttgaacacaggtagtatcatttataaatattatttcttgaggagttagctgttatatgtcattgttatgcagaggacgttaaaatagagacatttgagctgagcacagtggtacgcacctgtagtcccagctgttggggaggccaaggtgggaggattgcttgagcccaggggtttgcggccagcctgggaaacttagcaagaccacttctctcaaaagaaaaaaataaaacagacatattgcgttgctctcagtgacaacaaa

SEQ ID NO: 8410 - DNA, 9849 bp, Homo sapiens
gtcggcgctagacgccggcgcgcacgcgcagccggggccggggcggggcggcggcactgcggtgaaagccgaggcagcgggcagacgagcagggggcgggcggacatcttgggatccggagagtggccgggccggcagagcagggggccgaggacaccaggtgagccggggatctggccttatggcgtggaggaggacgctgcgggtcgtctgcctcgccgcgcagctttgtcctgccctgcactgagctggcggaaagctgcccacacccgggagtggcttcagccttcggacccgggagctagctgacggtggggcgggggcgcccggggcgcgattgcagggctggcggggagcggtgccctccacctgacccgcctggcgcctcccatgagagggataccgcttggaatcctcccagagcaggaacgctgcgcagcgccccctccctaggatcgtgccaaccccctacccctccgcgcaaggacaatttccccgtctcgtaggacagtgacacccctttgtgccgccgccttgcaccgtgacaggtctcacgccatgcggcaccccctcctcttagttcagtggcaccccgcggctcttcttccttagacctgtgacagcccccgcacccccatggcaccatcttttcccacaatgtcctccccaaggcgaaaagcctagcaccctctcattactctgcacctgaaccccaagcaggctctgtctccccagctttcccttattcaccactgtcagttcccccggccggtttttccttcttaaagccttgaccttttccatactggaaacccttacctttacgttcactccaccagcccagtttgctgctgtgggctcacctgaggacgctgcctggctttcactgaaggtctttccccttaactaaatgttccattcttgcccaaggtccccctctggttctcgggtgcccttcgctacctaccactcgatacctgtggacttggtgctttgccccaggctctacctccattttgcatctcctctcccagcctgtttgggactgagggatgggatgagtccaccaccttgagagaccgctcacccctctggaagaccttgacagccacaggaaaaggctttattttccagtttagaaaagtcctctaaagtactccctgtgaaattaataccagggctaatccaggaaatctaaaaccaaattaatgccttttctcaaacagtctaaattaatttgacccaaataatttggataattcaggcatcctgacatccctgcttcttgcttataggcacccaggccagaaatgagttacttcatgggcctggaatcacgatttcagatggaaggatttcttaattttatgagcctgcgccacccccaccccccagtccttatttttattgcattccagagctttttgaaaggggggtggtaatcagaaataactgtaataagcagcttgggtgatggaagtgtagtctgccagccctaggaccttcctcctgtgccctttgcctgcttattccactgcctggaagaggttaagccacactcccgggtccacattagggcctaagggctcccttctcttctccttataccctttcctggaatgtttgaattctgtgaattagagtgccggaagttcaggccctgcgaccttctctgaagggtagtggagcccaagagactggatgctctaaaggttatgcctgggggccccaggcctgaaccaactggagtaatgcctaccgccattcctgcagccgcaggcaggcaggcaagccttagtgagtcactggcgggagcccgagagtctgcacaggagggggccgaaaaggatcattcctgagctcagtgctggggagagggggcgggggttactgatgctcagccccaggaaagggagggtcaaaatggccttagaatcctgggcctaatctctctctgtttctttctcccatctagtgtggaataaacaggaactggagcctggctgaggggaggggcatgtctgggagggctgcagggtcacttactaaagggttgagtcaggaaagaagctccagtgacctgcacagctccacaggggatgttggcagcgattctgaggtcttcttttaccctgcccccgcctgtcctaggtctgttctcagagcgatgggccgcggagactgatctgccgccatgattggaggcttattcatctataatcacaagggggaggtgctcatctcccgagtctaccgagatgacatcgggtgagtcccctggcggagccagctgtgccccaccactccagccccccagccccagcatacaggattaggtcttttcccaccattggcttgacttgggccaccctgacccctggctgcaccctggaagctcagctagtgtagcctggctcccattaggtctggtggtattggcccggcagccagcctgccagcccctaggtgggacctgtggaatggcatggtcccacagctttaggaactccttcccttcctgcatcctgtttctctagttacagtgcctttgcccaggctggtgaattccttctttgaggaggaggaggagaaatgtctccagtgggtggggttagtggccacgctggaggcactaatccatctaagccttgctctcagaagcccttcccatatcaaacgccttcactggattctgttgaaagcccctccaggctgcccaatcctctcctgctccctttctcaggagtcgtcaggctgctgactcagctgtcttcagttcctctggcccattccctggggagtggctggaagcgtgaggcactctctgggtcactgtgggagggcagggaagccatgctaccctctcagtagacccagagcagctccatatcctgggccttcacacagagccacagcctgccttctcattctgcgcccccttgcacgcccttgttctttgcgactgaagggacctatcctagcctccgaggcgctaaagagtaggctcctctggttcctgctgcctgtttttcttcctcagagagcttgagataaagtcacagaatgggcctgtggcagtgctcttcatttggctccctggctgatgggctggcttggcccttgcgggcgtttgtccattggctggtggtgtggcatgagctagagctgcagctgtggcaaggcctggcctgtctgaacctggctggctacaccccccaccccagaccccctcctgccttggatggactgggcaagccaaggccaggtcacacgccgccttgcctgtcttgtctgcttctgcctcacggtgtgtgccgccctcccggtgtgttgtgtgtctaaccctctctctcgttgctatcactctcctcttcttgctggcgtcatttctctcatcccatctcattggctgccgtagcaataggtaagcggcctctcaagctgctgcccaggtacaggtgggtgggggcctgcccccatcgttttcctgcatcctttttcattccctcaacttgctctggagttggatcctgggcaagaatgggtagcacaattccatggccccttggtacttctccctcctttgtgacttctgaagccatgctggctttgtctaacatctggaggagtcggccctccccactggtgggatcactagcgggaggactgaagaagcagtgtctctttctgtcctggacctgggagcttacagggaagctagataaagctgggaaattagggccagccctgggagtaaggaatatctgtctctaaacctgatgaacctcactttattaaggttacatcagccttaatagttgacttccctatttcttgtggcctttagacactagcccagctcaggcactcttcccatgcctccacagggagtcataagaagggaaccactccagtggtttaggcattggctttctttggagtgtgtgtgtcagacttctgcagaaaggagggtggggctgttagcagctgtggttgatccttatggggtaaggttcacctgggtgctgagcaggccctatgcactcttttcccccaggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatggtgaggctggcgggctggcacggcagcgggcgtagggtgggaaaaaaccaggctgggcctggcctgaaggtgggtgtaggtccgaggctctggtacactctgaactttctttcctgagtatttggtctcttgggctaggatctctatgcccctcagaaggccagttcacatccagacctgaaggctggtctgaagtagaacacagaaataggccagcaggtgatcttccaaggggctaggaacctgactcaggtttgatggctgaacctcctgtattcatcctctttcctttgtggcttggaccttagttcactaactgtccacccagttttccatctcagcagctgcttcagagcctgggggagagtgagatattacaagcctcttggggtgcactgttatctctgttcctctgtagagtgtgatctaagagaaggtgaatacttccaccttcccaatgtctattttctggagaaaacagctcaaagcttcttgacttgccacccactggccatgtgactcttctattgatttcttttcttttttttttttttttttgagacagggtcttgctcttgtcacctatgctgagtgcagtggtgcaattgcagcttactgaagcctcgacctcctaggctcaagcaatcctccagccttagcctcctgagtagctgggaccataggcacatgccaccatgcttggctcatttttactattttttgtagagctgggtctcgctatgttgcccaggctggtcttgaactcctgggctcaagtgattctcccaccttggcctcccgaagtgttgggattacaggcatgagccactgcacctggccttgatttctctatttgaaaaaaatcaaacatttgaattgttttcctgtaaagcacaaatcacagaataaatgctacaaagctagaagactttcttgcggatgatcccacatgggctttgggagctgtgccggtcagatgtgtaggcccaagtaggggctggaatgaagaagctctgtccaggggctgatggttcccttctttttgcagagattctagactttggctacccacagaattccgagacaggcgcgctgaaaaccttcatcacgcagcagggcatcaagagtcaggtacttgaattgtgcagactatagtcagggtggagtccaatctcccttcatctcagctggcccctgagccttgtctgagctgactcatgagccctcccatgacaggaagtgctggcctgagcctcctgccatgattgcaggccgattttgctctgtgtggtcctcccactgcaggagcagccaattcagcatctctattaccaggaatacagctcaagcagtttccttttgcactgaggggtgggggaggaggcctggtcttgaggcctggtattcctcaggaggagcgagcttgggccctctcctctaggatccaagcctcatagctttctcctccttttctgcctcccttgctgcttcatgtgggcacctcgttggccctgcggcctccagcatcaggtaagctcttccctcagcttccacccttgcagctttgctttgtttctccaggccctgccctttggggcttataggggaaaatggattacaggtggggactagaagggatggggaatgagggtggagtggggatagagacaggatgattaaagggacagaggagtgaggccattgctgtttgtttctgccctcatgtagacaaaagaagagcagtcacagatcaccagccaggtaactgggcagattggctggcggcgagagggtatcaagtatcgtcggaatgagctcttcctggatgtgctggagagtgtgaacctgctcatgtccccacaaggtgaggtccctctcacgacaaagttggagggggcccagggcaggatcctgggcctgcctgcctgactccgctgctccccatttatctgttccatcaccagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagaggtgcctgaggcaggagagctggtgggagagggtgtcccttggagggctcagtggggtctagtgaaccacaagtttcttctggatttcattcccactgtaattgcaaactctgttcctgacggtaagcctggctgttcgctcttgacattagtgctacgagagatgaggggatcgtcctcagagagcaagcccctttgtttggtccctaggaccaaggccttttctgtacatactgacagcctctgcccagtgtgcctgaaacacccaggtccctagcagaaggagccccaagagatgagcttgcaaggcttccctctcatcccaagctctggggcagacctccgagtcacaaagctgcattctagcagcttttcatagtctctggtgccagcctggggtggagtggtctcccagcatgacagctgtcattctcctgtaccaatgagacctcttctgcccctgcttgcagcgggaagcaatcaattgccattgatgactgcaccttccaccagtgtgtgcgactcagcaagtttgactctgaacgcagcatcagctttatcccgccagatggagagtttgagcttatgaggtgccattggggtgtgaggaggcagctagtgctgctggcagactggggagaggaagtgggtcagctctttggtaaccttgcttcccatcccttaaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggacagggggctcaaggaggaggaagaacttgtccctaggaataaaggtagctgatgtcacagcttgacagagctccctgacaggtgtgtcacttctaggtgaggatcccaaccccactgaacacaagcggggtgcaggtgatctgcatgaaggggaaggccaagtacaaggccagcgagaatgccatcgtgtggaagtgagtctttccttcattaggccacagcagggctcaagatcccagtataccctcttgttttcagctttgatccttctgaatgaggggcaggggagtgtgcctgtttgcttttctaggagcctctgcttgtactgtcagtctttatacctccatgtgagtatgtacacgcctgcatttgggttcatgcacgtgcttattttttaagatgctttggcatttccctttgtaatgtatacattacaaagggaatacattgcctttgtaatgtatctgtgaagcagacaaagcaaacgatagcatgcccaagtgtctaggcagaaactgcatcctgttgttctaaagaagtagacccaagtttccatagcaagtggttagcagggtcctgaccacttctccttgttctggcacctcctgcaagctcctgggctctctccttgcttgaaatgggcaactgcccttgaaactcctccaagccccaatgggctgcccattgtccctgtgttcccaggatcaagcgcatggcaggcatgaaggaatcgcagatcagcgcagagattgagcttctgcctaccaacgacaagaagaaatgggctcgaccccccatttccatgaactttgaggtatggcagaggaggggcctagactcatgccagggtatgctggaagacctcttagagatcattccgataaaccgctgcaccttagaggtgaggaaactgaggcctagaaagaagaactggctttaattcatagatccattcttcccctttcaagcctcttagtagaaattactatttgtaatgaggcaaatcttttacttctctcagcttgtcctaacacagttctttcaaaaaacttagattgtttaaatgccaggtaagacacaaagtttacttacagacaggataatgggctgactttgctttgcgcatgttagacataattttctccaccttatttttaagttcataatattgagcaggataagtatgttctaaagcagttctttggttgctgtctcctgctgattaaaggaactgattcaaggtgtcacaggtagggctttcttctttagtcacctcttagaaggtcccacgccgccccagcttctttcaggaccccagccatacaaacacctgtagtagcgatgaagtagggcagggcaacgggacttcccagaggagagcggctgtaagaggaaggccacatttctaactagctctccttgcccaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacactagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtggagttgctggcttagtgttgatgtgggagctacatggggagggaactggtgttgctctccgtgcagttttctgtactgaatactctaaaggctctttccttgtcttgtcccagttaggcccctcctgggccatccaagcccttatccttgtgggttctgggcccaggtttcctggctcctcttagaaagcctcaagggcatgcagccgcagcgggccccagtaccctggggatagattctttccctagctcctttttattccccctggtcctcggactcctaggctcaagagatcttacctgccccagcctctggagtagctgggatcacaagcacgcaccaccacagcacccagctctttctctaattcttaggcagatgttttctaattagattaagcataaattaagtgtgaagtttacatttggtcttgtagccatcctaagaaattgaccttttaattccatcatttacccaagcttcccaaatcttgctgactgggtggtaggaggaaagatttgcaaggagaataacataatggactgggcgcggtggct

SEQ ID NO: 8411 - DNA, 1703 bp, Homo sapiens
aaatgtagtaaccaattacagagacttctttaaagatataactgttgtgcttttttgaaggcaaagaacctgccctgaaaaagaatctgacctgaacacatgctgtcctaagcagttagtctagtgtgtctctggggtctatgcaggtttgcagtgtacagactgttatctcctgtctcagtatttgcccttcttatggaattactttccttcctcttactaccttatttcctcctcttcatttgtctcattagttgtattagccagatatatatttacttgtaggggagggggaatgtcaaatttcagtttctaggaattatatatggcatgagtcattgctatagcatcacagaaattttcatcaacgtctatctagaacagtcaggagttctagttatgagttctgtaatagatatttattgaacatgtgagaacaatgtaaagccaatagttggttcactcaaatatttactgagcactgggatacctccatgaataaaacaaagatcctaacccttgtgaagcttcattttaatgcagggggagacagaaataaaccataaacttaacaaataggtatattttatagtaaatcagtatgtaatagatgcagtgggggggcagggaatatgaaactgtgtaaagggaaattgatagtgcttggggacagtggctgtaggttacactactcagtatggtatcaggaaaggcctccttaagaagagatgtgtgtaggccaggtgccatggctcacacctataatcccagcactttggggggccaaggcggccggatcacctgaggtcaagagttcaagactagtctggccaacatggcgaaaccccatctctcctaaaaatacaaaaattagccgggcctggtggtgcactcctgtaatcccagctacatgggaggctgaggcaggagaatcacttgaacccaggatgtggaggttgcagtgagctgagattgagccactacactccagcgtgggcgacagaaagaagagtgtgcaaagacttaaaggaggtggggggagtaagccaaacagatagagggaaaaagcattccaggcgcagccacagccatgtcctaagaatcatgcaatgcgttggaggagctgcaaggaggctggtgagtctgggtggagtgagcaagaggagtagaaagaaatgcagtgcgagaggcatcaatacctggggctgttcctggagcaccttatatactgtgaggactgcttttcactaggagttagagagcacttttgggttggggttttttttaatgtttttattgagctaaaatttacataccatacaagtcacccatttgaagtgtaaaattcagtggtttttagtatattcacagatatattcaactattaccacagtcaattttagaacattttcattggctgggcgtggtggctcacacctgtaatcccagcactttgggaggctgaggcgggtggatcacctgaggtcaggagtttgagaccagcctggccaacatggtgaagccccatttgtactacaaatacaaaaattagcaggcatggtggcacgcacctgtaatcccagctactcagggggctgaggcaggagaattgcttgaacccaggaggcggaggttgcatcacgccattacactccagcctgggcaacaagagcgaaactccttctcaaaaaaaaaaaaaaaaa

SEQ ID NO: 8412 - DNA, 214 bp, Homo sapiens
gcaacattctttttttttttttttttttgagtcagagtcttgctctgtggcccaggctggagtgcagtggcgcgatctcggctcactgcaagcttcgcctcctgggttcacgccattctcctgcctcagcctcctgagtagctgggactacaggtgcccgccaccgcgcccggctaattttttgtatttttagtagagatggggtttcactgtg

SEQ ID NO: 8413 - DNA, 2193 bp, Homo sapiens
gaaaccaaggtgttggccaggccatgctctctctgaaggctctgggggcagaccccttccaggccactcttctagcgtctgacgtccccagcagtacttgcttccatggcgggtaaggcatcccttacatcatctgcctctgtcattgcgtggccctctctgctgtgtcttctccttttatggatgccagtcattggattttgcgcctaccacaccccaatgtgacctcatcttacctaattatacctgcaaaatctctgtttccaaataaggtcacattctgaggtaatgggggttaggatttcaacacgtcttttttgggagcacgattcaacccataacaatatgtaatatacccaaggttacccatctgggaggtaactgtcttcagggtaaacttggggaagcatcccctctctgtgtgaggcaagatttgaattcttttcatagcagcaagaggacagttgaggattccgtgaggtggtttgaccaaaggattttgtctgtttcattttctctgtccaaagcaatgccatccacataattgcaattttttcagaacatggattgagaaatgcttagaggttcgttttgtttttatatgttttaaaaaaatgttacttttaacaatgaaaagagatcattccttatatattgaccagtgattagattttaaatctacttttctataaaacacaacttttattctttcctatctttgtggaaaacattcacatcaaagtgccacatcatgggtatgcatacatgtttgtatatcatagactatctggatgtttttaagtttcttatcgagatataattcatataccataagtgttgccattttgaagtgtacaattcagtggcttttagtatattgagaaggttgtacaatcataattccagaatgttttcatcacctccagaaaagaaaccctgtacccatgaacaatcagtccctctctctcacccccattccctagcaaccactaatctgctttctgtttctatggatttgcctattctggacatttcatataaatggaatcatccaatatgtggccttttatgtctggcttctacttagcatcatatttttgaggatcatccgtgctatatcatggatgggtaccatgttcctttgatggctgaataatacccccttgtagggatggaccacgtttagtttatgcacacatgagcttgagtggctgctctttaaagggtataaaagaaaccagttctccctggaggggaccagggaaatggggctcatggatggcaagaggttttttcatcatggtgttttgtgttgtttaaatttttacattgtttgtatgttacctttaagaaatgaaggaattgatgtttacaattcagtgttcttgtgaaatgcagggtgtggcatttgtgatatgaccagggcctcctcacacctctgcagcttgagattctcaccaaagcacagcacgttcctcacccaggagtagggacagcagcccaggtccccaagggctggccagtttcagctgggagatgggtgactggttccttgcaccgcccctccgcattcacaatccatgtgtccctcggcacagttatgaatcactccatagtggagccactttagggtgagggagaattaggttagcaaatgctaacactggaaacgcactgtctgcctgggtcctgcgaggctggcacagtgtcaacagctgtgtgtaggagacgtgattgcctggaacccccaagaatgcacctaaaaatcatcaaacaccatcagattacaaaccaatataaagaattgatagtttttctatggaagaatcaaaaatcactttggaaaatagaatggaaatcaaaatcctgtaatagcaataaaaactaaagacttggcctggcgtggtggttcatgcctgtaaacccagcactttgggaggctcaggtagggggacttgaggctaggagtttgaaaccaaactgggtgacatagtgagaccctgcctctacaaaaaaataaaaaaattaactaggcatggtggtgcatgcctgtagtcctagctacttgagaggctgaggcaggaggattgcttgagcccaggacttggaggctatagtgagccatgatcgtgccactgcactgcagactgagaccctgtctcaaaacaaccaaacaaacaaacaaaaataaaa

SEQ ID NO: 8414 - DNA, 2194 bp, Homo sapiens
gaaaccaaggtgttggccaggccatgctctctctgaaggctctgggggcagaccccttccaggccactcttctagcgtctgacgtccccagcagtacttgcttccatggcgggtaaggcatcccttacatcatctgcctctgtcattgcgtggccctctctgctgtgtcttctccttttatggatgccagtcattggattttgcgcctaccacaccccaatgtgacctcatcttacctaattatacctgcaaaatctctgtttccaaataaggtcacattctgaggtaatgggggttaggatttcaacacgtcttttttgggagcacgattcaacccataacaatatgtaatatacccaaggttacccatctgggaggtaactgtcttcagggtaaacttggggaagcatcccctctctgtgtgaggcaagatttgaattcttttcatagcagcaagaggacagttgaggattccgtgaggtggtttgaccaaaggattttgtctgtttcattttctctgtccaaagcaatgccatccacataattgcaattttttcagaacatggattgagaaatgcttagaggttcgttttgtttttatatgttttaaaaaaatgtgacttttaacaatgaaaagagatcattccttatatattgaccagtgattagattttaaatctacttttctataaaacacaacttttattctttcctatctttagtggaaaacattcacatcaaagtgccacatcatgggtatgcatacatgtttgtatatcatagactatctggatgtttttaagtttcttatcgagatataattcatataccataagtgttgccattttgaagtgtacaattcagtggcttttagtatattgagaaggttgtacaatcataattccagaatgttttcatcacctccagaaaagaaaccctgtacccatgaacaatcagtccctctctctcacccccattccctagcaaccactaatctgctttctgtttctatggatttgcctattctggacatttcatataaatggaatcatccaatatgtggccttttatgtctggcttctacttagcatcatatttttgaggatcatccgtgctatatcatggatgggtaccatgttcctttgatggctgaataatacccccttgtagggatggaccacgtttagtttatgcacacatgagcttgagtggctgctctttaaagggtataaaagaaaccagttctccctggaggggaccagggaaatggggctcatggatggcaagaggttttttcatcatggtgttttgtgttgtttaaatttttacattgtttgtatgttacctttaagaaatgaaggaattgatgtttacaattcagtgttcttgtgaaatgcagggtgtggcatttgtgatatgaccagggcctcctcacacctctgcagcttgagattctcaccaaagcacagcacgttcctcacccaggagtagggacagcagcccaggtccccaagggctggccagtttcagctgggagatgggtgactggttccttgcaccgcccctccgcattcacaatccatgtgtccctcggcacagttatgaatcactccatagtggagccactttagggtgagggagaattaggttagcaaatgctaacactggaaacgcactgtctgcctgggtcctgcgaggctggcacagtgtcaacagctgtgtgtaggagacgtgattgcctggaacccccaagaatgcacctaaaaatcatcaaacaccatcagattacaaaccaatataaagaattgatagtttttctatggaagaatcaaaaatcactttggaaaatagaatggaaatcaaaatcctgtaatagcaataaaaactaaagacttggcctggcgtggtggttcatgcctgtaaacccagcactttgggaggctcaggtagggggacttgaggctaggagtttgaaaccaaactgggtgacatagtgagaccctgcctctacaaaaaaataaaaaaattaactaggcatggtggtgcatgcctgtagtcctagctacttgagaggctgaggcaggaggattgcttgagcccaggacttggaggctatagtgagccatgatcgtgccactgcactgcagactgagaccctgtctcaaaacaaccaaacaaacaaacaaaaataaaa

SEQ ID NO: 8415 - DNA, 30704 bp, Homo sapiens
cgggtcccgagggccatgccctgagcagacctgaagaggtaaggactcctcaacttgggcatgactctgacactcaccactgagcactcaccttgatgctgttccagctggagtagcccagccaggacccggcctcttcccgtgtcctctcccagaccatcccaaaccatcttgttttccccgggaaccctggggactgctggctggagaagacaggaagaggtgctgcctctcccagggtcctggaacttcactccaaggccccgtgggtgcttcagtgtcccaagtggatacggattctcatggaggacatggcatagtggataataggaaagtggagccgcatgcccaagcccagcacccaggagacaactcccactgcctgccctgttcccaagccttgaaaaaggatgacttcccctggactggctgtgtgtgtatgtgtgtgtgtgagtgtgtgtatgttagtgtgtgtgtgtgagagagacagtgcgtgtgtgtgtgtgtgagtgagtgtgtgtgtgtgtgtgtgagagagtgtgtgagtgtgggtgcatgtgcatgcacctgcagggagtgtggaaggaggaaggcaagctgatcgggcatggaatagagtgggcaccctggcagccatcctttgagttgaggacaccttctttttactttctttctttcttttctttttttttttttttttttgagatggagtctctctctgttgcccaggctacagtgcagtggtatgatctcggttcactgcagcctccgcttcctgggttcaagtgactctcctgcctcagcctcccaagtagctaggagcactaggcacaggcctgtgccaccacgcctggctaatttgtgttttttgtttgtttgttttgtttgtttttgagacagagtctcgctctgtcgcccaggctggagtgaagtggcgccatcttggctcactgcaagctctgcctcccgggttcacaccattctcctgcctcagcctcccaagtagctgggactacaggcacctgccaccacactggctaattttttgtattttcagtagagacagggtttcaccgtgttagccaggatggtctcgatctcctgacctcgtgaatagagactgggtttcaccatggtggccagtctggtctgaaacttccgacctcaagtgatccatccgtcttggcctcccaaagtgctgggattacaggtgtgagccaccgtgcctggccaagttgaggacattttctgatgtcctcatcaggtcattaccgagtcttctgggcccatgccctgggcctggtgtctgctggacacaggggacacagacatgagtccacatgagtggacaggttccgtgtcctgaggggcttgagatcccacccagtgctcttcatgagctccacagcccagggatggccacgagctgtatgttcctggcccatggtgaggtcaggacagaactgggaggcagtgctataaacttgtatagcgcttggatgttgctgccgtatcccagcgtgagaccaatgctccaccccggagagcagggggcactgtcaagcgctgttggactcagtatgtccttctcattcaatggagcagatttcccttctgatcacattcaattaaggaaaatggagatgggtggtagctgttacaccagccttccctcctgtgacactgtgtgtgccgtgttcagctggaggccgaggcggtgttccgggccatcaccattgcgggccggatcaactgccctgtgtacatcaccaaggtcatgagcaagagtgcagccgacatcatcgctctggccaggaagaaaggtatgcagccggccctgggccttctgggggcagctggggcctggaagggggtgtcctgcaggttcaagttcactccctcccgaactcagacaggcagccggaggagggaggggtggagcggggatgctcctgacacaaggatggtggctggaattctttggtcccaatgaccttaggatattcacctcgataagctcagctccatttaaagagaattttaataatatattatgtttaatctaatggatccacatattaattcagcatgtcatcaatgtaaaaatcattaatattttgcatgatgttttctgtactctcttcaaaattcagtatcttacatgtacacaactcagttcagactaaccacagcctcaggttattggtggccacatgcggctcaggactgccttattggacagagcagctgtggaccccaaatatgttgttttagtgtttttaagggcaagctgacaagtagaggctagaacagcacagcttgcctgaaactagctccattttgaagataaggaaaccggggctcagagaggttacagaaatctggaagcggtaccagccgggagcgggtaagcaggcaggttctggagctacaggaagccataaggtagccactaaccacacgtggctatctaaatttaaattaagtaatgttaagtaaaatgaacaagttagtttctcagtggcaccagccacaccagcttaacagccacatgtggccggtggttgctggttgggcagctgtgatacagggcacccccctcgctgcagaaagcgctgcttgatgggctgccctagagccgggcagagcttgcagctgcctctcctactgggcagcaggtggcctcaggcgagggcagcagggggtctcgggccacatctcttgcccttggtctctaatgcaaagatctttcctggggagcccgagcctctgcctgcaggcttttctggaagaagcccgccaggccgactccttgaaagacaagcaggaacttctgggaagttagtgctcgggaagccgccctccggcactgggctgacagaaacacatccaactccctttcccctggggtgggaggaccctgaggcgtgttcccgagcaggactgagtgccagggccctcagctgtgcctcgatgagaaatctccctttattggctgctttccctgccttatgtcacttcctcaatccccagccagtgtttcctggaatcacctcccaaataagactcttgaactagattcctaagatctgcttctggcagaaccctaactgagagagtaaatcgtgtctccatggcttggcttacaaatctataaaaggacataataatgtccaaatcgtaaaagcaacagccatatccacaggttgctgggtgagtcagctgccgtacgccccatggagcgcgtggcggggcgccgacaatgtggtggagctgggcccggacacccaaggtccctgcggtgcaggcggtgatgcctgcaagaacggtggccagtgttctggccttcagccagccccgttctccctccacagtcttccaattttgtgcctttgacatctgcctcaagagagtatttgcttttaaccaggcttatgttttcccctcctaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctggtgagacctgtgagaacgtggggctgggggaggcagctggggcctttggaggcagagagttaatggtgggaatccgcaggctggtttggactcatgattgtagaggaggctctgccccgtgctctgcaaggactgcgctcatatggcttacaacaggccctcacggacctgaagatctgtggcatccagtgactgttccattcacatcaattgaccacctcctgttgagccaacctactgttaagcacctgctctgtggcaggcaccatggtgtatcgggaagcactcaggatcagggatggagacaaggctgtgtcaccccggacctggcacgtcacccgtgacatctctctgtctccctcgttttactcaaagtggaagcagacagtacctgtggcagagctgcctatgggacagtgcaggaaaaggacctggaaccgagtgctccagaagtggccgctgctgcctgcagcacacttgctgtggtgcacgcacactgtggagcccagcacctcagccccttcccttctgttagccaccaggagggaagagcacttagcaatagcagggccacacagcgaggctaagtgtccaggccgctctggaagcagagacgcatgctcagaacccaccgggaggcttgcagaaggctttctggaggagggggcatcaagactaaagcttggggatgagtaggagtttgcccaataggggaggataagatggggcttcttggcagaaggaaccttggaggagggggcagtggtgtgcgcccacgtggaaatcaccatccccctgatgatacagaaacctttgactagcgtagccaagggcttactcaacatctgcagtccaatgtctggtgggcagctcacgtttacaaagaactgcagatcttcccccataaagctgctagtcccacagtcttgcccatctaagaaaatgtcaggaacacggaccagaggccctagagtctgacaacgcctcacctgtctgctgtggccatcctggctcaggccaccatcatccctggcttccgaccaagactttctatttccacacgggcccaccccaccctacccatcacagtctgctgtcagacatttagaacctagattagatcaagcacccctctgcttggaaccagtaagtcctctgccagtgaaacccaagtccctgcaacatccaacaaggcagaactcaatccggtgcacacgccctgaccaacctccctccctgggcctcctctgcccttggctccctcggtccagtcccagcttcatgctgaccctgaaccccaggcaggaccctgcctcggggcctttacactcatgggaacccctggctagttccctctttcttagacgccacatggtttgctctgtgacttccttcagatctttgctagaaggctcctcagtgacgtaattttctgattatcctcctggaaatggcatctccagcctgtccccagcacgcctcatccccacctgctttggttgaatccctgacactcactctaacagcgcccatgtgccccattcgcctctgcttattgccagtctcccccatccctcagtatagctgacacatgcagaagctctctctttctgatcttagatgcagtccccattccttaaattgtaccgggcacataggaagcatgcaacacaattttgttgaataaatgagtgaagaaaacttctaaatatactcctctgcatctaggcaattgctaacatttcctgggcctctggattggaggacagcctcaccttcctcaccttgcatttagaaccactaataatggtccattcattttttattttattttattttatttattttattttattttattttattttattattttattttattttattttttgagactgcgttttgctcttgtcgcccaggctggagtgcaatggtgcaatctcggttcactgcaacctccacctcctgggttcaagcaattctcctgccttagcctcctgagtagctgggattacaagcgcccaccaccacgcctggctaattttttttttttttttttagtagagacaaggttttgccatgttggtcaggctggtcccgatctcctgacttcaggtgatccacagcctcccaaagtgctgggattacaggtgtgagccaccacactcagcctggtccattcattttattgtcttaggtgttcagctcagggcacctgatatatcaaagagtatttgtttttaaaacaccaggggacaaaagggtaaatcccagtgaacttgtgccactttgctgtaaccaatgaatagtgtttgttctgcaagcacagcacaaacactctggccagcccttaagccaactgccttatgtcaagaagacaaatgtcagcacacattactcactttgtaacgtgcaaagcatgaggccagtgacataaatggggcatccctgacttgtgacacgtgcaggcacacgctagagagtctctcttacccactggcttccttatctattcattcattcactggctgtgctgcatgtacctgtctgaagtcaggatttgccttcaaaatgaactagggtctgaactctaccttgttttgtccttgccagtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggtaaggctggatctcttctcaggagcattctagaaacactctacctgccctgtgaaagccgatgcattatgcacgctgggttcttaaaagttcccttcttacatggaggcggaagcagatatactaggagggcgcaggagggaacgcataacttgagagatagtagctcaagtccgggagaggcctctgcatttgtggatgtcacccttgtcctttacatcttaagattgaaaaatgttttgttttgtttctcaaccacgtcttagttcctgtggaaatggctctgtaacgctgtgtgtgtgcatgtgcacacgtgttaggagttgggatgttgagtgggtagagagagaattcctgttgcagaggaagagctgggtctcactctgatcactgacctgaaaccaaaggtttttaatcttctgttaaactggggcctggtgacatggacaagatgtcatagtggctcttgcgtcaacatacctctgtgcggttaattaaatgtcctctctgatgaggctgggccttctggggttcttgatgatggcacgtttttagctgggagaggagagaattccaagccttgcaaggcctcagctggcagtcttccatttgtgcccagctgcccctcctcctggccccattatgagatgctcttctcatctgtgggtcttgcctgtaggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggtaagtcctggcctatttgtgctgctgagataagtgattcttcgttgtaatcatttttaaagactggttaaaaatgatttatgaattttccaactaggatgtgatctgatatctagcctgactcagtcattcccatttctcctccagttggagagattgggaggagggatctgagcaggctcaactaagctgcttctccttctctttctctctctctcttcctctcctctctctctgtctctttgctcctgcccatggatgcatgtgttcccagccatctgacactgcttataatgtgtaagcttcagggctcagcgagggaaagtattagatctaaggttctcaatttaattatcaagctggaaaggatttgatttggtatgtcggaaacctcccactcggttttgtggctggctgctaatagacaggaaagggttggccctaaagtgcacactttttcacattccatgcccatagttatgggccttctctgctttgtatcttatatgcctttgatttctccactcatccagcaacctaccaaagatgcgtgcacagagagggtgcatgcagagatggcagaagacaactgtgcctccctgaagggcttgctttaacaccctcctgcatggccaagagtggccttgggtctggattaacaactacacgcacagacccaagaggccacagtggtccctggttcactggagtctgtgcaagcacacaggccagaagtagtgcatgtgcacaccgtgatggagctgcagtgggtgttcccatggccccatgggctatgggctcacatactgcagaaggagtatgggctcacatactggagaaggagtatgggctcacatactggagaaggagaccacaggtgtggggacaggacatgaggcacaaggaagtttcataagaaagccacaggaaacacttgtagcagctcacggccatggccctggagtatccattggctgccacagacatggcctgcagaagcagaggtctcggtagctgctcactgaccttgtccggctcaccaatccaggtcattcttataatacacaatgctccctggtaacactacttgcttcccacagcccccatctccagggaacggggtgcctgagatcatcttcccatggagaaaggtttatgccacgcacatgtacagtccagcagggcttgcaattctattatttattatgaattatttcacgtgtgtacacactgcttggggtctgtgcacataggagaggcaatgggagagcgtctgagagggtcttgccagtgagagggtgtcttggtccattttgtgctactgtaatagataccacagactgggtaatttataagaaaataaatttatgtggctcacggttctggaggctgggaatttcagtattaaaatgccggcatctggcaaaggccttcttgctgagttatcccatggcagagggcagaaggataagacaggacaagtgtgaaagaagtatcaagaggacgctgaatttgcttttataacaagcccagtctcacaataactaactcattcctgtgataatagcattaaccattaatgagggcagagccttcatgacctaatcagctcttaatggtctcacatcttaataccattgcaatggcaagtcaatgtccagttgaattttgaggggatattccaaccatagcacagggtgtgcactcctaccgccatctggctgtgggagctgccccttgcttcacaaggtgatccttatctagaaaggaacgtgaatgtctgtgtcagccagtcaaaggtcggcggacaaggacccagaaggaagtagactgagctgggattgtcttactattccttttgttgttgttgagatggagtcttgctctgttgcccaggctggagtgcagtggcgcaatctcggctcactgcaagctccgcctcccgggttcacgccattctcctgcctcagcctcccgagtagctgggactacaggtgcctgccaccacgcccggctaattttgttttgtatttttagtagagacaggtttcaccatgttagccaggatggtctcgatctcctgacctcgtgatccgcccgtgtgggcctcccaaagtgctgggattacaggtgtgagccaccgcacccagcctcttactatttcagtgtgggatcagaggccacaccagattccatgctcaggagtgggcactctgattatcatcacaatccagccaaatactgttttgtagttacttcgtgcttagcattctccatgcatcatctcatttaatcctcacgatcttctaagttaggtatattgttattgataaatgagaaaatggagagagagagaggacacatgtgtaagtttcctctggacgctgttataaagtgccacaggttgggtggtttaaacaaaagaaatttcatctcttaaaagttctggggccgggcgcggtggctcacgcctgtaatcccagcactttgggaggccgaggcgggcggatcacgaggtcaggagatcgagaccatcccggctaaaacggtgaaaccctgtctctactaaaaatacaaaaaattagccgggcgtagtggcgggcgcctgtagtcccagctactcgggaggctgaggcaggagaatggcgtgaacccgggaggcggagcttgcggtgagccgagatcccaccactgcactccagcctgggcgacagagcgagactccgtctcaaaaaaaaaaaaaaaaaaaaaaaaagttctggaaggtagaagttgaaaccaaggtgttggccaggccatgctctctctgaaggctctgggggcagaccccttccaggccactcttctagcgtctgacgtccccagcagtacttgcttccatggcgggtaaggcatcccttacatcatctgcctctgtcattgcgtggccctctctgctgtgtcttctccttttatggatgccagtcattggattttgcgcctaccacaccccaatgtgacctcatcttacctaattatacctgcaaaatctctgtttccaaataaggtcacattctgaggtaatgggggttaggatttcaacacgtcttttttgggagcacgattcaacccataacaatatgtaatatacccaaggttacccatctgggaggtaactgtcttcagggtaaacttggggaagcatcccctctctgtgtgaggcaagatttgaattcttttcatagcagcaagaggacagttgaggattccgtgaggtggtttgaccaaaggattttgtctgtttcattttctctgtccaaagcaatgccatccacataattgcaattttttcagaacatggattgagaaatgcttagaggttcgttttgtttttatatgttttaaaaaaatgttacttttaacaatgaaaagagatcattccttatatattgaccagtgattagattttaaatctacttttctataaaacacaacttttattctttcctatctttgtggaaaacattcacatcaaagtgccacatcatgggtatgcatacatgtttgtatatcatagactatctggatgtttttaagtttcttatcgagatataattcatataccataagtgttgccattttgaagtgtacaattcagtggcttttagtatattgagaaggttgtacaatcataattccagaatgttttcatcacctccagaaaagaaaccctgtacccatgaacaatcagtccctctctctcacccccattccctagcaaccactaatctgctttctgtttctatggatttgcctattctggacatttcatataaatggaatcatccaatatgtggccttttatgtctggcttctacttagcatcatatttttgaggatcatccgtgctatatcatggatgggtaccatgttcctttgatggctgaataatacccccttgtagggatggaccacgtttagtttatgcacacatgagcttgagtggctgctctttaaagggtataaaagaaaccagttctccctggaggggaccagggaaatggggctcatggatggcaagaggttttttcatcatggtgttttgtgttgtttaaatttttacattgtttgtatgttacctttaagaaatgaaggaattgatgtttacaattcagtgttcttgtgaaatgcagggtgtggcatttgtgatatgaccagggcctcctcacacctctgcagcttgagattctcaccaaagcacagcacgttcctcacccaggagtagggacagcagcccaggtccccaagggctggccagtttcagctgggagatgggtgactggttccttgcaccgcccctccgcattcacaatccatgtgtccctcggcacagttatgaatcactccatagtggagccactttagggtgagggagaattaggttagcaaatgctaacactggaaacgcactgtctgcctgggtcctgcgaggctggcacagtgtcaacagctgtgtgtaggagacgtgattgcctggaacccccaagaatgcacctaaaaatcatcaaacaccatcagattacaaaccaatataaagaattgatagtttttctatggaagaatcaaaaatcactttggaaaatagaatggaaatcaaaatcctgtaatagcaataaaaactaaagacttggcctggcgtggtggttcatgcctgtaaacccagcactttgggaggctcaggtagggggacttgaggctaggagtttgaaaccaaactgggtgacatagtgagaccctgcctctacaaaaaaataaaaaaattaactaggcatggtggtgcatgcctgtagtcctagctacttgagaggctgaggcaggaggattgcttgagcccaggacttggaggctatagtgagccatgatcgtgccactgcactgcagactgagaccctgtctcaaaacaaccaaacaaacaaacaaaaataaaaaactaaagacttacataaattcagggacttttacactgagaagatccaatatagtgaacatatcaattctttctaatctaatctataaacttgatgtgatcccatcagaaaatttaattgtttagctaggaaagcagagttcccagatgagaaatgtgagagtagctgaaatagttctgaaaaaagggaagactgggcccgggggtatcagtcatcccagttattaaaacgtgtcataaagctgcaataaaccaaacagtttggcaggggtacaagaaaagagagccaaggaatagactgactgcatatgagaatttggtttacaataaaggagacaattagaattaggaaacgatagttactcatccaattgtgttagaacacctggcccaagaggcttaacctctgccctactatttactatcaaacaaatcaaaccatggttcaaagattaagataaaataaagctatgaaaggactagaatacaacacacattttttgaaagaatgataattttgaaggggaaaggatcttgctaagcaagacacaaaacttagaaatggtaaagaatggtctgtttgaccactgactacacaaaaattatacaaaataatctgtgtggcaaaaacaattacttcatttgagttccagagacagaggaccagggagggaggacatatttgcaacacacataacaaaggataaattctttaacattgagtgtgtacttttagaaatcagtaagaagaatgccaagaccctgagaaatagaataatgtgcaaaacacagtgacaccgtaagaaataaatatagaaatggcatgtgttgatttaaaaagagacccagtctcagtcacagatgcaaataaccacctagagatagtatttttcacctgtgccagcaactgagatcaggagtttaatatacatagatactgtttaccaaaggctgtcaggtaagctcacggagttttgttgggaatggaaactagtgttgtcttttttggagggcaaatctgtcaaagatgaaaatccatttactctttggcccccaactccacatctagaaacatgttcacgtgtgcagactgtggatgcaaagtctgtttcagcagtttttagcaaaggcatggtaatgacccaactgtttattcttgggaactgggcatataaatggtagtacatcctcctgatgaaatgtagcagtgtaaaagtattttgtatgtgtgctgatatggaacaattgctgaggtaaagaaaaattaagctgagaaatgtctgtgtagagatgtgtatatgtcagacagttattcatgcctcggacatacttagagatacagaagaaactcttcagggcatatgtctcagactcaagtagaacacagacttacctttctatccaatatcttttttaccagttgattgttttcaaccatgtatgtgacctacttttaaaataataaaaagcagttggctggtgacagttgacacacaactgtcaagtattcacttgaagaataatggaaagaaggtgagttttttgttttgtttttttctggagacagagtctcgctctgtcccccaggctggagtgcagtggcacgatctcggctcactgcaacctccacctcccagattcaagcagttctcatacctcagcctcccgagtagttgggggtacaggcatgagccaccgtgcccggccgaatgtgtgttttaaaggaaatgttattttgtctttcaaattagcagagaaagaaaaaaatggcattacccaatgctggagggggtaagtgccgatatcgtgtcaattgatctgaacccttgggaaaataatttggccatatggcacacgtgctttaaaacagctctattctttcacccagtaatttgattttagaaacctagagaaaaaaattttatttaaagacacattttaagtaaaatgaagaacattttacttatttttatgtccagtacagtcaaagcagccacattgcataaccccgggggacccccttcctctttgtgatgccccagaacaatattgatttgattatagaaagccaccggcagcctacatgcgcaacggtgagttgttggttatatacactgtggaccatacagtggaatattacagtcaataaaaggtatttttagagagaaaaaaaaacattggaacacgcttatgatataatgttaggcaaaatcgctgttatgaacagctcgtttggggcagagcaaatcctgggaagtaacactgaggctgttggtgcaggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtgagtgtgtctgcaggggagcgggcccacccgtgggaccagagccgacagcgtctcttggggaatcgagatctgacgtgtgcagagttaataatgtcatcgccctgggaacctccgtttccttatctgttaaatgggttgagacgctggcctgggctcctgtctgaggacaggagtgagcatcaaatgaggacatgcaagttccagggctttgcaaactgtagaggggtgtgcacccgtgagggtgggtggatcatgggagggacgcttaccaagctgctctgggcgctgtcctgcgtcatcttaagtaatcctgcccacccacgggaggtgctgtgatcctccttttgcagcccagagcagtgaagggcttagccagagtcacggctcagaaaccctcgggtctggccctgtggagcaaggtgttacccctggcatcttgcaggcagggcttccttcagatccgccctttcttcctttccttcctcccttgacgtttctgccctgtcgttccttattttccttgaacaaccttagcactgacctcaggacatctgtcaaagggaaggagcaggctctattcctaactttagagcaactcagaggagggaactttctcacagctgagagagactcccgcccgtggccaacatcttccccagccaggccctcccatccccatggcagctgctttccccatgagacagctgatgtttgccagaaaggccagcttcgtgtgtgtgtgtgtgtgtgtgcacgcgcacatgtgtgtatgtctatgcgtgtcatgtgtgcatgtgtacatgcatgcacgtgtgtatgtgtgcatatggggatgtgtgtgcgtgtgttggagtgtgtgtgtgtgcgcgtgtgtgtatgcgagcatgtggtgagctctgtgtgtgtggccatgtgtgtacctgtgtggtcctgttctttgtatgcttcctaagtgaccaattgagatggagaagtccagagaccttcctgcattcccaggctccagcccggactgggaggctctgcatctggttttggtctctccccagcttccataaggtgtagcaccaggtcaaagacaccaagtcgcacagatgctttgcactggatggggaaacaagggatggggtggaaacaagtcagatccgagacaaggccaggcacaggcagcaggccatatgaggacaaggggactcatggaaatccctggctgggacacccactgaagaggcagacacaccccttggctggcttcatttccttcttggtctgaagctgaggcctgcggttaacagtcagcttccgtgagggcagatatctgaccccaaatgccaagacagcaatttgcaggagcaataggatcggggggtcccattgcacagggattccttcatgcctgcaggagctagaccaggtgaaggagagacctgcatcagagcctgcctctggccacctgagcttcagggagtgatgaacggcctcacccaggaagcaatgccacagccacagagaatgcacaggatacagtgaggcccagggagtcggggagcagggctccagggacagaggggagggccgttgacatgatgtgcaggtgctgggtctttaaacttggtgctaaaattaaggcttcctcctatggagagacaggagcccagagctgggggtcagggtgctatcacctgcagagaaggagggagccaggcctggggtcagggcactgtcacctgatatggaggatgaagccccgtgttgggttagggcactgccactgactcatgctgggaccctgtacaggtccctgaacacatgctgttctccagtgcctggagcaggtgccctcccaaccttggccatccctgaggtcacctgggctgctgtcagcagttcccagcaggctgacagcctcctgcctggaagccctgctgctttcagggtctctgcccccacaaccctttcccagtggggctagggctgtggctccattgccctccttcctcgtcctcctgcaggctggtgtggaggtgtcctccccacagcatccccagccctgccccccatagacctggcccactccttgtccctctgtactgagttttctccctccctgtctcagctccccactccttccccctttctggaaccatctcccaacaaactatctgccccccgaatctttgcctcgctgttgacttctacaagaacatacatgaagatgggcccgttgctgctgccttgtctgggactcaggggtcctttccgggggtgggtaggtggtagtgtcaggcaaagtgacttctctttggaagggatttggggtcctcctgcatgaagctttgtgtgtatgagtatgcgtgtgtgtaagtgtatatatgggtgtgtatacctgtatgagtgtgtgtgtgggcatgtatgcatgtgtatacatatgtgagtatgcctttgtgaagatctgtatgtgatttaagtgtgtgtgcgtgttcacgcgtgtatgctactgtgtaggcctgttttgttactgcatgtgcatgcatatatgtgtgcatgactgcatgtatgtgagtgcgtgtgcgtggtgtgtgcgtctgtatgtgtatgcatgtgggtatgtagatgtgtgtgtatgcatgcttgtgtgtatgaatgcctgtgtgcggctgcatgtgtgtgaagtgcacctgtcgtgtgtgcgtgttgtgtgtgtgtgtgcatgcacatttgaagtgacctcaggtttctctctcgcccgcagggctctgctttatctgcccagaagggcacacatgcacagtgtcgatcaatcacactctcccttcctctgtttaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtaggaaagagtggtggcccaggctccccacaattgcagcagttcaggccgagtccttcctgctgcttctgaggaaatggacacgtggccttggacactagatgaagaagcagggaagggagtgtgccccacccgagcctgctctcactggtggggcagagtgggctggcatggtcaccaagcagaggggggtccatgttaggggggcaacatggtggtacctgatgtgggtttacaaagagaggtaccaaaattgtcccagtgctcatccttacacacatttggggacactttcacactcttcctcatgaaagtaaacatggagtggtggggatgaacaagagatgggagtagctgccatttgcagggcatgtgctctgtgtaagtctttagcctgttcacccactgcagtgtactaagcactttcataacccatgattttattttatcctcactactccataaagtaacattataccctatttatttaaagaggaaacggaagccccaagaaatccagtgtcaaaataccaggacttggtgctcaacaaatgtgtgggaacaaaattagatgttgacctgatccctcctgactttcttaaggtctcagggcagtgtatctgtgatttggtgagatggccacatgagggcaggcacgcacacgttgagaaagttgaactggaattttgtcctgcaaactctttgaggcgttgcatgggttgcacaccgtgctgggtactaagagtatggtgattttttttcttagaaggccggatagtaaatactttaggctttgtaagctaagaggcaacatctaggatgtcaacatctaggatgttatattcaatagccatttgaaaatgtacaaactattctcaggtcatggatcgtacagaaacaggcggtgggccggatttggtcaatggacccgtttgctaattcctggtcaggaaaggcgatatgcttagcaaaagagagagtggaaggggcaaagagagagagagagagaggatgacgtgtgaattcagattgtgtggtggcagaacctcttatccattcaggaagtgtctgattcagtgattatgccgaggaggcatgaatcaaggaggcctccccattcatctcactctccataagactttgatggaagagcttccagtgtttcatatttttgcacaaaatggaccctaaatagaatgctaaaagtcatgtgatgctcaatcagcaaaccagggattggcttcatcctgggaaaaagctatctgggtgcaacaagacacaagctctcaaggagtttgcaaactggaccactgttctggagttatgcaattaaacactgcacaattgcaattaaacatggacagaaaatcctcctccccgttgttcttagaacaagaataacaatgaagttaaaagccacctggaagggcccctcctcacccttgttctctcagtttcactcttagtcctcctgaggcccacagcaccactgctgtcagccagcctcttggcaggttgataggtgacttcatttggtaccaacaacacagatgctttccaacatcataacaacctcacagatgccctttttaatatctgcgtatgttacgttatagagctgtaccatgagttagtgtctgttttcgtccatttacattgctataaaggattacctgaggctgggtaattaaagaggtttacttggctcacggctctgcaggctgtacaagcagcacggtgccagcgtctgcttctggtgagggcctcaggctacttccagcatggcagaaggcgaaggagagctagcgtgtgcagagatcacatggcaacagaggaagaaggcagaggtgctctttaacaaccagttcttccgagagctaatagagcaagaatttactcattactgtaaggctgacaccaagccattcatgagtggtctgtccttcatgacccaaacccctcccattaggccccacctccaactttgggatcaaatttcaacacgaagttttgggggacaaaagtccaaaccatattagtgtccttttttccagcaggtattttcaaagtacagacatgcaaccagcaaggtacagatggttgtaaggaaaaagttactaagtgctaggcctgattccaggcctttaggggagacttgtattgcaagaagacatattgtctaccagtgaaacaatgggagaaaagaaaagtcactactgtgaaccaaattcttagtggcttacatagacaaatcatgtaatgttggagttggaaggggctcatctagtctactgttcttattgtgcagaaaaggaaatgaggccaagggagtggggtggtgtcttactccaaattgcccaaattcaaggcatgattagcactgaaacttgagtctccttcctgttgcaggtgacaactacctggggccagtgttctgcagctagtaaaaaaaattcaccaagacagttgtcggtaaagaaagtcagatgtattagaaaaagtatgaaagggtacagtgggtaggtcagcaagaaaggagccgactgcaaggaaacaaaggcttgctggagattttataggatggtgcttgtgctgtgtgccgaagagggctttgtgcagtactgataatgctgtggttgcagtgagctaacttacttacgtttttctgttagctgaggatctggtgataagttgagtacaggaaggctgtgttgtagaccatgaagaaaggcagacttacagcttatttgctttctctttttgattttcctcagttccgccggctcaacttcccctccctgataaggactctatccttcccacctttcagcattatccacccttcatgatttactcatttaataaatatttgttgagctccaggcactgggtttgctgctagaattttacatctttatgcaagagaataggtaaaagtagaatggatggttggttttgaaagattaaaattaagaacctctgcacaccacccccccccccttcagatccacctatcgccaatgagggaagtaaatccagcttgcggagttcacatgcacatgcacacacatatgcacatgcatatacaaatgtgtacacacacaatatgtaaaatacctttggagtgtgggacagtgtgcctaagatcatgggctttgaaaaccaaccagtttgggcttcaatcctggcttccccacccaacacctgtgtcccgcaagacacgtggcctgaacctcaaattgctcacccgtaagttgggagtacaaacacccccttcatagtatgattgtgtgccctaaatgcagtaacatgttaaagcaccaaatgtgcgcctgcacacagtaggcactcagtaagtgtttgatcacctgtctcaggaatgtcggattttactggggattttgacaagaacaccacaaggtggtcagggctgaaggtggggggagcccagggactgaggggcacagaagagggagcagtggactctgtggaggccagggaggcttcccatggctggtcctggactgagccctgaatgaaggtgggtccagtggagtgcatggcagagtacatggcctccaggagcagcgtggaactgatgctaacagatcccatccagcagcgattggcgctctctttcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactgacctgactagggcactttcatttcagtggtggtgtctggattgggtacgaatgcttggcagtccccccgcgtgataacgaatggtggtggctgcttcctgaggactcactcttggtagagactggtggatgtgggggtgggaggagagattcagttcatgacttctgaaggctgagttcctgagacccaaggaggcgaagagagggaagacggctgatgggcgggcttccacaaaataggctcaaatcttgcattgattccctcctgttgggcctttcctggctctctttcttcttgtattgtatggatcagcctcagactggaagctccaatctcctaaacttcacatttcttccttccatttccatgagctagagatacactaaaggacggataaaaacagcaggcaaagttgcttgcttccattagctgttgttagtaatagtgatgacaatgatggtggtgacagtaatgatggtggtgatggtgatgatggtgacgatagtggtgatgatgatggtggtgttggtgatagtgatgaagttgctggtaatgacaacaaatacatgggctgatagctgtatagcagttgctatatgccaggtgctctatgaggtagggattattatccccattgtacagatgaggaaactgactcagagtgagatcaataacttgtttaggatcacacacttaggaagtgatggaaccaggatttgaatccaggacccaggcactttgggccctagtccaaagctccttgctcctaattactgagctccaagggcatttgaggcagatggctttggatgctctggtcccacatcaacgcagggcttttcatgtacccttctcctcccccgctcctcggcttcgtgtggatacctttgtcaaggttgaaagaagtgttggctcagggtcagttatagacttccttgaaacaaggttaactaactactgagaaagaccaagaatggatggtaaggatttttggatggaaagaccaagaacggatggtaaggatttttgatgttcggctttggcccatttggactattaaagggaaacttccagaaaagtaaagttggcaggatgaagttatccagcctgttctctgggcctggcctcctcagtcctgtcagggtggaagtggaagcagaagcagccctagcaccttctctaagacagactctgacggggtgcttgcctgactcccaggtcatgggagccactgtccaaccagcataatctagagcccatgtcgaactttgggttccccagcgcctccaagaggcacagttaaaggggacaggagacctggtagctcagataatccttagttcttggagactgagctgcaacactccttttaaggcatgtgacttccttttacctcttgagattttgggaggagggagagagagtttctcagaaagttttaggggaaggctattctcattcattcatctgcaacccaattctcccagccatgtgacataacatactcacaggcccagggattaggatgtggtcatcttgttggcagggacggggagcgttattctgcctaccacagtagtcttctgggttttttctagaagttttatctttcacatttaggtctctgagccatctctcaataatctttatgtacaatataaggtaggactgaaggttctccatttcccatatgatctcccattgacccaacaccatttattgcaaagactattctttcccccattaagatgcagtggggcctttgttgtaagtcaggtgattgacccttctgattcagtggtccagaagtgtgctgccaaatcaatgttgaacaatgggtgaaggtgggtggggtagaaagcccttgtttgtagtgtttgctagttctgtggaccccacttctgttaccgattttctgtcttagtccatttggcatcactgtaactgaatacctgagatggggtaatttataaagaaaaggaattcatttcttacagactttgagactgagaagtccaaggttggggtggtgctggtgcatttggtgagagccttcttgctggtggggactctgcagagtcctaaggcagtgcagggcatcacatggtgagggggctgagtgtattggctcaggtctcgcttcctctgcttataaagctgctggtcccgctcccatgataacccattaatccactgactcactgatacattaatctatgaatgaattaatccattcatgaagggagagccctcatgacccaatcacctctaacaggccccacctttcagtactgccacattgggtattaagtttcaacataagtctcttgccatggccaatttcaacctatcgacattaagtaaatgagtttggaatccagaccacttaactgttggctctgatgtcccaggaaggggtggttctggcccctctgcatttgttggtgtattagtctgttctcactctgctgataaagacatacccaagactgggtaatttataaagaaaaagaggtttaatggactcacagttccacgtggctagaacttcacaatcatggcagaaggcacgtcttcatgatggcaggcaagagagagaatgagaaccaagtgaaaatggtttccccttctaaaccatcagacctcttgagacttattcactaccacaagaacagtatggggggaaactgcccccatgattcaattatctcccaccaggtccctcccacatcacggaattatgggagctacaattcaagatgagatttgggtggggacacagccaaaccacatcagttggtttgtctatctttgcctccagattgcatattgactcttaaaaagtgagacagaatgggcaaggtctttgcacatacttttccttcatctacgtaaagccaaaccattttcagatgtcaccagtagggtctaccatgttctagcccccagggttggtctggccaccttgatcatagacagtggacaagagaaggtgctacccttatcctggggccaaatctctatagactcaacagagctactcttctgacgtaagtgcgtaaccctcctctgtgttactctttccaaggcagagtgtggccgtgatgcccattgacagtgtcatttgcctaaaggttcattccaatcaagtccatttatgaagtgaaaaaccatgaaaagaagtttcctaagcaaaaggggctcttagcaagttgaactttctatttttctcttagtgcagacctgcagagattttagaggaaaagacacaggggccctggtgcacctggcttcagagtaaagcctctcactggtagtctgttcccaagaggaggaaagctgtggcatggctgtgcgtccagagtccatctgggaattttctgggagatctatcaaaccacttaggcagcctggctatccattatgcctggatgtggacttcaaagtctttccctatcagacgggagccaaacaccacgtgggtagcttggggtcccagcttgcaatggacaagagccccgacacggtgcaggaagcctctatagccactgccctcccccatccaggccactgtatttggaaggaagaatgtcgaccaggacctccatgactccagtttcatagcaaaaaagaacactccgtatcccaacgttcacttgtagccatgtgggcaaatgcctggtgcaggggatttctcctgggccaggcggccctgtgacctttaggctggggcctcagcctcactgattccttctcccaacctgccctgcctttgcccagagcatgacggaggcagctaagtggtttccagagaaaggagaacatggacaggagtcagttctctagggttgcctgggcccagagttctcaggaggttgaagggtcaactaagcctgagacggcaagtgccttggtccacgtcctctgagacgcagacactgagccaggattagatgtgggcaagatgtgtactgggggacatatctgtgaggcaaaatgaggagagagccagaggaggcagagcccacagatttgcgatgcagctgacagccccatgatggagggagagagggaggggagagaggggagaagggaagggagggagggaagggagagaggggaaggagggagggaagggagagaggggaaggagggagggagaaaagaaggacagagggggtaaggaaagaagggagggaggggaggaagggagtgaagagagggtagaaaggagggagggaggcaagactctggtgctgcacagttctacatctcagcaggtagagcaagaagtcctggggcccaggctgtcctctggaggagccctgtcatgtgggctaaggaggcctccacatccctgcctcttgcaggcactgggagcaccctgcaggaagtgtggcctccatgctcacgcagggaaggatttctgagcacggcaggaaatcccaaggatgttggtcgtttttgctccttgccgttggggacccaagaggtacatgttcatggccaccacagccagaacaaggcggatgaagagctcacctcagactaagtccagcggctggactgcaggctatgtcggtgggcaggaggtgcatcaggaagtggaccaagtccatcagcgggagcccagtggggaaaaaacagatccccaggcctcctgtccaatctgctgactcagaatctctgggatggggctaagaatgttgtttttaatgagcccctgggtaatgctgacacacagccaaatctataagccatggggggaaaatagtattcctggcctccctccctccctccttcctttccaatccatacaccacaggaggaaagtatatactcagcgttcctccctcccttccttccaaaccagttgccacaggaggaaaggaatattcccaggcctccctcccttccttccaccaggtgaccatgaatgcctgttatatgccaggtggcatgtggccggtcaatggtgtacattccaggggggacgtcaggtgcgaatcaaatgattactcaaagcaccgaactgcacactctgttaagggctatagaggaaacatttaggggagaataatcccatctcccactcctctggtttccatagagggaggggcttccactctctgggggacagcacaagggacttccctggcccctctccctctctcttttattcttctctggggaggaggagaaatacctgattggccagtctgggaaggatcactcccaagacagtgcctgcctctggatcgattcgttccccctataaatcacgctttaccctctaaacggccacatttcccccatttcccgtctccctatgagggtgtggaagcacctggacctcactggtttgtggggtcatcactctcctgcaattccccatgccatgcacgttacgttggaatgcttttctttttcctattggtctgcctttggtcaattgtttctcaaggagccttcgtagggtggaggaaaagcttgccctctgtgccccacagctgattcactgtaaagctcatggagctcacacttctgccacctgtgcacagaccccaccgagacccgggagtgggcttagccacgggttcactgacacattccttacagtttacaatgccacagtcagatcttttagctgcaatccttaagaccactgttccctttcctgctgatgccactgcatatcaggtgacactagggaggcctgggacatttggaggatctgggtaagggccagttgagttgggtttagtgggattgtttatgtgggtctcactgtacacctctgtgtatagtgatgaacttggacaagaaataaaggaaggttatttatatgctcccccaccgacctcaccccagtcccagcagcaaagaacacaggacctagaatctaaggggggccctgatgttgttcagggttgggggcagagggggatctctggagatgtgagtcctgactccatgtgaggagtggctaggagccactgggcagagggctggggaggggggcaggggtcttccagaaagaatgcacatcatgagcaaaggcccagtggggggcaggggtgtggcccatgtgaggccatgagagaagacagggaccaggtgcagagtgaaggggaagggcatctgctaggccgcaggggtgggctcagcctagacctctctgagcctcatggtccatggtaaagatctggctttttctcctaagagccagggaacgccgcccataaggccaggcagatttgcgttggagaacatgtgatgggcggatggcaggggcaggagaggcttctgtggcaacagcaagatcagcaccgccctggccagggcctcagaaggaatgtggtgcagaacgtgacccctggttggccaggagggtcctgggagagtgcactcaccctgggggagtacaaaaaaccgtgctggcttcatcctgcggtctcaagtacaggtcagagggtgctattttcaccaaagaattaaatcatgagttcatcataatacatcatctctcatggtccccttccaaatccacatccatccatcaccataacagcccacagcccataataagtggggatggtaaccaaaatggaggcagggtacctgcgaggcatcctggggctgcactgctgatcctcttctctctcccctggccctgagtgctgccttcatgtggctcagcccttccgtccttcaagccttcatcagcttcagggcagccccgagtctgtgcccaggtacactggctaaaatgcagtgtcttccaaatagccatatctcattttaatcagggagcaattccagcatggaagtccccatcatgctcctgctggcaggtacaggtgccagtttgtgacggatgaaagcaccgacagcccacgcgtcttcatcatggaggcctgtgccccagactgtgcccagcacaacagctgggcggcaagggtgggccagggtcgagcaaatgacacgttccctttggctaaggaagacaccccagaagcaaaatgctccatgcgacagccaggcattcaggctacaagctcggtggcggggaggcagccgggagccttctcagaggagaagggtcccgtgatcattccacagatgctttcagagctctgggctcagggtaaccgaccaattatggtgctgccagagggcctgcatttactatacacacgtcacaaaatcaggcttccccgggaggagccatcggactctgtgcagagggcccatgtgacaatataaaagtgatttctggccgggcgcggtggctaacgcctaatctcagcactttggggaggccgaggcaggtggacgatgaggtcaggagttcgagagcagcctggccagtatggtgaaaccccgtctctactaaaataaaatacaaaaaagatttagccaggcgtggtggcacacgtctgtagtcccagctactggggaggctgaggcaggaaaatcgcttgaacccgggagatggagattgccatgagccgagatcacgccactgcactccagcctgggcaaaagtgatttctatgcaaagcaggttttaagaatattgcaccaaggaagccatagctttgcacaactccatggaataaccaagttttttagtgaaccacaagagggagctgttggttaactttggagagcccactggctgatgggtgaggaactgaaggaagcgctctgatgattaagttttggccactgggaaggagtcacttgtttctaagagagtctatttcaggttttaagaaatgaaaagtcacaaatgaccctgaaaattcctgagataggggctcccagagccagagggctcactaggttctggggatttttggacgtatccacggctatgtcctggattagaccagggcaaggcaccctttgactcagcacagtgggtgataaccccatggacacggggcagtgtctggagacatccttggttgccacgaatggtgggagtgctggcatctggtgggcagagaccagggacactggaacatcctgtgatgctctgggcagctccttcccctgaagaatgatctcgcccggtatgttcacagtgctgagggtgacagtccctaacctccatcaaaggagcaattttccctccaggtgggaacggcctctcctggctgtggtgagaggggctggtctggaagtttctctccaggtgggaaaggcctctcctggctgtggtgtgaagggctggtctggaagcttctctccaggcaggaacggcctctcctggctgtggtgtgtggggctggtctgaaagtttctctccaggcagaaaaggtctctcctggctgtggtgtgaggagctg

SEQ ID NO: 8416 - DNA, 692 bp, Homo sapiens
tttgaaagaatgataattttgaaggggaaaggatcttgctaagcaagacacaaaacttagaaatggtaaagaatggtctgtttgaccactgactacacaaaaattatacaaaataatctgtgtggcaaaaacaattacttcatttgagttccagagacagaggaccagggagggaggacatatttgcaacacacataacaaaggataaattctttaacattgagtgtgtacttttagaaatcagtaagaagaatgccaagaccctgagaaatagaataatgtgcaaaacacagtgacaccgtaagaaataaatatagaaatggcatgtgttgatttaaaaagagacccagtctcagtcacagatgcaaataaccacctagagatagtatttttcacctgtgccagcaactgagatcaggagtttaatatacatagatactgtttaccaaaggctgtcaggtaagctcacggagttttgttgggaatggaaactagtgttgtcttttttggagggcaaatctgtcaaagatgaaaatccatttactctttggcccccaactccacatctagaaacatgttcacgtgtgcagactgtggatgcaaagtctgtttcagcagtttttagcaaaggcatggtaatgacccaactgtttattcttgggaactgggcatataaatggtagtacatcctc

SEQ ID NO: 8417 - DNA, 910 bp, Homo sapiens
ttttgttgttgttgagatggagtcttgctctgttgcccaggctggagtgcagtggcgcaatctcggctcactgcaagctccgcctcccgggttcacgccattgtcctgcctcagcctcccgagtagctgggactacaggtgcctgccaccacgcccggctaattttgttttgtatttttagtagagacaggtttcaccatgttagccaggatggtctcgatctcctgacctcgtgatccgcccgtgtgggcctcccaaagtgctgggattacaggtgtgagccaccgcacccagcctcttactatttcagtgtgggatcagaggccacaccagattccatgctcaggagtgggcactctgattatcatcacaatccagccaaatactgttttgtagttacttcgtgcttagcattctccatgcatcatctcatttaatcctcacgatcttctaagttaggtatattgttattgataaatgagaaaatggagagagagagaggacacatgtgtaagtttcctctggacgctgttataaagtgccacaggttgggtggtttaaacaaaagaaatttcatctcttaaaagttctggggccgggcgcggtggctcacgcctgtaatcccagcactttgggaggccgaggcgggcggatcacgaggtcaggagatcgagaccatcccggctaaaacggtgaaaccctgtctctactaaaaatacaaaaaattagccgggcgtagtggcgggcgcctgtagtcccagctactcgggaggctgaggcaggagaatggcgtgaacccgggaggcggagcttgcggtgagccgagatcccaccactgcactccagcctgggcgacagagcgagactccgtctcaaaaaaaaaaaaaaaaaaaaaaaaagttctggaagg

SEQ ID NO: 8418 - DNA, 327 bp, Homo sapiens
aagttctggggccgggcgcggtggctcacgcctggtaatcccagcactttgggaggccgaggcgggcggatcacgaggtcaggagatcgagaccatcccggctaaaacggtgaaaccctgtctctactaaaaatacaaaaaattagccgggcgtagtggcgggcgcctgtagtcccagctactcgggaggctgaggcaggagaatggcgtgaacccgggaggcggagcttgcggtgagccgagatcccaccactgcactccagcctgggcgacagagcgagactccgtctcaaaaaaaaaaaaaaaaaaaaaaaaagttctggaagg

SEQ ID NO: 8419 - DNA, 692 bp, Homo sapiens; identical to SEQ ID NO: 8416

SEQ ID NO: 8420 - DNA, 832 bp, Homo sapiens
tctccaggtgggaaaggcctctcctggctgtggtgtgaggggctggtctggaagcttctctccaggtggtaaaggcctctcctggctgtggtgagaggggctggtctggaagtttctgtccaggtgggaaaggcctctcctggctgtggtgtgtgagaggcttgtccggaagtttccaggcgggaaaggcctctcctggctgtagtgagagggctggtctggaagtttctctccaggctggaaaggcttctcttggctgtggtgtgaggggctggtctggaagtttctctaccggtgggaaaggcctctcctggctgtggtgagaggggatggtctggaaatttctctccaggtgagaaaggcccctcttggctgtggtatgaggggctggtctggaagtttctctccaggtgggaaaggcccctcctggctgtggtgtgtgaagggctggtctggaagcttctctccagatgggaaaggcctcttctgggtgtggtgagagggctggtctggaagtttctggatgctctcagcatctatcagggagagcaggtgcccccatgacatctctctgcacgggcagggtgtctactgtccggaagaagcccctccccaggtgaagtgagggttgggccacaccctcttcctcatattctaagtgtcctcagagaatacatttctgcaggtgtcattatgtatctgtgtgtcctcagccccagatgggcccagacaggcctttgggccagggattccagagtctgcatcaggggtccttggcctgaggctcggacccctcaagacgtccctccttggggagaaagatccatgaggc

SEQ ID NO: 8421 - DNA, 16422 bp, Homo sapiens
tttttttttgttttgttttttgagacagagtctcgctctgtcgcccaggctggagtagagtggcataatctctgctgactgcaacgtcctcctcccgggttcaagcaattgtcctacctcggcttccccagtagctgggattacaggacactgcaacgatgcccagctaatttttgtatttttagtagatacagggtttcaccatgttggtcaggctggtctcaaacccctgacctcaagtgatccacccgcctcggcctcccaaagtgctgggattacaggcatgagcgactgtgcccagccacaatgaacaactcgtatcagtgtagcaaactgtttactagccaaattggcagatgctagtcaagggctaaccttgcaatcagatctttctaaggataatagtctcagtctcttctgtacaaagacatttaagagaaagtcgttctccaaagacatttaagagaaagtcattctctttttttttttatttgagtcaaagtctcgctctgccacccaggctggagtgcagtgtcgcgatcttggctcactacaacctccgcctcctgggttcatgcaattctcctgcctcagcctcccaagtagctgggattacaggcgcctgccaccacgcccggctaaattttgtatttttggtagagacaggtttcgccatgttggccaggctggtctcaaactcctgactgcaagtgatctttgttttttatgacgttgatgtcttgatgagttctttagttggggtttgcctaatagcttctcatgattcgattcagattatgaatttttggcagaaataccacagaggtgacttgtgtctttctcagtgcattacgtcggaaagcacataataccaatttgtccctgtcctggtgacgctaaaggtgacttggttaaggtagtgttctccattataaagttaccctaatccttgttataattaaaaagtaagcctgggcaacatagtgagatctcgtctctacaaaaaatttaaaaattagccctctgggccgggtgtggtggctcacgcctgtaattccagcactttgggaggccgaggcggggtgatcacctgaggtcaggtcagggttcaagaccagcctgacaaacatagtgaaactccgtctctactcaaaatagaaaaaattagctgggcatggtggcaggcgcctgtaatcacagctactcaggaggctgaggcaggagaatcgcttgaacccaccacacctggctaatttttgtatttttagtagagaccgggtttcaccacgttggtcaggctggtcttgaacccctgacctcaggtgatctgcctgccttggcctcccaaagcgctgggattacaggcgtgagccacagcacccagccttttttttttttttttttttttttttaatagagagtcttgctctgtcgcccaggctggagtgcagtggcccgacctcggctcactgcaacctctgccttccaggttcaagcgattctccttcttcagccttccgagtagctgagattacaggtgcccgccatcatgcccggctaatttttgtatttttaatagagacggggtttcaccatgttggcccggctggtctcgaacttctgacctcaattgatccacctgcctcggcctcccaaaccgctgggattacaggcgtgagccactgcgcctggccaatgatgcttgcctaaaacaattattacagtagtagttgccaaatagttattttctaattccatcattccttgtacatttattagttggcattcctctgtgaggaagagttttcccttcgcctccatttatttatttagatcactttggactcttgtattcttttttaattcaaattctttcaatgtgtggttaaaacaagatgttccaggctaatcttgtactttccttgccccagccctgcaatcagctatttctctaaggggccctggttcctgttagtggaaaatggtaattaggcaagagaaatcaattacagccagtgtgactgattggaaaagaataaagatatccctattttcagatgatatgattttgtacctggtaaaccctagagaatcaatgataaaacactctaacaataaaagtattcagtaaaatggaaggatataaaattaacatagagaaatcaatggcttttgtatatatcaacaataaccagtgagaggatataaagacgcatagtggctcacatgtgtagtcccagctacttgggaagttgaaatgggaggatggcttgagcccaggagttcacggctgtagtgtgccatgatcatgcctataaatagccagtgcagtccagctggggcaacatagtgagatcctgtctctaccgaaaaaaaaaaagagatacaatgatagagaaaacctcatttacaatagcatccatagcatcaaagaaaataattaggaagaaatctaacaagaaatgtgaaaaaaatctatgtgtggaacactttaaaatgcttctgtcaaaacccattgatctttacgatataaaaaaagtttgttaatgtatgcaaaattttaaaaaaagcaaccaggaggtcagggaatccagtatggaatggagactgtgacaacataatttatatattacaaatgtaggcaagggccgggcacggtggctcacgcctgtaatcccagcactttgggaggctgaggtgggcagatcccttgcagccaggagtttgagaccaacctggccaacatggtgaaacctgtctcaccaaaaatacaaaaattagacgggcatggtgtcacgtgcccataatcccagcaacttgggaggctgaggtaggagaatcgctagaacctgggaggcagaggttgcagtaagccaagatcgggccactgaactccagagcgagacttcatctcaaaaaatcacacacatacaaaaaaaaaccaaaagtaggcctagtgtggtggctcacccctgaaatcttagcactttggaaggcagatgtgggtggatcacttgagcccaggagtttgagaccagcctgggcaacatagtaagacttggtttctacaaaaaattaaaaaaaaattagctgggcatggtagcctgtgcctgtagtcccagctacttgggaggctgaggtaggaggactggttgagcccagaaggtcgaggctgaagtgagccgagattgcaccactgcactccagtctggatgacagagcgagaccctgtctcaaaaaaaaaaaaaaaaagaaaaagaaaaggaaaaggccgtgtgtggtagcttagctcacgtctttaatcccagcactttgggaggccgaggcgggtggatcacctgaggtcaggagatcgagaccaggctggccaacatggtgaaaccccatttctactaaaatacaaaaaattagctgggtgtggcggtgtgtgcctgtaatcccagctactcgggaggctgagacaggagaatctcttgaacccaggaggcggaggttgcagtaagccgagatcgtgccattgcactccagcctgggcaacagagcgagactccgtctaaaaaaaaaaaaaaaaaaaaagccgggcatggtggctcaattctgtaatcctagcactttgggaggccgaggagggcggatcacctgaggtcaggagttcgagaccagcctgaccaacatagagaaaccccgtctctactaaaaatacaaaattagctgggtgtggtggtgggcacctgtaatccaagctactcgggaggctgaggtgggagaattgcttgagcccaggaggtggagggtgcggtgagccgagatcgtgccattgcactcaagcctgggcaacaagagtgaaactctgtctcaaaaaaacaaaaaacaaaacgaaaaaaaacttattggccgggcatgatggctcacacctgtaatcccagcactttgggaggcagaggtgggcggatcacctgacatcaggagtttgagaccagcctagccaacatggcaaaaccttgtctctactaaaaatacaaaaattaggccaggcgcagtggctcacgcctataatcccagcactttggaaggctgagacgggcggatcacctggggttcggagttcgagaccagcctggccaatatggtgaaaccccgtctctactaaaaatacaaaaaaaaatagctgggcatggtggcgcacacctgtaatcccagctactcgggaggctgaggcaggagaattgcttgaacctgggaggtggaggttatagtgagccgagattgtgccactgcaccccagcctgggtgacagagtgagactccatctcaaaaaagagaaaacaaaattattttgtagagacagggtctcactatgttacccagactggcttaaacttctggcctcaagctatcttcccacctcggccttccaaagtgctgggattataggtgtgagccactgtgcttggcctatctctgctttttttttttttttgtagacggagtttcggtcttgttgtccaggctggagtgctatggcacgatctcggctcactgcaacctccgcctcccaggttcaagcgattctcctgcctcagccctcccaaatagctgggactacagccgtgtgccaccatgcccagctaatttttgtatttttagtagagacggggtttcaccatcttggccaggctggtctcgaactcctgacctcatgatccacccgcctcggcctcccagagtgctgggattacaggcatgagccaccgcgcccggcttctgcttttctttgtttctagtttctctctagtaaagtgcatgaaatgtactaatcttaagtgtacactcagtgaatcctctcttcgtctctctcttttttttctctctctctccccgccaccatagccaccacccagatcaaagtataaagcacttttagtaccccagaaggtcccctttaccccttcaaagtcagtactcccccagaagtaaccattattctgatctctagcaacataagattcatttcgcttgttctttaacttcatataaatggaatcagctgctctttgtctctgacttctttctggcagcactatgtaagtttatccacgtggcagcacagatctgttctcttactgttgtgtggtattccattgtatgaacataccacatttacccattctcttcattgtttttctgtttgaaatttcctctctcttcctggttctcttcccacctccctccctgtttccctggaactagggggctcataccctgtccctggcccctggggtccctttcactctacttctcatcaccactactttctccagatccaaacagcaaagacccaagaactgaatatgctccgggaacagaccactgggctggcagctgagttgcagcagcagcaggctgagtacgaggaccttatgggacagaaagatgacctcaactcccagctccaggtaacacctttggctctggcctgtctcttcctagttccctagtaatggcccagtgaagtccccagtaaggtggagtgggaagactggagtcaggaggacctaggttccagtctggctccctaacttattagcacctgtgtgttctgggacaagtcatttcacttctctgaaactgagcctcttcagttagttaggatatcaattctttttcattttttaaattttaatttaatttaatttttttttgagatggagtcttgctctgtcacctagtctggagtgcagtggcgtgatctcggctcactgcaagctccgcctcccgtgttctcgccattctcctgcctcagcctcccgagtagctgggactataggcgcctgccaccatgcccggctaattttttgtatttttagtagagacggggtttcaccgtgttaaccaggatggtttcgatctcctgacctcgtgatctgcccgcctcggcctcccgaagtgctggtattacaggcgtgagccaccacgcccggcctccttttttttttttttttttttttttgagatggagtctcactctgttgcccaggctggagtgcagtagcgcgatctcagctcactgcaacctccgcctcctgggttcaagcgattctcctgcctcagcctccggagtagctgggattacaggcgcctggcaccacgcccagctaattttgtatttttagtagagacggggttttaccatgttggtcaggcttctcaaactcctgacctcaggagatctacccggctcagcctcccaagcaatatccattctgattccataatagaaaccagaataatagtagattaaataagatacaaatttagttccctctcattaaaagtccaggtaggttattcagggatggaatgatggctttccagtcatctgtgacccaggttctttctccattgctgttcctccaccttcaacacaagacttttatcttggcatccaagacggttgctgaaactccccgaccatcatgtttgtattctatctggaaggaaggaggaaaggggcagggaagagtgtgcccctttcctttaagagcataacctaaattacactcaccacttccacatacagaaataaatcacatggccacacctaaccataagggaggaggggaaacatctgctagacagctgtatgcccgatgataaattttattgctagggaagtaaggaagaatgaatactggggagcaactagcagtctctgctatatttcctatccagaaattgagatcacaataccaactttaccagggagaagggagatggtctaccagatggtcctgggtgactagcacctactggatgctctttatcaaactctttccctttggtgtctgcattaggagtcattacgggccaatagtcgactgctggaacaacttcaagaaatagggcaggagaaggagcagttgacccaggaattacaggaggctcggaaggtaggggaacatgagggttgaagggagaggatggggggtaggaattggctcagtccatggggatgggaggaggtgatataaccaaacatgtggggataggagggaaaggaaaattgactggtttctggttgaccagtttcttggccaaatccatgagagtgggaggggaaagaaagaaagtgaccagttctataaggatgggtgagtgccttagccagttcagtggggatgggagggagtggagtttggctagttccttgggcatgggaagagggttggaggccttttttcgatgttgtggaaggaagttgactgccatcgtcctggcccccagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggtgggtgggtagatgatgatgcccttcttcctctaaaacctgggaaccacagcgttgctgataggccagtgggtggcatgcatcaggtgcccgctcctctgccttcctggcccatgacagtctgccccatcccaggcccggacacgggagctggagactctccagcagacagtggaagaacttcaagctcaggtacattccatggatggagccaagggctggtttgaacggcgcttgaaggaagccgaggtgagttggtgatgcctggtgaggaacagaggctgattggggccctcatgtcaaaccacagaagcaggagtggtcaggccctggaacttcccgagattttctggacttagggatatccccacagtcccctggctcaatagcagccctctggagtggatcaggggatggccatcagataggacagactgtcacgtgttaaggctgccctgcctttgtgcaaatttggaaaggcacctctttctcctgaaactgtacttctgtcaggaaattaatgcaatacactgatgttattgaacaagaacctgctgggtgcggtggctcacgcctgtaatctcagcactttggaaggccgaggtgggcggatcacttgaggtcaggagttcaagaccagcctggccaacatggtgaaaccctgtctctactaaaaatacaaaaattagccgggcatggtggctggcgcctgtaattccagctactcaggaggctgaggcagaagaatcacttgaacccaggaggcagaggtcgcagtgagctgatatcgtgtactgtactccagcctgggtgacggagtgagactctgtctcggaaaaagaacctttgttgccattttctggaaatctcataatacactgaaaggcattgtcatgtagcagtgaagagcacaggctggagccagttgtttgtctaggtttgaatcctggctgggccatttcctagctgtgtgaccttgggcaagttatctgacctctctgtggcctgttttcatcaatggtaaaaagggggtaacaataatatctaccatctaggtattacgggaggattatagaaaatgagttaatatatgtaaaactcttagaacattcttggcatgtagtaagcgctatgttttgttaaataaaataaaatgtaaatgcaaatctaagtcaaccatgcgaatggtgcaactttagatgtgacacttcagcatattgcctaagggcgtgtggggttccctgcaggagggtcatttctgcatacctctgggcccccattgcagtccctcatacccctaactgggcatgataccttctggggggctgtggccagacctgggacttgtcttgtaggaatccctgcagcagcagcagcaggaacaagaggaagccctcaagcagtgtcgggagcagcacgctgccgagctgaaggtgcctctcgcatgatggtgttcctctctccagacagtgacgggccctcctgggaggacagaggcttcccaagccaatgcctaagctgctttctgctttgcagggcaaggaggaggagctacaggatgtacgggatcagctcgagcaggcccaggaggagcgggactgccacctgaagaccattagcagcctgaagcaggtcagtggtcactgcacagccccagacacacccctgatcctcagcgtacaggaggggcagggagggagcatgcttcaggcagcccttccggcatctaccagccatgcctgctttctcccacaggaggtgaaggacacagtggatgggcagaggatcctggagaagaagggcagtgctgcggtaagacagagcggtgcccaagcacggctccctcctacctgtagcctccctcctatgggcccactgggcctcagtcctcatgttacccctgtcccccacagctcaaggacctcaagcggcagctgcatttggagcggaaacgggcagataagctgcaggagcgactgcaggacatcctcactaacagcaagagccgctcaggtgagggactaggacagggagaggaggctgaggcatgggggaggtagggcctgggcctgcaggctgcaggttagtcctgcctcttcctcagctgtgctttcctgcttctgtcgctctggaactccatcttttaccttttctctgtctctcctctgattctttctctgcattctctctttatttctatctttctctcgtttttgccctgtctcttctctgtttctgtctctgcctctgtctcagtttgttctctctctttcctctatgtttgcctttatctccttgctttctttctctagttttctccttttctctctcttttttttttttgagacagagtttcgctcttgttgcccaggctggagtgcaatggtgtgatctcggctcaccgcaacctctgcctcctggattcaagcaattctcctgcctcagcctcctgagtagctgggattacaggcatgcaccaccacgcccagctaattttgtatttttagtagagacggggtttctccatgttggtcaggctggtcccgaactcctgacctcaggtgatccgcccgcctcagcctcccaaagtgttgggattataggcatgagccactgggcccggcccccgccctttcttttctctgtccctttatctcttcccgccactctgtgtcctcttcgtctcttctgtttatatctctgtctgtctcctcactgtatgtactacattacacactcccacacctcacttggcatttctaaatctattgtatacaatctctcattctataaatctccctgctcaagtacagggtccctgatataaaactccctgagtctctgccctctagaagcccccagttgagctacggagacagacttatacatagtcagcaacgctgtggtgttttcattatacagctaatccaatctgttatttctgccacttcaagcagaagacacacacacacacacacacacacacacacacacacaactttagttgcttcagccttttttaagacggggatggcctataaatacatttaagtaagtaaaatgcagtgatggctctggtgcatctcttagattacagactcagagaaaacttggtcccttattcccccactcgggatacctacggatccccactcagtcaccccacccttgccagagatcctcgagggctttaagtgatgtggcaaaacagatgtgtatctctcaccaaatcaatttctctctgaggcactcggtctcctgaagtaacctttctttaaaaaggagttttgtttctgttttatcacagatgaatgtaagaatcttgggaaaggtgtaatcccagcactttgggaggccaaggtgggtggatcacctgaggtcaggggttcaagaccagcctggcctcccaaagtgctgggattacaggcgtgagccaccgcgcccggcatctttttttctctctgtctctgctctggctcacttctttcaccagggtctcagtttctatcatctgctctggctttccatctctggcattttctttctgcaagtggatgtgccctgtgccctctctagctgtcttcctttctctgaaccctgtgtccaagtgtgtctgccacttgagacccatgtgtacccatgtcgttctctttctccaacctcttccattttctccctctcattttgtatgtgtttctccagaaaggcagctctttcttttctttctgttttttgtttttttttttttgagacaagagtctcactctgtcacccaggctggagtgcaatggtgcgatttcggctcactgtaacctccgcctgcttgggttcaagcgattctcctgcctcagcctcctgaatcgctggaattacaggcacacacaaccacacctggctaatttttgtatttttagtagagacggggtttcttcatgttggccaggctgttctcgaactcctgacgtcaagtgatcagcccacctcagcctcccaaagtgctgggattacaggtgtgagccagtgcgcccagcctcagctcttttttctgtctctgtctctccctgtcctcctgtctgcttctgcctttccccatgcccaggtgtctctctttccatctctgttaaatctatttctgcctcttcctgctggttgctgccctgggactcaggggtactggggctcaagtttctcttccctccaccacccaggccttgaggagctggttctctcagagatgaactcaccaagccggacccagacaggggacagcagtagcatctcctccttcagctaccgggagatcttgcgggaaaaggagagctcggctgttccagccagggtaaggggaaaggaagaacctacagctccagcttctctcaacccaaaaatctgagaacccctccccttttctcctcacctaaacccatctcctactttgggcgcagcacacatattttcttgtcaacttttccccaagcccaccaacttggattcagattgcgacatgcaggacaggccagtcattctctctctctgactttctgtttaatcatctgtgggctaattcccccttctctggtgccataaattatgtggctcatagtaggtgcaccatccaaggagaaggtccctttttccaacttgtaatgatcactaattattattgccggctgtcatgtcagcctccttaccagccactttcctttggaaataacttttttattgttccacaaatagtatgtgctcattgtagtacattttttaaaaaccacaaatgagcaaagatttttttaaaaccttaaatgtctggccgggtgtggtggctcatccctataatcctacactttgggaggccaaggtgggcggatcacttgagctcaggagtttaagaccagcctgggaaatgtggtaaaactccgactctatttaaaaaaaaaacaaaaacaaaaaaaccttaaatgtcaaaaaaaaataatattttcaccatccagacgtcaccattataaattcttagttcagggctgggcgcggtggctcatgcctgtaaccctagcactttgggaggctgaggcgggcagatcacttgaggttaggagtttgagaactggcctggccaacatagcaaaacctcatctctactaaaatacaaaaattagccgggcgtggtggtgcgtgcctgtagtcccagctactcgaaaggttgaggcaagagaatcgcttgaacctgggaggtggaggttgcaatgagccgagatcacaccactgcactccagcctgggcaacagtgaaactccatctcaaaaaataaataaataaaataaattcttagttcatacccttccagaattctctctctttttaaaacctagatgagattaacctgttttttattcaactgttgtctctaccttcccaatttgatcaattttcatgtcattggctgggtgcggtggctcctgcctataatcccagtactttgggaggccgaggcgggcagatcacttgaggtcaggagttcaagaccagcctggccaacatggtgaaaccccatctctactaaaaatacaaaaattagctgggcgtagtggcgcgtgcctgtaattccatctactcgggaggctgaggcaggagaatcgcttgatcctgggagttggaggttgcagtgagccaagatcttgccattgcactccagcctgggcaacaagagtgaaattctgtctcaaaaaaaaaaaaaaaattcatgtcgtctgatactttgaccttaaccagatttctctagttggccccagaatgtcctttcttgctggttttatgaaaactagcattcagattcagagcacatgttacatctggttgttttatggcccttaaatctctttagtgcggtcccttttttcctgagaccaatttgttgaagaggccagcccagtcaccccacaggaagtatgctaccttttgggtttttctgctggcttcctggtggtatgatttaacatgtccctctcttccagttttcctgtcagctgaaagttagatctcatttgctttgggatcttccttcaatcctctccacaaggctctgatgtggttactctctacccccatttaggcagaggagaaaacagagtctgagggtaccaagatgggccaacagtcccagcttcagggcccatgttctctcacccacctctggcctggttctcctccccagtccctgacacctgtctggggtcggtggtgctgagcccggggctggcctctccccttctctttcctgcagtccttatccagcagccctcaagcccagccccctcggccagcagagctgtcagatgaggaagtggctgagctctttcagcggctggcagagacacagcaggagaaatggatgctggaggagaaggtgctgcctgcctgcctgcctgcccatccccacttgaagtgcccttgtgggtgtggggtctgcccgggcccgcctcatgtgtgaacatgtacagtagaggggtctcaggtgggctgggccatcttgcaggtgaagcacctggaagtgagcagtgcttccatggcagaggacctctgccggaagagcgccatcattgagacctacgtcatggacagccggatcggtcagtgtcccctccccggccctcagccctggtccagccttcacctggccctccctctccattctgtgctgcggcttctctcctctcctctcggaactcagcgaagctactgacaagaccatggcctgtggaggggagaacaggaaagcactgtctcttgatctcgcctcctccctcttctctctttctctgtcatctctccactctccattctccattgtgtctctctgtccactttctcctttcctctccctgtgcctcatcttcctctcctctctctctcccttctctcttctccgtttctctttttcaccccactccttcatcttgtctcgctgtctatattgttttccttctctgtatcttcattgcttttgctttctttcaaactttctccttcacagatttttctttattaatcagaatcatactgaccaacatgtgctgaggactttctgtgtgctctgtgcttcacatacagtcatgtgcatctttccagttccacaagttagttatcctcatttctcggggccatagagctagtgagtgacagagctaggttttgtatgtcaaagcctctgtcctacatgacatggcttttcctgctgccttctcccctggtattcgtctccctcttttctcctctggctctgcctggctctcctctggctctgccgagggggtggttttcagcctgggcccttgcagatgtgtctgtggcagcaggccacacagaccgcagcgggctgggcagcgtcctgagagacctagtgaagccaggcgacgagaaccttcgggagatgaacaagaagctgcagaacatgctggaggagcagctcaccaagaatatgcacttgcacaaggcaagtgtggcctgccagcctacccatctgttcacccagccacctgcctacccagccacatagcccctgggtcatctgccagtccccttgcccacccacccagcctgtcctcccagctatcctcctacccactcatcaactactccatcatgctctcatcttccaccctctcatcaacttattatccattcattccttccatgtacccgctcatccatttatctacacattcacccaaccatttgcccatctgtccatctacccaatctactacttacttatctcattgtctaccccatgtcctgccacccatttcttgacatatcattctcttatctactcatcaattgccccttgtgttacctttcacccacccagttacctgcctgcccacctgttgatctccatctgtcctctggacaattcattcgtccaccaatttgtctaccatagatcccccatgcccatgggtccacacacacatctttctgcccaaactgccacccaaggactttccccatctctgagagttagaaaggggtcagacccagctcctgcctttgagaagcaagctcacacttagaagagcaggtggccagagtggtggtgtatcctgcagcagcaccatgccacaggaggcatcccactcccattatctgtagctccccacccatcctcatgacttttctgagccctgcccactgttgggggtgctgtgagcttctccaagtaccttctcatcccaggccagacacagctgagcattgattaatgaaagggtgtgagggaaatcacagatgataccctacgtttggcaagggagcagcctgtccccttctctggcccctgatggttcatttgtttcttaggatatggaagttctgtcccaggaaattgtgcggctcagcaaggagtgcgtggggcctcctgacccagacctagagccaggagaaaccagctaaagacctgcaggctgcacccacctcctccccttcctaccccctaggatgctattcccttgggctgtggtggaaaaatgagggctggagccaaaatcaaatagcttgggagactggacattaaaggggctagaggcctgatggttagtgttaatgatcctgtcttagggcagaggccaccagggagtggggatcctgagggaaggggcagggatttctccttcttcttggtcctggctcccaagggcttctgtcttcatctctgcatgagctctccttcccagagaccaactcttttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggccagacgggcccacccactga

SEQ ID NO: 8422 - DNA, 370 bp, Homo sapiens
gggtaggagctgggcaggaagagaggggagtccaggaaggaggtggagagaattggcgaagttccctgccacccccattttccagatgacgcgactgaggcccaaccagctttgtaggaggcggagtctccccagggtccctctctggctgtcctaggggagggggctcagggagccacgaggcccctccctgcctctccatctcccggcaagctcagaggggcggggagagagagccagaggaggaggagaactcaggcagctctgcagagggggccaggagctcgggtgtttggtacccccagccccaccgctgttgctgctcctgcagcggggacacaggtgaggacgccccgagagagagggggag

SEQ ID NO: 8423 - DNA, 1946 bp, Homo sapiens
taattaaaaccccattgtctcagccgaaaatctccttaagctgataagcaacttcagcaaagtctcaggatacaaaatcaatgtacaaaaatcacaagcattcttatacaccaataacagacagagagccaaatcatgagtgaactcccattcacaattgcttcaaagagaataaaatacttaggaatccaacttacaagggacgtgaaggacctcttcaaggagaactacaaaccactgctcaatgaaataaaagaggatacaaagaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaattacgccacatatctacaactatctgacctttgacaaatctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaagggcttcatgtctaaaacaccaaaagcaatggcaacaaaagccaaaattgacaaatgggatctaattagactaaagagcttctgcacagcaaaagaaactaccatcagagtgaacaggcaacctacaaaatgggagaaaattttcgcaacctactcatctgacaaagggctaatatccagaatctataatgaactcaaacaaatttagaagaaaaaaacaaacaaccccattaaaaagtgggcaaaggatatgaacagacacttctcaaaagaagacatttatgcagccaaaagacacatgaaaaaatgctcatcatcactggccatcagagaaatgcaaaccaaaaccacagtgagataccatctcacatcagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaaccagaaataccatttgacccagccatcccattactgggtatatacccaaaggactataaatcatgctgctatgaagacacatgcacatgtatgtttattgcatcagtattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacactgcatgttctcacttatagatgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacgtatgtaactaaccggcacattgtgcacatgtaccctaaaacttaaagtataataataataaaaaataaataaataaataaaatataataa

SEQ ID NO: 8424 - DNA, 2371 bp, Homo sapiens
tggtaagttggcatgaattttccatgaaacacttgactgccatttgcagcatcatatctactttttatgcacctaattatatttttcctttcacttttatgtttttttctaaaactgccacctaaatacctttccactccgttaaatgtatggagtcaagataaatttctcattcttgctctacagtttaagatgtataagaagtaaacacttccgtggaatagggcttaatttggggctcaaatgttttgttttcctcctgagatgtttttgaatggataagactactctggttttggatgcagcaacttttctcctggcatggaagaactaaggactttgataaacagtttcccattgatagtataatataatgaggggcccagtctgctcttgtgaaaattggctgagcggcagcagcccatcccagctgtgtgtgagtagccccgctgttaaaagtacacctgctgggaattgttggcacatgctcatagcatatgctctgtgggggaggtgcttttaattccaagaggagcttttctcccacatctgcggatgcagaacaaagatgcagcaggactttagaaaacaggagtgtttctactgacattttattcattgctttgttagtcccgcaaatggagcaacttctggttgtttgtaagcagaaaaacaaaacattcaaaaccaaaaacctaattagtacttttgtcctttatatccctaggatgctctagggagtagaggtggcaggcatctttatcttcacccactggcacattagcagcttatgcaacttaggaagtcactgggagatgagtcctaaaagcctgaatttcaggatggggaggagataagaagcagagaactttgggagaccatggggcatttagtcctggcatagacacagaatggatattcacaggaagattcctgaggccagatatgcaggagagcacacattgtcacaaggggtgtggtgggaagagaggtgctggatgcctaagacagacttctgtgcttggcagattgactgagtgttgactctgaatactttgtggtccagtccataataggccagtcactcctgcctgatgcatccctgttgcactgttcataaaacctgtatcatatggggaagcttcaaggctggcaggcttttcatcaagtaatcatcattccatgttcctacgtatccttgaaatcaaaaccaggcaatatgtgtgtttttggttttgttttacaaaaaggcatacaatgagacgaattcttaagataatgcacatacagaatcatcaataaagtttcaaagagtttatgaagaaaaggtattttcctttcttgtaaaaaatgttatatatatataatattctgatctgcattcaccttagggcttagcctcttattttatgaattttcaggctgtgatttgtgttggatggctaagctctaaaataatgcaaatagccccaatctttaaatatagcggtgctaagttgaacaagtaacacaatacagaaaatgctgatatgaatacttagtaataatacaaaagttcctgctaaattatatatgtgtatcactgcctgactagaaaccccacttttcttttctaatccagcacaaaatcaaactctgattctacaaccagtctttttaaagggcaaaaatgactcaacacctttgttttgtatggaaaacttttttttttacactaactgcaaaactgctttaaaaaaaggcttattcaggatagataagcatgtactccttttttaacttgctggaagacttgcccctccaaactagcacccccaaaagacaacttctttcagaaacggggtgttttacctaaacatagtagcttacatgttagccagcagtaggtcggcactagtgttttccacggttatcacctttgacaggtgatgtgcatctatagatagtggaagccaccccatgaggaggtgttaatagcagcatggtttcacttttggtaatcaggtaatcatgtgtatatacttagattcgcattattttaacatttctctgctactctgcacttcaggttcgttaagctattttaataattactggggttatggcaaacaccaatggaaatgtatatggcaactgctttcctgagcaagtgtgatttgttttatggctgttcaagttataaaattgttcttacattgtaggtaaacaaaatcttgatgtttttaaaggtcactgtaacttaaggttcaaatttctggcacagttttattagtattcacttcggaagctaataagataccatggttttctatgttactcccattgtaacattagtaaagtgactttcaataaaagatttatgttattttga

SEQ ID NO: 8425 - DNA, 3455 bp, Homo sapiens
cgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaattttaaaaaaatgcagctgttacacacaagtgtattttgccaaatgcctaaaaattccgtcacaatcacatcatcgtcatccatccagtgatcttcaaagactataagcaggtaatgtaaatatagtggtcaatgctgtaaatgtgtctctccataattcgtatttgtccaaaacatgtgatatccctttaacctgtgcacagtctggaggcagttttattgagtgagtagttgagtgagagaacaaaatgcccagcaaaacttctggcctccacagtttgctgatgcaggagcccactctgctgccgatgggctgctccctggaaatcatctatcccatccgtccatcccatctcatcccagtgagccagcccctcagcagtgtgtgctgctgagattaagcaagtgcaccaaagacacatgagacaacgtactgccagtgagctggtagcttctggtttgccaatactctaaccctttgtggcctgaagttttgttccttggcaaaactttgtagtcacccttatctgtgaaatgaatgacttgttttaacaaaaacaactttgacactgttgattaagaatatttgtcatcactgggatgtgaatcccaacaagtcattctgcactgactctgaagcaagatgacggaagattctactgtttgagttgagcagcttcaaccattcataaagggttaagttagatctaaaccacagagatgcagcatctgcgaagttacactaacagctggtgggggaaagaatctgatgctttgaaacatatatttttaatccataggaaaataagattctattttaaaagacccttctttaaaaccaaagtttgatagctgttataatggcagatctgtcattccaaaagaaagctagctaccctagtgaggctggagattgatgggctcaatcacatggtctgctctgaagtatacttctgatttcctcatttgctgtgtgttcttaagaggaatggaatctgcagacaggttttcagatatactctcttaaatttgatcctctcccatagtatccatggacaaaatccatatcatcttcatatgtaatcaatttgattacatatcatgcccaaactgaagggccgagttagaaggcagcattttatactgtgtgtttatgtcttctgtaatggacctctcttttgaaagtctttgaaatgtttggaaagcaatttaatgatccaaaattacataatgtaaaacagcatttttcatgacaggaagggatgtgattgttgatatgaccataaagcgatccatcaggccaaggtttgggtgagtgttgggcagtgttgccacatagctcaagccaagaacagaagggcagacagattgaaagatgtagcaaataaagtgactttttaccaagatcactgtaacgtgcactgaatgtttcctggtactgagtgtacaaaaggctaatgctataaggtttattttgactataaaagagtttatagatttgaatataaggtgcctcatgtaaatatgcttcctagttacaggtacacaaactctaatttgaaagaatccacaaatggctagctgagaagttaacagatctctatcattcgtctgtgtgtctttcttccctcacctatttttacatgaaattattatttcaaatgaaaatcatgatcatgtgccttttgggagacatggtttctctagaggtatatagtttgtaattacccgccttggtaataaccttcctgtggaactgactaaaaatttttgttttatttgtagagattatgatttgaggtatacagtaactttaatgttctattcttggaatctactctatctcccatgtttaaacattcttagagccatttgtgggattcattgacaaatttatagtctcaagggagagtttcaagaagtatctatatgtatactcatggttggggttctagaggcattacatctaaatatttatgacttttcatccaccgaggtaggtagcattaaatatacaagcacagcattatttctctttaaatatctattttggagagaaactttgaggccgtatcacagtttatatcatgcaactaatatttatatttcccaatccactacaaaatcattgctaagcagaagagagcagttatttggcctttatgttccattgtatgcctttttcccctcttccagttttatgcattgataagactacagattggcaccctgctgcctgagaagttccatttatccatagtcattgcagtgcagtaaaccctgatttaaaggaacatttaagtctctccagtaagtgtgaacaggaaggcatgggatagaagagagtccttatggagtggactggccacatgaactgtcctccagccactctttatttagatgggaagtggcatggtcctctgaacgctgcaggctggaaatgatccccagggcacatgcaatctgtggaaaggaatacatcggacagtgcaacatggtgagggctttcaatttgctgtggttgctgtatttttaacaagacacccggagcttcgattaggaataacctatcattagagttgttcctttaaaaaatgttgatgaataaagcaaatgtgggtttaaaatgccaacttatttttcactttgatattggtgctttattaagtgataccatagtttctctctcttttccctgttactttaaaaagaattttaaaattgtgtttgtatataaggtcagtctggcatagaatttctgaaagtaacattaataggatttctaaagaagttgtcagaaagacaaaattggatattctctgcactttcagagaaggactatttatgtttgaatttcataacaggcttacatttcttttctattgattcccttgcatatctacataatttaatcctgtctattgtcccagatctcttgtggctactttacctgttaccttttttgggattttgttctttatgttttacagttaccttcggaccagaagatatatggtatttttattcacttttttcagtgttttaaaataaggtttgttcatttattcattttatccattcatttcctattgtcgtatagttctaaccatatatatagtactttaaatattttcttatgttattatttaacacaataataaattcttatctaaagaaaagatt

SEQ ID NO: 8426 - DNA, 1331 bp, Homo sapiens
agtcaaggtattgttttaatgtgagaaaaagagaaggaagtcactgatgaagggtttgtacatttagtatgagattttaaaagtttatggtgattacacatagctccatttcttgcatttataatattttagtcatataataagtcatttagatgaacactgaaacagtaactcggctgagccaaagcaaagtctagttcacagatggcagccagctcgtggacttgatggtaccacctggaacatcatgctgaaggacagtctaaactccagtttggctcagtagaagcaagagctttaatttaatatgactgctgtggtgcaaatctacgccaactatccccaggaagcaccaggtctctagcagccacattcctatggaagtaagtgcacgaaatgtgttaaaagtacttcataaatcatggatctcttgaaacacatgagtaaagcacacatctccaaaataaaattaaatcctaatgagggtgatttgaggagcttaattctccaaatagttgaagtattcaagcttgagctcacagctttaccatgctccaactagattctttaagaaaaagtaaacagaccaggaaataattttaaagtagtgggtgaggctacactagaagtatacaatgaattaaacacaacccaacataaaatagaaataaggcaacaggagatttcacttgtaatgaagactggctgtaattaaaggagatgaatacatcaaatttgtcaacgggaaggaaactttttctaactgcagggacatactgaaaactatgctccatgcttttggaaagaatgggtgaaagcagaaggggaggagattaagagattcgttttgaggtatcaataattaaaacggaattaactgaatgatgtctaatatggtttggctctgtgtccccacccaaatctcatctcgaattgtaatccccatgtgtccagggagggacctgtaagccttacatcgagggagggaagggattggatcatgggggcggtttcccccatgatgttcttgtgatagtgagttctcatgagatctgatggctttataagcatctggcacttccctgcttgcatttccatctcctgctgccttgtgaagaaggtgcctgcttcccctcccgccataattataagtaagtttcctgaggcctccccagccatgtggaactgtgagtcaaacctctttccttcgtaaattacccagtcttgggtaatgtctttagcagtgtgcgaacaaactaatataatgtcagagggatgcttttgtattcaccccaaagccaattcagaaccacaactgatgcagcacacct

SEQ ID NO: 8427 - DNA, 7694 bp, Homo sapiens
atcgttattatgcagtgaatttctgtatacaaaaataaaaaatgtatctgcaaaatgctgttaacgtttgatagagtgtcacattgtcaggtactagattgtttctgtagtcactatacttactgcctatttgtgataataaatagattgtgattttcaagttttcagctgatattggtgggagaacacttttgactcaatttctataaaatatgttttccttcataccctgtattctttatgtcttgatgaaaggtggtttattaatggacattggagtttttcctaatgcatgaaattttgagctgacaaagtttatattctgcttttaattcattgtttaatgctcataaaaaagatcaggattgcctaaccttatattattaaacttttagaaacccttgctggtttaaacggggtataatagttcatatctgtaatcccaacactttggaatgccaaggtgggaggatcacttcagcccaggaggtcaaggctgcagtgagctatgatcatgccactgtactccagcctgggtgacagagcaagacccttctcaaataaagatttttttctttgagatggagtctcgctctgttgcccagggtggagtgcagtggcaccatcttggctcactgcatcctccacctcccgggttcaagcagttctcctgcctcagcttccctagttgctgggactgcaggcatgtgccatcatgcccagctaattttgtgtatttttagtagagatggggtttcactgtgttagccaagatggtctcgatctcctgacctcgtgatccacccgcctcagcctctcaaagtactgggattacaggcgtgacaccatgctcggcctacttatttttttgttcataaaattaacagctttcacagtcattaattgttgcagcattcactcttagaatgttttttgtttgttttttaaaacaaggtctctctgtgttgccagtggtctcaaacttctgggctcaattgcttgattttcccaccccaggcttccaagtagctaggattacaagctcgtgtcgccacactcagctagaatatttatctatgtttcaaacctaatattcacatattaatccagatggacccaccgtatataattaatgttatattgatttgacatgatggtaatttatacagctacatgatctttgatggtgtaccagaaatgatgttaaggtaagtgttccgcaattcaaagtcttacagctgatgtggattgaatattggggtaaagcctaattttggtacatctctaaaaaagctactgaaccttatagaaacaagacaattagagttttcccattttcatatccctgcacctaccctatcaggcttttgtctaccagatcaaaattttacaatttgctcctttatacattttttttgtgttgtttttccagacagagtcttgctccgtcgcccaggctgcagtgcagtggcaagatcttggtccactgcaacctccggctcctgggttcaagcgattcttctgcctcagcctcccgagtagctgggattacgggcatgcgctaccacgcctggctaatttttgtattcttagtagagacggggtttcaccatgttggccaggctggtctcaaactcgacctcgtaatctgccttccttggcctcccaaagtgctgagattacaggcgtgagccaccaagtctggcctgatacatttttaaacatattagttgtagttccagtctcttatctctgtccttctaggcattctgttctttcttcgtttaattcagtaatacttatagagcacttaaaccctgagcattttatgcatgtatttcagccaagtgaggttttaagactgcctttaaatctcaactcagatgttacctcctaaaagatttttttcagcctcctgagttggaccttgttacatctgtattctcagagcattttaaacttactttgtttgtagcatcacattgtaatataaagaattgtttgagtatctcctttaccagattttgagctccttgaattaaaaaactgttttttcttgttcatttctgtgtctcaaagacacagaatgaggctgcctgatacactgcctcaagtaagcaagtacttggtacaaaggagttacagcacatatgcatttaatttatgggtttacactgtgtgcttaattaaaagataaataattgaaataatcaggcagtttcactggctgttgtacccagtgggtgtatgcctaagattgggacaatataagaagtataaactgttgttccagtatctgttctcatatgcctctcaaaagtaaacatctcaccaggcttgagtgcgtttctcctgttgaagataacttttcatagcttcatacctcaaacacaagccagccactcccactgacactcattccaatgatggaagaaaagccagctgtgttggacttgaggggtggtgtattaatctctaacatagtgcttttctaatgaacgatgaaggataattttgactggactgagtttcacaatatattatacactgacttcagaacctaactctcccccccacacccccgccaagaagaagtcttgctgtgtcgcccaggctggaatgcagtggcgtgatcttggctcactgcaacctccgcctcccaggttcaagtgattctcctgcctcagtctcccaagtagctgggattacaggcatgtgccaccacacccagctcatttttgtattttctgtagagacagggtttcaccatgtccaggctggtcttgaactcctgacctcgtgatccacaccccttggcctcccaaagtgctgggattacaggcgtgagccaccgcgtccagccctgaacctcactctttatatgaaagataggaatgctactatacagttttgttaaatgaatgatctgtcctttttctgcgtttctgtaatactttattattcaaatgacatttttgctgcttatttcatagctgtttacttttgtcttatcccaccagttaaaaaaacaggaatcatgtctttatacctctttgtatttggtatattgctttttatataatactcgtttatagaatgaatagacattttattttattatttatttatttatttatttaaagacagagtctcgccctgttgcccgggctggagtgcagtggcgtgatctcagctccctgcagcctccacttcctgagctgaagcagtcctccaggttcagcctctccagtacctaggactataggcgtgtgccaccacgcctggctaatttttgtgtttttttttgtagagacagagtttcaccatgttgcccaagctggtctcaaactcctgacctcaagtgatctgcccacctcgggtgggtcccaaagtgctgggattacaggtgtgagccactgcgcccagcattagacagctcactgtacagtgatcataaacctcagtaccctttgctaaatgttccctctcagttatcacttttctctctttcccacagctctttcgacgtgtagcagcagctttgccgggaatggaaagcacacaggacagaagcagagaagatagtatcctttttatttcattggaaatttttcattattaacactagtctttagagccctgcttgcttggctaaagaatattgtgccattgccttttacaaccaggaactgatgacttaaaggcatagaaattcatttgttttctatagcaaatgaggtctggttatccaagtgcaccctttgcagcctgcttctcgttgttaatcagtgagaggttttgtgtttgtttgcttgcttttaaatgagcaggaaactcttagaatccctgtgtccttgcctcttcattttgagtcccattgactctaggctttttcctcatggaatatcaaattttcatttctttttctaacacttgagctttctacttgacacaggcaagaaatagagtggagctttattgtagcctctgctttcagaaacaggacataatattagttcatttccaaggattgggacatctaatattagttaattctaaggatttttaatttgatgttttcagtgtttcatattcaccttctagtgtatttccatatgcaggcatttttattaagccatatagtttgtagcactttgtattcagctcttcccacttgtaaatgttatatgttttcataaaaaacataaaacaggccgggcgcggtggcttatgcctgtaatcccagcactttgggaggccaaggcaggtggatcacctgaggtcgggagttcaagaccagcctgaccaacatggagaaaccttgtctctactaaaaataaaaaaattacctgggcgtgatagtgcacgcctgtaatcccagctactaaggaggttgaggcaggagaattgcttgaacccaggaggcagaggttgcagtgagccgagatcacgccattgcactccagcctgggcaacaggatcgaaactccattccccccccaaaaaaaaaaacacaacaacaacataaaacataatatgtttcaaaaacaaaacaacaacaacaacaaaaaatgttctattgagttgaagtatgtccccgcgcccaccgccgtttttttctgagatggagtctcattctgtcgcccaggctggagtgcagcagcgcaatctcagctcaccacaacctctgcctcctgaattcaagtgattctcctgcctcagcctcccaagtagctgggaatacaggcatgagcaccatgcccagctaatttttatatttttagtagagatggggtttcgccatgttggccaggctggtcttgaactcctgacctcaggtgttcggcctgcctcaacctcccaaagtgttgggattacaggcatgagccacggcacccggcctgaagtcccattatttactaaatgtttcctctgctgttggaactatcttgtaggctattttcagatttatattatagatgattctatgaggaacatcatcttcatatcacttcttgccactgtagaataagttccttaggatagatacccataaatagagcttgtacctcattctgacccttgttgcatatagtagatataaacaagtttattccatttgagcaccttatatggtgaggcggctatgtagaaaatagtgagtgtgtaggctctgaagacagataggaatataagggccatcccagaaatgctagtgtttggaagaattgaaattgtactttcccatttatggcttcttaacttttgtttcagtgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgatataaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagattttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaacttatacttaaagatgggatggagttgtaaagtgcttttataatacaatataattgttaaaggcaagggttgactctttgttttattttgacatggcatgtcctgaaataaatattgattcaatatggcagatgggtcatattctttatttggaagaagttgtgacttctgacatgggtgtgattgtcttcctacactgttgcatttgattctttttatgtatttttaagaaagtaaccagttatactgcttttaatattgattggtctttttatttggcttggagttcttcaaagcattgaagtgtgttcatagtccaggttttttttttaataaacacaattttgctgccaaaaatatataaataaaacacgaaagaaaacaattattgacctggtttcccattcctgccaagatggtgaattagcatttacttctccctctctgggaagacctttaaagcagacatggacagaatcc

SEQ ID NO: 8428 - DNA, 126 bp, Homo sapiens
agatcgagaccatcctggttaacacggtgaaaccccgtctctactaaaaatacaaaaaattagccaggtgtggtggtgcgtgcctgtagtcccagctatttgggaggctgaggcaggagaatcact

SEQ ID NO: 8429 - DNA, 1247 bp, Homo sapiens
cattatgtctgtaaaaacaatgtacatatctggccacacgtggtggctcatgcctgtaatcacagcactttgggaggccaagatgcgtggatcacttgaggtcaggagttcgagaccagcctggccagtacaatgaacccctgtctctactaaaaatacaaaatttagccagatgtggtggccgatgcctgtaatctcatctactcaggaggctgaggcaggagaatcgcttgaacctgggaggcagaggttgcggtaagcctagatagtaccactgcactccagcctgggggacagatagcaaaactctgtctcagaaaaaaaaaaaaaacaacaatgtatgtatcttaattaaaaaatactttattactaaaaaatgctaatgatcatctgatcgtagccttctgcaaatcataatgtttttgctgttggaaggtcttgccttgatgttaatgtctgctgaccgatgagggtagtagttgctgaaggctagagtggctgtggcaatttcttaaaataatactattaatacaatgtagttttctgcattgatcgattcttttatcacaaatgatttctctgtagcatgcaatgctgtttcatagtattttacccatagtagaacttctttcaaaattggcatttcagtccagtcgcagtggcacatgcctttaatctcagcactttgggaggctgaggcaggtggatcacctgaggtcaggagtttaagactagcccggccaacatggtgaaaccccatctctactaaaaatacaagaattagccctgtgtggtggcgcacacctgtggtaccagctacttggaaggataaggcaggagaatcacttgaacccaggaggcggaggttgtggcgagctgagattgtgccactgcactccagcctaggtgacaaagtgagactgcatctaaaaaaaatagtgccaccaggtgcggtggtgcatgcctgtaatcccagcactttgggaggctgaggtaggcagatcacttgagctcaggagttggagaccaccctgggtaacatggcaaaacctcttttctacaaaaaaaatacaaaaattagccaggtgtggtggcatgcccctgtagtcccagctacttgggaggctgaggtgggaggattacttgagcccatgaggtcgagacctcagggagccatgattgtgccactgcactccagcttgggtgacagagcaagaccatatctccaaaaaaaaaaaaaaaaaaaa

SEQ ID NO: 8430 - DNA, 102 bp, Homo sapiens
gaggcggaggttgcggtgagccgagatcgggccattgcactccagcctgggcaacaagagcgaaactccatctcaaaaaaaaaaaaaaaaaaaaaaaaaaaa

SEQ ID NO: 8431 - DNA, 1416 bp, Homo sapiens
aatttgaggagatataaagtacaggaatgggatctcagtacaatgctgtccacctggtggtgacttttctaagcactgtggtatattgggaccttagggctttctttgtgaatatgtatggtcattgttaatatcttgattctttgcttcttattgacaagtgatgattataattcaatggacaacctgaatcttggaggaagggaagaagatgctgaactctctgttaatttagcataaaacttgactttttgtattctagaaattcaagtctatacaggtataataaagcaaaaatatgtaatttatgttgcttctctcaatacattaggtaatttagtttgaaaaaaaactacctttaaaaattgacgttatttttctcttccaaaatatttccaataaacttacatattgtcttttattaacattgtgttaatgtccaagtttataaatagaatttttgtataacaagacacattatcatctaattattttttattctagatgtgaaatgccaatttacagaatattgttttagatttctgtataaatgttaatccctcttaaggcctacttaatgtagattaataaaacaattattatagtctcttagaggttcacattacaattccaaattgtaagtgattctatgctttcatgattgtctaagcctgatataacagtcatgttcagttttttaatattcttgatgttagtttttgtttttgctataaatacactgccctggaatttaacatatctcttctttttgatgaaacttaaacagtaatagacaaaattaggctagtttttattttttcatacaacttttaggattaaaagttgccttctcaaaaacatgacaatacttagagatacttatttcattttctgtgtctgcctcaaattttccatttaatataaaaatagatatatttaattgtttataagtataattgattggcatatgcacatgccatcttagttttaacacagggtttggaaactagataaacaagattattttagctgtctttttatacatgcaaatggaatttaaacctggatggttcaagtgtagttttgaaggggaattaaaacataataggatttctggctgggcatggtggctcacacctgtaatcccagcactttgggaggccgaggtgggtggatccacttgaggtcaggagttcaagaccagcctgaccaacatggagaaaccctgtctctactaaaaatacaaaaattagctgggcatggtgacgcatgcctgtaatctcagctactcaggaggctgaggcaggagaatcacttgaacctgggaggcggaggttgcagtgagccgagattgcaccattgcactccagcctgggcaacaagaacgaaactccatctcaaaaaaaaaaaaaaaaa

SEQ ID NO: 8432 - DNA, 436 bp, Homo sapiens
catgttggccaggctgccggtctggaactcctgacctcaggtgatccgcccacctcagcctcccaaagttctgggattacaggcatgagccaccacacccagctgacacctttcatttgttaagtctctgttatgtgccagatactatgctaataagctagcgtggattatgtcatttaatatgtatagctatttgatgaggtatttttctccctatttttgagaaaagcttggagaagtagttttccttgaaatcagacagccagtaagctgcagaaccaaaattcaaactcaggtctctgattccaaggcctgtagtgtatatatcaatttattgttatgttaagccttacatatactcttccataacatataataccatacctctatgcagtttattttatattgcatatttcagcatgtaactcgacctttt

SEQ ID NO: 8433 - DNA, 2786 bp, Homo sapiens
ccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcactagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtctttaccatgctga

SEQ ID NO: 8434 - DNA, 2786 bp, Homo sapiens; identical to SEQ ID NO: 8433

SEQ ID NO: 8435 - DNA, 2786 bp, Homo sapiens; identical to SEQ ID NO: 8433

SEQ ID NO: 8436 - DNA, 270 bp, Homo sapiens
cacgcctgtagtcccagctactcaagaggctgaggcacaagaatcacttgaacccgggaggtggaggttgcagtgagccaaaatcgtgccattgcactccagcctgggtgacagcacaagacttggtctccaaaaaaaaaaaaaagagggggtgggcaaagaactctcaaaatttatttttccaagtagaagacagaaagatggagtcttcgtcttaggaataaaatatgctaatagaattaattttatctataaaattgaatttccata

SEQ ID NO: 8437 - DNA, 270 bp, Homo sapiens; identical to SEQ ID NO: 8436

SEQ ID NO: 8438 - DNA, 270 bp, Homo sapiens; identical to SEQ ID NO: 8436

SEQ ID NO: 8439 - DNA, 1362 bp, Homo sapiens
ggtgaagtgtagctgctccctcctctccccgttcctctctgtccccccatcaggggaatacctactcattcttcaagccccggttcaaagtcgcctcctcctgatgcccacctgctgcaggaattgaacctccactttgcatctatagtgcttcagaccagccttgaggagaatgtcactgtggtgtggtgtagccatctatacttgtcctcctcctacaaggctgtgagccacttgaaggcttctgatgaagcaggaacaaaaatattaagatgtgaatatttacagcctttcttctcctgccatgttcccacatctgagctgatcaaggtgatacaaagtggaagatgcttcactgaagaaagagcataaagttagcagcaaaagctggatcagaatagaatcgatccagtcaactagaggtggaggcaagagagagcagagctagagttttaggagagaaaaaggaaaaagaaaaaagggggtggggagtgtagtgacctatggcactttggggaaaggcaggcctgaagaggatttggagagagtttctgtctgttgtacgacatagttgcttttcccaccttgccgcttgtttgggagttttgcaaaggcttcattgccaatcaatgcttttggagactatcagggtttcttctggatgtgacccaggcttcaaatggcctaagatttgttcaggttgcattgtacattttgggcccagctcagcaggtatgcagaataatacaaagatgagacaaaagagcaggtggagggacaggaggaggagtgcacacaggctgtggctctctgtccctctctgggcagaccaccatggtggacaatgctcatgcgttcatgacaacttgttccccagggagccccagattttgatgaaccatctccccaggtcccgcctctcccaaattgtggataaataaagccctaagatttttaataggcacaaccattgaggatgtatcagaaatactccctctctgtggttttggtgcagacaggaggggatgggtgttgggtgtgattctctttcagcctttctttcttcccctctcaagaaagcttatcaggaagcacacaagcacaatacttctagataaatattacttcatttgactccttctaggaatcttgtgaggtgggattaatgttcttattttaatttcaacttccaattgtttattatcagcatgtagagatataatttatttttgaatattgacctattatgaaattttactgaacttaatacttctagttttatttttgattgattcttagagttttctatgaagacaatcatgttgtctgtgaataaagatggtttctatttttcctttccaa

SEQ ID NO: 8440 - DNA, 488 bp, Homo sapiens
ggtcaggagttccagaccagcctggccaacacggtgaaaccccgtctctactaaaaatacaaaaattagccagacgtggtggcgggcacctgtaatcccagctactcgggaggttgaggcaggagaatcacttgaacccgggagacggaggttgcagtgaaccgagaccatgccactgcactccagcctgagcgacagagcaagactccatctcaaaacaacaacaacaacaaatttcaaaaagcataaaagagagggtggaatgtctccctctacctctaccccggtgtcctggttctctctttcaactcccagttcctatcccaaggggaaccaatgtccccagattcttgggtgtccttccagagaccttatatccaagaataaacaaatatgtatagtctttcctgcctctgccacaaatgatgacgtgctgtacacactgactgcacctcactggtctcacctgtatgtcccggtgaccagag

SEQ ID NO: 8441 - DNA, 1485 bp, Homo sapiens
cagttttgatccccagagagccccctgtacccttcagctgagtactctcaccattgtgccttgggctccctgagattccccaaccaaaggaccctcagggctcctcagcctctgcaaggcttcctggcttgccctgaaaggaaaagtcctgatattggcctctaggatttattaaggacaagagcttagagtttcagagcttctccctggggaagctctggcaaagatgacagagatggttcttttcaatgcccaaggttgttttttgatatgtggtctgctggtgagcagggccatgcacaatgtgtcagaaggctcttgatttgcagaaatggtgtaaatggagaccccttttggccaaggaagtggggaggcgggcacaaacataatctctgttccacttggaatgcttcgcagggagtctccattggtgggttaagcacgatcaccaattgatcacaccagcctggggcagagggtgtggggacagggaagaagaagggagtttgagctccaggtccctgcacgggaaaaacattggcaatagcctccttaccaaccaaccgtcccatctctctgctccttctgacttactaggatggcctcagagaaggcacagtgttaacccagccttatcacagttgtggaagcgccaggggaatgggagagtcaggggattaataatagtaggagcaatgccttacatctagtagatgcttcacactttcccagaagctattacttaatgaatctcacttaaattgtgtctgtaccatattagaatatcctgtgcagggataaatatgcccacttgaccgtcttattggaaactgcacacagtgaggaaatgcagcttgttcaatgacaagtggcagagccagggctgggactcaaaagcagtgagatctgattgttggtccagaagtttgttattctctcagcttgattaaactgcccttactcctgtttttccctattctatctccagaatttgacaagaggctgtcagctaaaatctagttattccagccgcataagctctatagttcaaccccagtggagtctttggggttgagatgctgaggcccttttcagagccccacaataaccaggtggctaagtgcaaaatgaaaacagcagaaagactaatgtccccactgagccacttaccatctctttgtggttggggtagtatgtctgttcaatgagagggaacttttctcctcccagtgtcttatagatagcgaccagctgggcaaactgcaaaagaaaagcaaatgttacagcttatcttagataacttctgaaacagatgaaacatcaactcatcaaatatttattgagcatttgctctgtggaggactttatgctaagcattgtgaggatataaaagaagtgtacaattcctatttccaaggatatgatacgcattagttggggaagggaaagagagtgagctaaaattcaattagctttctcaattgt

SEQ ID NO: 8442 - DNA, 1485 bp, Homo sapiens
cagttttgatccccagagagccccctgtacccttcagctgagtactctcaccattgtgccttgggctccctgagattccccaaccaaaggaccctcagggctcctcagcctctgcaaggcttcctggcttgccctgaaaggaaaagtcctgatattggcctctaggatttattaaggacaagagcttagagtttcagagcttctccctggggaagctctggcaaagatgacagagatggttcttttcaatgcccaaggttgttttttgatatgtggtctgctggtgagcagggccatgcacaatgtgtcagaaggctcttgatttgcagaaatggtgtaaatggagaccccttttggccaaggaagtggggaggcgggcacaaacataatctctgttccacttggaatgcttcgcagggagtctccattggtgggttaagcacgatcaccaattgatcacaccagcctggggcagagggtgtggggacagggaagaagaagggagtttgagctccaggtccctgcacgggaaaaacattggcaatagcctccttaccaaccaaccgtcccatctctctgctccttctgacttactaggatggcctcagagaaggcacagtgttaacccagccttatcacagttgtggaagcgccaggggaatgggagagtcaggggattaataatagtaggagcaatgccttacatctagtagatgcttcacactttcccagaagctattacttaatgaatctcacttaaattgtgtctgtaccatattagaatatcctgtgcagggataaatatgcccacttgaccgtcttattggaaactgcacacagtgaggaaatgcagcttgttcaatgacaagtggcagagccagggctgggactcaaaagcagtgagatctgattgttggtccagaagtttgttattctctcagcttgattaaactgcccttactcctgtttttccctattctatctccagaatttgacaagaggctgtcagctaaaatctagttattccagccgcataagctctatagttcaaccccagtggagtctttggggttgagatgctgaggcccttttcagagccccacaataaccaggtggctaagtgcaaaatgaaaacagcagaaagactaatgtccccactgagccacttaccatctctttgtggttggggtagtatgtctgttcaatgagagggaacttttctcctcccagtgtcttatagatagcgaccagctgggcaaactgcaaaagaaaagcaaatgttacagcttatcttagataacttctgaaacagatgaaacatcaactcatcaaatatttattgagcatttgctctgtggaggactttatgctaagcattgtgaggatataaaagaagtgtacaattcctatttccaaggatatgatacgcattagttggggaagggaaagagagtgagctaaaattcaattacctttctcaattgt

SEQ ID NO: 8443 - DNA, 1485 bp, Homo sapiens; identical to SEQ ID NO: 8442

SEQ ID NO: 8444 - DNA, 5796 bp, Homo sapiens
gagccctgctggggccgtccagtcccccagacctcacaggctcagtcgcggatctgcagtgtcatgcctgggagccctcggcccgcgccaagctgggtgctgttgctgcggctgctggcgttgctgcggcccccggggctgggtgaggcatgcagctgcgccccggcgcaccctcagcagcacatctgccactcggcacttggtgagtccgaggtccgcgaggtccacagcagggggtggttgtgggggattagtatctggccagcagtacaccaggagtccagaggaaaagggaggagctcaaattcttaccggttgtctcttgctgaggctgatgggtggagaaggaccaggcgccatagcaaccttgcaagcccagaacctgactgattcataaggaaatgaagatttcatcagggacttccatagcgacctccctcactccggccatactgcaattatggagtgtcattacacaaggtgtcaccggagctatctgatgattattctgaactactagactggggacagaaaggggaggggagagggcttgcattgtaactacccgtgtctgtccaggcctataactgaggttgccaccaagcccctatggcaacacacacgttctgtcctttctcttccctctgcctggaatgccctccctcacacccttaaattcagaaagactcctactcatccttcaagggctaacttaggtctctccccttctctgcaggctcccgggctccttggtgccgcctcagcatctctaaccgtcttagcgctcctactatgctgtgctgttgttctttacacgtgtgcactccactagatcaagagcttggcaggatggggaccctgtcttaatcacatctatgggcctagtgcctagtgcaaggccaggcacagaggaagaacatcatcaacagtttttggttattaatgctcaaatggcaagagatgcaatacctcagtgcagggtcagaacatttatgaattcaataaacatttactaatatcaactgtaggcgggatgagaggccttgaccacagcaatagataaacttcacaccgactgccctgaaggggctcctcctcccttctctactctgactcctaccctgtgccccactgcacaaacggctatggagaactagagctctccagactaactggttcaaaaggcagaaacagcttagcggttataggacctaataagcctgaggggtttggaacttccagtgactgcaggggaggtgtttccaggtcccccttctcacacatcacgttgctcacaacccagccacaccaaaaccaagaactgccctatagacttcttcatggaccctggatcatccagacctcaggtgtattgcccccaccagctgctgaaggttccctcttttctcttcctatgcagtgattcgggccaaaatctccagtgagaaggtagttccggccagtgcagaccctgctgacactgaaaaaatgctccggtatgaaatcaaacagataaaggtacatgggggcaggctgggatgtgtagcccctaaggctgatggagaaagtggagtctgtgttctgggagggctggtagctttcaggtggcctggctcagtaatccttgggtctagatactgaagtggaactggatgagatttggaggcagagcccatagaatcccagggatattgccagggagggcctcagcatccatctggtcccacagctgctggtgtatggtgccactacaggtacctactggaataaaccaaggtttaggtgtttttttttgttgttgttttgttttaagagagaaaataacccagtagggacatctgaggacacaaaatcctcaactagacttttgcttacatttttaggctgagaagtgagaggtttttgtctgttaatatatacagtacactcactgacccaatattgcctttttttgtaattgcctgtcagatgttcaaagggtttgagaaagtcaaggatgttcagtatatctatacgccttttgactcttccctctgtggtgtgaaactagaagccaacagccagaagcagtatctcttgactggtaagttaaaagaccaacaactggccttaatataatagattctgccctaggggaggtagtgagaaaggagccagggtcttccttgggcagtaggctgagccaggtggcattttcttgggcataaaacagagctgtgttagtgacagacaacctctgggttaggaggagccttgtaacctccctttaaatgtaagagttcttagtacagtgaccctggccaccgtttcactattttaaggacaggctgctcacccagtgtagggcagctgcttccgtttttcaaatagtttaaattagtataagatttttggcaacttgagtcaaagtctcctctctaaaactgctccttgcaggtcaactctgccttttgcacaggacttaacaggagcttgagtctaacatagttctgtctctgtgaacttgggcccaggcaggattcctccatactgaattggctgggatagaacagttaaagaatcacacaaaaatatgactccataaatgaatgcaacattaaattattttggagttcagagaacggaactatttggtagttgtgaactatcagggaagcttcattgtgtaggtgggatctaaactggcctgaaaacataaaacaatatttagaaagaaagcaagggaaagaaaaagcacagcagtgggggagggaacaggtgaagggattccacgatctatccacacattcagcaatgaatgaccacttagtcactgccatgccttggccaggagagtggagattcagtaacaaggcacagtccttaaaagagttcactgtccagacatggctcttgatgagtcataggcactggaggctacaatgataagggcttcctagctctgaggatgtggaattgtacagaactgaggagctcctggatggaagaggcagaggcaggacacaccactgagccctgcagttcccaggtctagcagaccaggccctttcaaactctattatcgcacctccttcctaagcacctgccctctgtgtgtctagcccgctgctaggcatggaggtacagcaggggaaatgaggaaacatgttccctgccttcagggaggtcaagtctaactgagggtggggagaaatgacaaaaaatagtctaagaaaagttatcaatggtgcccaggtcctacaggagaaggcacaagctcctttgcctggtgttgaaagctctttgtgaccagaacactgctgccctctctagctttgtcaatatcagttcccagcccctcactttcccaagaactgaactcagctacctgtggttgcagaaggtatgctgccaggctgtgtctccctgcctctgcacaggatagtggcaatgacaggaagcccttcccccaacctgtttggtaggcagactcccactcatcccttcaaggcccaatgcaagcacagtcttctctgagacaccttctttgccccacactccttccatagatggaaataattgtatgttcctttgttcttatactgcactttgtatagaaccacacaatagtgtaatttttccctacttatccatctaccctactcatttctaagctccttgggagcagagatcctgtcatttttatatctgtattcctggtactagatcacagcagtcactcagtgagtaaatgattgagcgactgaggttctaaaagaggcatgggctagctaggtggtcagagatggctttgaggtggcactgaaagggtctttgaaaggtgaaaaggagcttcataggtaaaaagggggaaatttcctatggggaaggtaaaagactcaccaatctagagcaggagcctggcctgtgcagatactgggaagggctggaaaggggaagggacctattatttattgaatatcttctgtgggaccacactgtgctgggaactttatagacaatctctcatttaatctgacaactttataattttcatcttccagctgagaggttatacaacttccttaagatcattcagctagtaaatgacagaaaagaaagggggatcccacacagactttgactttaaagaccacattcttctctctgtaccatgctaaacgaaaaggccttcaccagatcccacaactctgcctcgtacaaacataatctgcttatctttttgctagaaagattatagtagttttatttattggtcccttcactgagccccatgccaccactgccaccaaagtcattggggaggctgcaattctgggcttttcaaggacctgggcccctggggctccaggagaagaatcctgatgcttgactctcctccatctccccttgaaggtcaggtcctcagtgatggaaaagtcttcatccatctgtgcaactacatcgagccctgggaggacctgtccttggtgcagagggaaagtctgaatcatcactaccatctgaactgtggctgccaagtaagggaatgtccatttccaaagtctttagggatgggggaagggttctgagccttcattcatgcatgaatttattcacttactagactatacttgagatctgcactgtatgaagttggggatgagaaagcaatacagtctataggccctgatctcaaagtacttacactttggctgggaaggtggccatcacaggaggcagaccgagataactgtaacacagctaccctttaaagagagtctattctttgccagccactgtaatagtaaatttactgtaaatgtttaatttagtctccaaaacatatttatgaagaattaagatttccattttaaggtgaagaaatgaaagctctggcaagtgaagtgctcaaggtcagtggtagagtaaggaccctcagagctgtctgactccagagatgccactaagtggcaatattgaatatggggaaccttggggaaggagaatccaggagaagactggggactgggaaaggcttgataagatagggggcatttgagatgggctggaaaggtacgtaggaatctgaaaggcagcaatggaaaaagaaggacaccctactcactttaatgttgtgtggccatgactctagatcaccacctgctacacagtaccctgtaccatctcggcccctaacgagtgcctctggacagactggctgttggaacgaaagctctatggttaccaggctcagcattatgtctgtatgaagcatgttgacggcacctgcagctggtaccggggccacctgcctctcaggaaggagtttgttgacatcgttcagccctagtagggaccagtgaccatcacatcccttcaagagtcctgaagatcaagccagttctccttccctgcagagctttggccattaccacctgacctcttgctgccagctaataagaagtgccaagtggacagtctggccactgtcaaggcagggaaggggccatgacttttctgccctgccctcagcctgttgcccctgcctcccaaaccccattagtctagccttgtagctgttactgcaagtgtttcttctggcttagtctgttttctaaagccaggactattccctttcctccccaggaatatgtgttttcctttgtcttaatcgatctggtaggggagaaatggcgaatgtcatacacatgagatggtatatccttgcgatgtacagtatcagaaggtggtttgacagcatcataaacaggctgactggcaggaatgaaaacaagaacatactgtggctgtgta

SEQ ID NO: 8445 - DNA, 502 bp, Homo sapiens
cagaggaaacacatctctctagggctactggattagttcacactcgaagccactggtatctggcatggctagaagggaaagctgctagatgaaatctatttatcagagaaaggaaggctagaacatttttcaacagctcaggtcctgttctctacaagcgatactggcacataagccagggaggggagacgaggttggggcagtaaaagctcggaactgggttgttagaaaactggaatcttctgattcttgttctgttaacttcctaggtgtccttgggcaaatgagttttcctctctggatctcattttcttcatatataaaatgagatggttaaatttgatcagttcctcaaactttgtaccataaagaatatctctttattatatttcctcccaaactctgctatcaaactgtagtttaagtgatcatctgttgtggtccttttgtaggtatagatatgattttgttatttttgaaatgctggaaaacactggaattc

SEQ ID NO: 8446 - DNA, 5853 bp, Homo sapiens
gagccctgctggggccgtccagtcccccagacctcacaggctcagtcgcggatctgcagtgtcatgcctgggagccctcggcccgcgccaagctgggtgctgttgctgcggctgctggcgttgctgcggcccccggggctgggtgaggcatgcagctgcgccccggcgcaccctcagcagcacatctgccactcggcacttggtgagtccgaggtccgcgaggtccacagcagggggtggttgtgggggattagtatctggccagcagtacaccaggagtccagaggaaaagggaggagctcaaattcttaccggttgtctcttgctgaggctgatgggtggagaaggaccaggcgccatagcaaccttgcaagcccagaacctgactgattcataaggaaatgaagatttcatcagggacttccatagcgacctccctcactccggccatactgcaattatggagtgtcattacacaaggtgtcaccggagctatctgatgattattctgaactactagactggggacagaaaggggaggggagagggcttgcattgtaactacccgtgtctgtccaggcctataactgaggttgccaccaagcccctatggcaacacacacgttctgtcctttctcttccctctgcctggaatgccctccctcacacccttaaattcctggcagactcctactcatccttcaagggctaacttaggtctctccccttctctgcaggctcccgggctccttggtgccgcctcagcatctctaaccgtcttagcgctcctactatgctgtgctgttgttctttacacgtgtgcactccactagatcaagagctcggcaggatggggaccctgtcttaatcacatctatgggcctagtgcctagtgcaaggccaggcacagaggaagaacatcatcaacagtttttggttattaatgctcaaatggcaagagatgcaatacctcagtgcagggtcagaacatttatgaattcaataaacatttactaatatcaactgtaggcgggatgagaggccttgaccacagcaatagataaacttcacaccgactgccctgaaggggctcctcctcccttctctactctgactcctaccctgtgccccactgcacaaacggctatggagaactagagctctccagactaactggttcaaaaggcagaaacagcttagcggttataggacctaataagcctgaggggtttggaacttccagtgactgcaggggaggtgtttccaggtcccccttctcacacatcacgttgctcacaacccagccacaccaaaaccaagaactgccctatagacttcttcatggaccctggatcatccagacctcaggtgtattgcccccaccagctgctgaaggttccctcttttctcttcctatgcagtgattcgggccaaaatctccagtgagaaggtagttccggccagtgcagaccctgctgacactgaaaaaatgctccggtatgaaatcaaacagataaaggtacatgggggcaggctgggatgtgtagcccctaaggctgatggagaaagtggagtctgtgttctgggagggctggtagctttcaggtggcctggctcagtaatccttgggtctagatactgaagtggaactggatgagatttggaggcagagcccatagaatcccagggatattgccagggagggcctcagcatccatctggtcccacagctgctggtgtatggtgccactacaggtacctactggaataaaccaaggtttaggtgttttttgttgttgttgttttgttttaagagagaaaataacccagtagggacatctgaggacacaaaatcctcaactagacttttgcttacatttttaggctgagaagtgagaggtttttgtctgttaatatatacagtacactcactgacccaatattgcctttttttgtaattgcctgtcagatgttcaaagggtttgagaaagtcaaggatgttcagtatatctatacgccttttgactcttccctctgtggtgtgaaactagaagccaacagccagaagcagtatctcttgactggtaagttaaaagaccaacaactggccttaatataatagattctgccctaggggaggtagtgagaaaggagccagggtcttccttgggcagtaggctgagccaggtggcattttcttgggcataaaacagagctgtgttagtgacagacaacctctgggttaggaggagccttgtaacctccctttaaatgtaagagttcttagtacagtgaccctggccaccgtttcactattttaaggacaggctgctcacccagtgtagggcagctgcttccgtttttcaaatagtttaaattagtataagatttttggcaacttgagtcgaagtctcctctctaaaactgctccttgcaggtcaactctgccttttgcacaggacttaacaggagcttgagtctaacatagttctgtctctgtgaacttgggcccaggcaggattcctccatactgaattggctgggatagaacagttaaagaatcacacaaaaatatgactccataaatgaatgcaacattaaattattttggagttcagagaacggaactatttggtagttgtgaactatcagggaagcttcattgtgtaggtgggatctaaactggcctgaaaacataaaacaatatttagaaagaaagcaagggaaagaaaaagcacagcagtgggggagggaacaggtgaagggattccacgatctatccacacattcagcaatgaatgaccacttagtcactgccatgccttggccaggagagtggagattcagtaacaaggcacagtccttaaaagagttcactgtccagacatggctcttgatgagtcataggcactggaggctacaatgataagggcttcctagctctgaggatgtggaattgtacagaactgaggagctcctggatggaagaggcagaggcaggacacaccactgagccctgcagttcccaggtctagcagaccaggccctttcaaactctattatcgcacctccttcctaagcacctgccctctgtgtgtctagcccgctgctaggcatggaggtacagcaggggaaatgaggaaacatgttccctgccttcagggaggtcaagtctaactgagggtggggagaaatgacaaaaaatagtctaagaaaagttatcaatggtgcccaggtcctacaggagaaggcacaagctcctttgcctggtgttgaaagctctttgtgaccagaacactgctgccctctctagctttgtcaatatcagttcccagcccctcactttcccaagaactgaactcagctacctgtggttgcagaaggtatgctgccaggctgtgtctccctgcctctgcacaggatagtggcaatgacaggaagcccttcccccaacctgtttggtaggcagactcccactcatcccttcaaggcccaatgcaagcacagtcttctctgagacaccttctttgccccacactccttccatagatggaaataattgtatgttcctttgttcttatactgcactttgtatagaaccacacaatagtgtaatttttccctacttatccatctaccctactcatttctaagctccttgggagcagagatcctgtcatttttatatctgtattcctggtactagatcacagcagtcactcagtgagtaaatgattgagcgactgaggttctaaaagaggcatgggctagctaggtggtcagagatggctttgaggtggcactgaaagggtctttgaaaggtgaaaaggaatctacggccataccaccctgaacgcgcccgatctcgtctgaaaggtgaaaaggagcttcataggtaaaaagggggaaatttcctatggggaaggtaaaagactcaccaatctagagcaggagcctggcctgtgcagatactgggaagggctggaaaggggaagggacctattatttattgaatatcttctgtgggaccacaactgtgctgggaactttatagacaatctctcatttaatctgacaactttataattttcatcttccagctgagaggttatacaacttccttaagatcattcagctagtaaatgacagaaaagaaagggggatcccacacagactttgactttaaagaccacattcttctctctgtaccatgctaaacgaaaaggccttcaccagatcccacaactctgcctcgtacaaacataatctgcttatctttttgctagaaagattatagtagttttatttattggtcccttcactgagccccatgccaccactgccaccaaagtcattggggaggctgcaattctgggcttttcaaggacctgggcccctggggctccaggagaagaatcctgatgcttgactctcctccatctccccttgaaggtcaggtcctcagtgatggaaaagtcttcatccatctgtgcaactacatcgagccctgggaggacctgtccttggtgcagagggaaagtctgaatcatcactaccatctgaactgtggctgccaagtaagggaatgtccatttccaaagtctttagggatgggggaagggttctgagccttcattcatgcatgaatttattcacttactagactatacttgagatctgcactgtatgaagttggggatgagaaagcaatacagtctataggccctgatctcaaagtacttacactttggctgggaaggtggccatcacaggaggcagactgagataactgtaacacagctaccctttaaagagagtctattctttgccagccactgtaatagtaaatttactgtaaatgtttaatttagtctccaaaacatatttatgaagaattaagatttccattttaaggtgaagaaatgaaagctctggcaagtgaagtgctcaaggtcagtggtagagtaaggaccctcagagctgtctgactccagagatgccactaagtggcaatattgaatatggggaaccttggggaaggagaatccaggagaagactggggactgggaaaggcttgataagatagggggcatttgagatgggctggaaaggtacgtaggaatctgaaaggcagcaatggaaaaagaaggacaccctactcactttaatgttgtgtggccatgactctagatcaccacctgctacacagtaccctgtaccatctcggcccctaacgagtgcctctggacagactggctgttggaacgaaagctctatggttaccaggctcagcattatgtctgtatgaagcatgttgacggcacctgcagctggtaccggggccacctgcctctcaggaaggagtttgttgacatcgttcagccctagtagggaccagtgaccatcacatcccttcaagagtcctgaagatcaagccagttctccttccctgcagagctttggccattaccacctgacctcttgctgccagctaataagaagtgccaagtggacagtctggccactgtcaaggcagggaaggggccatgacttttctgccctgccctcagcctgttgcccctgcctcccaaaccccattagtctagccttgtagctgttactgcaagtgtttcttctggcttagtctgttttctaaagccaggactattccctttcctccccaggaatatgtgttttcctttgtcttaatcgatctggtaggggagaaatggcgaatgtcatacacatgagatggtatatccttgcgatgtacagtatcagaaggtggtttgacagcatcataaacaggctgactggcaggaatgaaaacaagaacatactgtggctgtgta

SEQ ID NO: 8447 - DNA, 1615 bp, Homo sapiens
cagaggaaacacatctctctagggctactggattagttcacactcgaagccactggtatctggcatggctagaagggaaagctgctagatgaaatctatttatcagagaaaggaaggctagaacatttttcaacagctcaggtcctgttctctacaagcgatactggcacataagccagggaggggagacgaggttggggcagtaaaagctcggaactgggttgttagaaaactggaatcttctgattcttgttctgttaacttcctaggtgtccttgggcaaatgagttttcctctctggatctcattttcttcatatataaaatgagatggttaaatttgatcagttcctcaaactttgtaccataaagaatatctctttattatatttcctcccaaactctgctatcaaactgtagtttaagtgatcatctgttgtggtccttttgtaggtatagatatgattttgttatttttgaaatgctggaaaacactggaattcctaggtccctccctttagtgacaaacaattggtgactctagagctctagggcctcctccaggactgaaaggatgattcatggaccctcaagcccctaagataccattgtcaaaagggactttatagagtctctaggccagccctctgatttgacaaattgagattgaggctggagagcaaaggaaagtgcaggctcccggatcacatcctggagtcagggctgcactgcaagagcactcaggtctcttctccttgctgggtgcattcaccattgtaccctgctgtcctcaccgactttggtccttcaatttgctttaactgtcaagaacgaaccctcagacctttcctgccttctctgattctccacacctgctcatctgacctttacgtcctgcctgcccatctgggcctggctggacttctgctctgcctctggacacctgcctgtgctcctaaggctctccagcatccctagggagttaatgccagctctgccaaacgacctctgtcctgctgcagcccacgctctggcatggcaccaagacatgtggggccctacctttccagcatgtgggggagttacacagacaccacacagatgccaggacagcctgtggcagactcccagagccctgggacagccaacacaataatggcagccagttcccaggctctcgttgggtctcagggagctcaccccaccctcctctccagcagtccctgtctgctcaaggtagtgagcttggcatctaacccatagctccctggaaacttagattaaatcacagccacacagtcaccaattaaacaaatgtaacatctgataagggctgttacctctacacatagacaaaagaatgaatttgggagctgggggtgctgttggcaattaataggaagatatgtccattatagccactcatccaatgaatcaagaaagatttcttggaaaaaaatgggattccagatccatttgagtaatgtgtccctatgcctatcactcctggaaattaaatgatttaatttaactctggtgcacttatctccaaaaacccagaaagactcacggaatttcagatagactggcagcaataaacggtggtgccattcttg

SEQ ID NO: 8448 - DNA, 5853 bp, Homo sapiens
gagccctgctggggccgtccagtcccccagacctcacaggctcagtcgcggatctgcagtgtcatgcctgggagccctcggcccgcgccaagctgggtgctgttgctgcggctgctggcgttgctgcggcccccggggctgggtgaggcatgcagctgcgccccggcgcaccctcagcagcacatctgccactcggcacttggtgagtccgaggtccgcgaggtccacagcagggggtggttgtgggggattagtatctggccagcagtacaccaggagtccagaggaaaagggaggagctcaaattcttaccggttgtctcttgctgaggctgatgggtggagaaggaccaggcgccatagcaaccttgcaagcccagaacctgactgattcataaggaaatgaagatttcatcagggacttccatagcgacctccctcactccggccatactgcaattatggagtgtcattacacaaggtgtcaccggagctatctgatgattattctgaactactagactggggacagaaaggggaggggagagggcttgcattgtaactacccgtgtctgtccaggcctataactgaggttgccaccaagcccctatggcaacacacacgttctgtcctttctcttccctctgcctggaatgccctccctcacacccttaaattcctggcagactcctactcatccttcaagggctaacttaggtctctccccttctctgcaggctcccgggctccttggtgccgcctcagcatctctaaccgtcttagcgctcctactatgctgtgctgttgttctttacacgtgtgcactccactagatcaagagctcggcaggatggggaccctgtcttaatcacatctatgggcctagtgcctagtgcaaggccaggcacagaggaagaacatcatcaacagtttttggttattaatgctcaaatggcaagagatgcaatacctcagtgcagggtcagaacatttatgaattcaataaacatttactaatatcaactgtaggcgggatgagaggccttgaccacagcaatagataaacttcacaccgactgccctgaaggggctcctcctcccttctctactctgactcctaccctgtgccccactgcacaaacggctatggagaactagagctctccagactaactggttcaaaaggcagaaacagcttagcggttataggacctaataagcctgaggggtttggaacttccagtgactgcaggggaggtgtttccaggtcccccttctcacacatcacgttgctcacaacccagccacaccaaaaccaagaactgccctatagacttcttcatggaccctggatcatccagacctcaggtgtattgcccccaccagctgctgaaggttccctcttttctcttcctatgcagtgattcgggccaaaatctccagtgagaaggtagttccggccagtgcagaccctgctgacactgaaaaaatgctccggtatgaaatcaaacagataaaggtacatgggggcaggctgggatgtgtagcccctaaggctgatggagaaagtggagtctgtgttctgggagggctggtagctttcaggtggcctggctcagtaatccttgggtctagatactgaagtggaactggatgagatttggaggcagagcccatagaatcccagggatattgccagggagggcctcagcatccatctggtcccacagctgctggtgtatggtgccactacaggtacctactggaataaaccaaggtttaggtgttttttgttgttgttgttttgttttaagagagaaaataacccagtagggacatctgaggacacaaaatcctcaactagacttttgcttacatttttaggctgagaagtgagaggtttttgtctgttaatatatacagtacactcactgacccaatattgcctttttttgtaattgcctgtcagatgttcaaagggtttgagaaagtcaaggatgttcagtatatctatacgccttttgactcttccctctgtggtgtgaaactagaagccaacagccagaagcagtatctcttgactggtaagttaaaagaccaacaactggccttaatataatagattctgccctaggggaggtagtgagaaaggagccagggtcttccttgggcagtaggctgagccaggtggcattttcttgggcataaaacagagctgtgttagtgacagacaacctctgggttaggaggagccttgtaacctccctttaaatgtaagagttcttagtacagtgaccctggccaccgtttcactattttaaggacaggctgctcacccagtgtagggcagctgcttccgtttttcaaatagtttaaattagtataagatttttggcaacttgagtcgaagtctcctctctaaaactgctccttgcaggtcaactctgccttttgcacaggacttaacaggagcttgagtctaacatagttctgtctctgtgaacttgggcccaggcaggattcctccatactgaattggctgggatagaacagttaaagaatcacacaaaaatatgactccataaatgaatgcaacattaaattattttggagttcagagaacggaactatttggtagttgtgaactatcagggaagcttcattgtgtaggtgggatctaaactggcctgaaaacataaaacaatatttagaaagaaagcaagggaaagaaaaagcacagcagtgggggagggaacaggtgaagggattccacgatctatccacacattcagcaatgaatgaccacttagtcactgccatgccttggccaggagagtggagattcagtaacaaggcacagtccttaaaagagttcactgtccagacatggctcttgatgagtcataggcactggaggctacaatgataagggcttcctagctctgaggatgtggaattgtacagaactgaggagctcctggatggaagaggcagaggcaggacacaccactgagccctgcagttcccaggtctagcagaccaggccctttcaaactctattatcgcacctccttcctaagcacctgccctctgtgtgtctagcccgctgctaggcatggaggtacagcaggggaaatgaggaaacatgttccctgccttcagggaggtcaagtctaactgagggtggggagaaatgacaaaaaatagtctaagaaaagttatcaatggtgcccaggtcctacaggagaaggcacaagctcctttgcctggtgttgaaagctctttgtgaccagaacactgctgccctctctagctttgtcaatatcagttcccagcccctcactttcccaagaactgaactcagctacctgtggttgcagaaggtatgctgccaggctgtgtctccctgcctctgcacaggatagtggcaatgacaggaagcccttcccccaacctgtttggtaggcagactcccactcatcccttcaaggcccaatgcaagcacagtcttctctgagacaccttctttgccccacactccttccatagatggaaataattgtatgttcctttgttcttatactgcactttgtatagaaccacacaatagtgtaatttttccctacttatccatctaccctactcatttctaagctccttgggagcagagatcctgtcatttttatatctgtattcctggtactagatcacagcagtcactcagtgagtaaatgattgagcgactgaggttctaaaagaggcatgggctagctaggtggtcagagatggctttgaggtggcactgaaagggtctttgaaaggtgaaaaggaatctacggccataccaccctgaacgcgcccgatctcgtctgaaaggtgaaaaggagcttcataggtaaaaagggggaaatttcctatggggaaggtaaaagactcaccaatctagagcaggagcctggcctgtgcagatactgggaagggctggaaaggggaagggacctattatttattgaatatcttctgtgggaccacaactgtgctgggaactttatagacaatctctcatttaatctgacaactttataattttcatcttccagctgagaggttatacaacttccttaagatcattcagctagtaaatgacagaaaagaaagggggatcccacacagactttgactttaaagaccacattcttctctctgtaccatgctaaacgaaaaggccttcaccagatcccacaactctgcctcgtacaaacataatctgcttatctttttgctagaaagattatagtagttttatttattggtcccttcactgagccccatgccaccactgccaccaaagtcattggggaggctgcaattctgggcttttcaaggacctgggcccctggggctccaggagaagaatcctgatgcttgactctcctccatctccccttgaaggtcaggtcctcagtgatggaaaagtcttcatccatctgtgcaactacatcgagccctgggaggacctgtccttggtgcagagggaaagtctgaatcatcactaccatctgaactgtggctgccaagtaagggaatgtccatttccaaagtctttagggatgggggaagggttctgagccttcattcatgcatgaatttattcacttactagactatacttgagatctgcactgtatgaagttggggatgagaaagcaatacagtctataggccctgatctcaaagtacttacactttggctgggaaggtggccatcacaggaggcagactgagataactgtaacacagctaccctttaaagagagtctattctttgccagccactgtaatagtaaatttactgtaaatgtttaatttagtctccaaaacatatttatgaagaattaagatttccattttaaggtgaagaaatgaaagctctggcaagtgaagtgctcaaggtcagtggtagagtaaggaccctcagagctgtctgactccagagatgccactaagtggcaatattgaatatggggaaccttggggaaggagaatccaggagaagactggggactgggaaaggcttgataagatagggggcatttgagatgggctggaaaggtacgtaggaatctgaaaggcagcaatggaaaaagaaggacaccctactcactttaatgttgtgtggccatgactctagatcaccacctgctacacagtaccctgtaccatctcggcccctaacgagtgcctctggacagactggctgttggaacgaaagctctatggttaccaggctcagcattatgtctgtatgaagcatgttgacggcacctgcagctggtaccggggccacctgcctctcaggaaggagtttgttgacatcgttcagccctagtagggaccagtgaccatcacatcccttcaagagtcctgaagatcaagccagttctccttccctgcagagctttggccattaccacctgacctcttgctgccagctaataagaagtgccaagtggacagtctggccactgtcaacgcagggaaggggccatgacttttctgccctgccctcagcctgttgcccctgcctcccaaaccccattagtctagccttgtagctgttactgcaagtgtttcttctggcttagtctgttttctaaagccaggactattcccttttctccccaggaatatgtgttttcctttgtcttaatcgatctggtaggggagaaatggcgaatgtcatacacatgagatggtatatccttgcgatgtacagtatcagaaggtggtttgacagcatcataaacaggctgactggcaggaatgaaaacaagaacatactgtggctgtgta

SEQ ID NO: 8449 - DNA, 1941 bp, Homo sapiens
ccaaagtgctgggattacaggcatgagacaccattgcccggcccaggtggaatttttattaatataattagtaccacagttttgctttagtcccaaatttgagtggcctcctcctgcttggaggagggctttctgctcctgtagttcttaccaattaaggaatcaaaatgtgcacataaaaaaatgacttataggcacttacacatacagtattataaatggttcatcaatgttgagattattttgcacaatactacctgtatttctgtttttgtccaacccactatacatgccttaaaggactaaaatcagattggttaaggcaacaacttccccatatttttatttaatttgaataaatgttttcttataaaatatgtttagatttacagaaaagttacagggagttaaggtataccttgcacccagtttcccctatttttttttttttgtaagaaatgggggtctcgtcatgttgccagtgtctgacatttcaatgttaaatttgtcaccgttaaggaaccaatgttggtacattactactaactaaaattcatttatttggattttgttagtttttacctaaggttcttttttggttccaggatcctatccagaatacgacaatacatttagttgacatcttcccttagcctatctgggctgtgatggcatttcagactttccttgtttttgatgactttgatggttttgaggagtattggtcagggattttgtagaatgtccctcagtttgggtttgtctgatgttttcttcatggttagactgggattatgggtttgggggaggagagtcacagagataaagtgccgctctcattgcatcatatcaaggggaaatactatcagtacggcttatcactgatattgttaacctcggtcaccaggctgagctagtgtttgccaggtttctttactgtattgttttcccgtactcgtctttttggaaacaagtcattaattgtagaccacactcagtaggtctgttttcttaaaggggagctgtctataaaattatttggaattcttctgctatggatagtctttttttcttctccgtttatatatttattcaatcatttatttatatatgtatggactcatagatggttattttatacttggggtcataatcctatactactttatttattttgttgctcaaatttttctaccaacaggacatactccattgttttgttttttgagtacttccttactttctggcactagaagaagttccagactcatcttgtatatttcctgccccagccctagaatcagccatttttccaaggatccctggttctattttttggtgaatcatgttagaaaccaagatctggttactcagtgtgctcattgctgttggaatatcatgacttctaggccttttcagtgtatagacctggaaaatatatgtatgtatacacatatataactattatctgtatctatattgaggtaaacatgagttcatactgatgactttgactatcagtactatatagttcattctggctttactctgctatctattacctccctctccaaaagtgagaaatctggctcacgccatctgacatctattaacttatttgttcagtcccatcgtccatgtacagcacttttagaattgttaacctgtatctccatgagaaatgcctttaccaaaaaagaacagtgcttatatacagttctttttgttgttagagtttccagtttcaagtttcccaaagttacttaaatcaaaccttttcccctgacatctgtattttaattttatttttaataaattgatctaaattacatggtaattatatataaagcttataaaaaatttcccttgcccaactaaagatctttagctttagatgtgtttttttttcctcctgacttttgtgaccaaaaaaaaaaaaaa

SEQ ID NO: 8450 - DNA, 501 bp, Homo sapiens
gcatccttgttccaacttctgcgttattaggaactatttccttactttttcgtagttttcctgtcttcggttttatctccttgagattcaccttctcagaattgccagaatggtatgtttgaaacataaacctgaaaattctttactgactccccattgtcaacatgataaggttttagtatgtcattaaaactctccatgacttggcttctacctggttctctaatcttaactctagtaatttctgctttctactttccactccaactctgcagagctactttttgaagatttgctgaatatacgtactatttctggattgttgaccattgcttatgtagtccttctgcctggaatgcctttgtttcctccttcctttttctttttgcctacctaactcctttacaacttttaggactcagctgggcattactttctctagaacgccttctcagatccatactcttgcctggataattgggtccctcccagaataatcta

SEQ ID NO: 8451 - DNA, 603 bp, Homo sapiens
ttatttttttctgccctcaatccttgttgatactgtaggtgtagttcatttatttacacagctgtatagtgttccagtgaatgaatatatacaatttatcatttcttctattgatgagcatttaaattgttttcattttttatctattataaacattgcctcatgaatattcttgtagctcctgaagcaacatgccatagtttctccaggtcatatacctgactgtcaaattgctgggtcctaggatataaatatttttccctttataagatatttataggatattgcaaacaatttctgttttttcatatccttgccagcagttagggttatcaaattctttgatttcttactgatttgtaagtttttttgtttgtttttaggtattttcaggatagttacaaatgttaggaaaacttatttttatttggcttttgaagtttccagatttcttgaacagtgaccaatatggacccaagttactgtaattttgtcctatagtatatattgttgatagtgagctttccaatgtactttctccaagtatgtttagttatgctccttttctgagaccatgaggaagtgtttcagtgtttcagaatt

SEQ ID NO: 8452 - DNA, 2287 bp, Homo sapiens
gtcaccctaacaccagattactttccccaagacatgccaggatcatttcttctagcccagctgtgttcgaactagcccttcaccaagtggttcagtttccttggtggggcctgtatgattgtgaggggctgggggaagtctggaggcgggtgtcagggaagtatgaagcccagttcctgccacaaggttcacacccaatgaatggtcactgttattacacaggatggtaggcttgtggtttgttttttccctctattctttggtcacttttctataagcatattatttttagaatcagaaaaaaaaactcatgaaacaaaagaaatgtgatgagtgatttacagggagcaaagggcagagagagagagacagaaagagagagagagagacagatgctctttagaaaccgtggctctgggccccggaatttaatctgcagttaaggaggctgagagaggcaggtgggtgcacccacaggtctcctaactgagaacttcctgcctttgagcccacctactagtccccaggttacagatctcagggaaaccccagggctcccaccccctccacacacacacccactcccagtcaggcggcctgtgagcctgggttggggctaaccggaacccagccagcctctctcccaccttctaccttctgttctcaatgctgtgcccctgggctggggcagcctgagctaggtgatgtcgagccaggaacaagagccaaggaccacagaacctgcttttggttccacatgtctctgccccatcttcctttttctttttccacctcgtttctttttttttctcttttctttctctctcccttcctttcctttcccttgcctcccccattccccttcccttccttttctttcttccttccttcctttctttttctctttctttctttttctttctttctttctctttctttctttccctctctctccctcccttccttccttcctcccttccttcctctctttctttctttctttctctctttctctctttctttctctctttctctctttctttctttttcttagagaaaggatgtccctctgttgcccaggctgcagtgaagtagcacaaccatggctcactgtaaccttgaactcctgggctcaagcaatcctcctgcctcaacctcctgagttgctgggactacaggtgtgagcaaatgcacccggcacttttctccttttttattttaaatacttttagagtaattcctttacataaattgaacttcataaaaagttagaactttgcacattaaaagacactatcaacagagtgaaaagaccatccaagaatgagatacagtatttgcaaatcatatatccgattggggattaatccaggatatctaaagaactctaaaactcagtaacaacaaaaacccaaacaacccaattcaagaaatgagaaaaggacttgaatagacatttttccaaaaaagatatacaaatgatatacacatgatatacaaaatgatatacaaatgatatacaaaaagatatacacattaaaatatgttcacatcactgatcactagagaaatacaaatcaaaaccacaatgagataccacttcgtactcattagggtagctattatcaaaaaacaagtaacaagtattggtacggatgtggagaaattggtgcccttgtgcattgccggtgggaatgtaaaatgaggcaacctcagtggaaaacggtaggcagtttctcaaaaaattaaacagaataaccatagggtccagcaattccacttccaagtataaacacaaaagaattagaacagggactcaaacagatttttttttccttttcttgcttttctttctttctttcttttttttttttttttttttggagacagagtctcactctgttgcacaggctagagtgcagtggtgcgatcttggctcactacaacctccacctaccaggttcaagcgattctcctgcctcagcctctgggatagctgggactacaggcacactaccaccatacctggctaatttttgtatttttgatagagacagggtttcaccatgttggccaggctggtcttgaactcttggcctcaagtgatctgcccagcccacctcggcctcccaaagtgctggggttacaggtgtgagccaccgcacccagcctcgaacagatatttgtatactcatgttcataacagtattattcacaatagtaaaggtggaaacaacctaaatgttcactgacaaatgaataaataaacaaaatgtgatacaataaa

SEQ ID NO: 8453 - DNA, 2287 bp, Homo sapiens
gtcaccctaacaccagattactttccccaagacatgccaggatcatttcttctagcccagctgtgttcgaactagcccttcaccaagtggttcagtttccttggtggggcctgtatgattgtgaggggctgggggaagtctggaggcgggtgtcagggaagtatgaagcccagttcctgccacaaggttcacacccaatgaatggtcactgttattacacaggatggtaggcttgtggtttgttttttccctctattctttggtcacttttctataagcatattatttttagaatcagaaaaaaaaactcatgaaacaaaagaaatgtgatgagtgatttacagggagcaaagggcagagagagagagacagaaagagagagagagagacagatgctctttagaaaccgtggctctgggccccggaatttaatctgcagttaaggaggctgagagaggcaggtgggtgcacccacaggtctcctaactgagaacttcctgcctttgagcccacctactagtccccaggttacagatctcagggaaaccccagggctcccaccccctccacacacacacccactcccagtcaggcggcctgtgagcctgggttggggctaaccggaacccagccagcctctctcccaccttctaccttctgttctcaatgctgtgcccctgggctggggcagcctgagctaggtgatgtcgagccaggaacaagagccaaggaccacagaacctgcttttggttccacatgtctctgccccatcttcctttttctttttccacctcgtttctttttttttctcttttctttctctctcccttcctttcctttcccttgcctcccccattccccttcccttccttttctttcttccttccttcctttctttttctctttctttctttttctttctttctttctctttctttctttccctctctctccctcccttccttccttcctcccttccttcctctctttctttctttctttctctctttctctctttctttctctctttctctctttctttctttttcttagagaaaggatgtccctctgttgcccaggctgcagtgaagtagcacaaccatggctcactgtaaccttgaactcctgggctcaagcaatcctcctgcctcaacctcctgagttgctgggactacaggtgtgagcaaatgcacccggcacttttctccttttttattttaaatacttttagagtaattcctttacataaattgaacttcataaaaagttagaactttgcacattaaaagacactatcaacagagtgaaaagaccatccaagaatgagatacagtatttgcaaatcatatatccgattggggattaatccaggatatctaaagaactctaaaactcagtaacaacaaaaacccaaacaacccaattcaagaaatgagaaaaggacttgaatagacatttttccaaaaaagatatacaaatgatatacacatgatatacaaaatgatatacaaatgatatacaaaaagatatacacattaaaatatgttcacatcactgatcactagagaaatacaaatcaaaaccacaatgagataccacttcgtactcattagggtagctattatcaaaaaacaagtaacaagtattggtacggatgtggagaaattggtgcccttgtgcattgccggtgggaatgtaaaatgaggcaacctcagtggaaaacggtaggcagtttctcaaaaaattaaacagaataaccatagggtccagcaattccacttccaagtataaacacaaaagaattagaacagggactcaaacagatttttttttccttttcttgcttttctttctttctttctttcttttttttttttttttggagacagagtctcactctgttgcacaggctagagtgcagtggtgcgatcttggctcactacaacctccacctaccaggttcaagcgattctcctgcctcagcctctgggatagctgggactacaggcacactaccaccatacctggctaatttttgtatttttgatagagacagggtttcaccatgttggccaggctggtcttgaactcttggcctcaagtgatctgcccagcccacctcggcctcccaaagtgctggggttacaggtgtgagccaccgcacccagcctcgaacagatatttgtatactcatgttcataacagtattattcacaatagtaaaggtggaaacaacctaaatgttcactgacaaatgaataaataaacaaaatgtgatacaataaa

SEQ ID NO: 8454 - DNA, 101 bp, Homo sapiens
cctgtagtcccagctacttgggaggctgaggcaggagaatcgcttgaacccgggaggtagatgttgcagtgagcctagattgtgccactgcactccagtct

SEQ ID NO: 8455 - DNA, 136 bp, Homo sapiens
tttctttctttttttttttcctttttgtggagaacaaggtctcactatattgcccaagcaggtctcgaactcctgggctcaagctatcctcccgcctctgcctccctaagagctgggattacaggcatgagccacc

SEQ ID NO: 8456 - DNA, 136 bp, Homo sapiens; identical to SEQ ID NO: 8455

SEQ ID NO: 8457 - DNA, 5322 bp, Homo sapiens
cttcatataatttttaatagtagttgaaagttttgatgtttcatgacagcctatcccataaagatcactgaattgacatgctgttggcagtaaattttttaaagtagaataactttctatgactatataagcaaaatatttccataattaatccacatggtaataagagatgggtaaattgaagaaatgtccttgaagttattcttttaacagatgttcttaactattagcttcatgtttttacccacctaaatttccaaataattgaataaaagttaacatatgctttcctccccttaatgggcagagcccataattgatacaaagtttaccacagtagagaaattaccttcagtggtacttttctaatgtttttctttcttctaccctatcactgaccatcctgttcaccaattatttttccttttttttttaatatagagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaaggtatttccttgcattttgatttaatgtatatgtatttatataatacatagtatgcacatatgcacgtgtatagatatatatacacacttcacttttttgttgatataatactaagataatgaaaaaattaattgactgagattttattgagctgtgacagctcatcatagtagtcttcacacacacctccacactgaattaatgaatgcagtagaaattcaattatttgcattctgattatgtgactttcatttagtcagacttgaattattcgcgtttaaattatctagctaaaaaaatacccaactgcactccaaatggctaattaaaagtccaaatttcctgtctctctttgtgactggagataattaaagttctcctctgttactcaggctttgagtgtgttgtgaaaaccaatttcctctttttattattttccccctctcttcttttccagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaatcaactttgccggatcacttattttatacaagagaatatattctgccttagacccaaactcagtgttttttattttttatgaggaaatttggtaaaacatggtttaatattagctatagttgtacatatttgaggcttttagccttggtttagttgtttcaatgtccacacactggcttcttaaaactgatttcttgcagctgagatatttagatgaacttcagttcccagtggttttcttgctttgtctcttatttttctctggcatattttttataaagctttctttaggaaaaagaaaataattactgatgtagctaacttgaatagatgtttatttaacactatttttaatgtgacttaaatgtaaagaattctaatcctggattctttatgattacaatacagcaaaactgcattttccctggctgattcttaaagggtaaactattcacctataaagccaacttacgtgttttgttgtagaactagatttatatataacccaaaggtgtcaacagcactgaacgtcaacaacctgttacttcggcttcttataaagtctcacttagaagaaagttacttaattctagttaaaatttcaagttttaaaaattactagggacaaacaagtatttatttttaagcagatactattccttaagatatgaagtatcttgccagtttttcaaacctagtccacattttattgaataattaaatacaaacaagtgatatgcagtataaagtaaaagaacaaagtttcttttatgacaattaagaagttaaacaacttcatttagcctggccacaataaccgttatatccaacagtaaactggacgttgttttgaatttggtttgtatttgttggatgccttaaggattcattattattgagctactgtgataccaataaggttttcagtatttgagctataaaagacaaccccttttcattagaggccccttaacattttaaacgaaaataacaaagcttattctgtttctaaatagtcttcctcttaatatttaaattacttagctggtatcctgtgaatacaaggcaacatcttttcaatgaaggaaacaatttcagtacaattttgtgtttttgtttggaatatagaccttttcttagtttattatatataaacacattttcaaatacaaaatactgtctgaaattagttactgcaatttgacattcaaagcatagaattttctttgcaaataaaggtcataagaaattaataattttaatagagtggagttcaaaaatttcagaaggatgtaaataagcaacaatttctttaacatttgctatatatacaaaggactttggttctattctttgccatatgcatcttacaaacgagtcaccattgtccctttttagcagacacaattgcgcttcactcctactgcaaacttttctagatcatgagcagtgcattggacactaatttattttagctgcgcaaactctggtagttaatgaccctttctctttctccaaaattccaaagacttcttttcaaaagatatagaggaaaagagaaaaaaaaccattaagctacaatttcctgctgaatttaaactctggtctaaagacactatgtaaatggcttatgctaaagaggaaaataccctttctcccccgacgagaagtgtagattcatccaaccccacaccgcttgtctttgctgctagaggcacagcacgggcataacttgtggttgtgtttttgctagtttcttacctctgggccttctttatagctttgccccccaccccactggcggtggcgctcccgcggctgcaccctcggccgcctgttggttgcggcgcctccgcggcccgcgcgcatcccccgcgctgcgtcccgcacacgcgcgctcccgccgcgtcccgcccgggccgctccgctggcggcggcgactgggctgcaggtagcgagccagccggcctcggtccggtaacccatggcaaccgccctggtaacccatggcaactgcgcggcggaaagaaaaaaaagaaccgtggtggggcggggggcggcgggcggtgaatgggaacaacgaccgcaaagagacagcgatttaccgcgcgggcctgcggctcccggccgcacctgctgcagacggcccgcgaggccccttcccgcgctacggtgacgattctggctgctggggaaaagagcaataagcagaaagccctcgtgcagaggggatccgggcggtgcacttggtgtgggaggctgccttaaacgccgatgaccctcccggcctccgcgtgtcccggcttccagggccccgccaggctggagagcgcgcgtggagagggccttgccgcctgggggttggttgaggggcgg

SEQ ID NO: 8458 - DNA, 6926 bp, Homo sapiens
atggcagtattgagcagaaaaagaaaacgctgggaaataatgagtctaatgtacagtaaaattggaaattgaattatagctcaagaaaaaggacagtagccttgaggtcccgatcaacctggactctgatcacttttgtttgctgtacccatgtgttaagttactagcaagttaataacaacacgtgagcagttcaaggctcagtagaattgcttcagacatgaaataaagctaaaatgaatttgtgtccaatatcattggcattagtgctcattactgttgtggtgtaatgcctcaaaccatctaaaatcaattttaaagattacccattattttataaagaaaataaaacacatttccaacagaaacaaagccacgagtacaatcccatgaacagttccttgtacttatggcaggcaggaaaccgctgacagaggccacaggaaacactctgctcagacttcacagacttcacgatccaagttcgtattaatggattgttgctctataactcttctcttaatctgaagtatttaaaaacaagaatggtgaatatttgtaaatgtagaaaataaatctcaaagagtagtaagagggatttactacttagctacttgtacttggtaaattaatcattatcatgtgacatggtcatcttttgggaggacccagggcggaggacacagagggaaaaagaaggatttagctgctttgcttgaggttttgccttttaaaaagcacaaaggttttacttttccttctaatagaccagtaaagaatattttctcaaactgtaaacctgctgaagcaaaggggacagctagattttggttttaatactgtgcatttttaggcatttttgcctttgttaagaaataattgttttattttgtagaaaaggatttggtattataatgaccttggattttcactaaattgatattaatggccaaaagagatttactttccttattacttgtttaaacaagcagaatataaggtaaggttcatttggtctgaaatacatgatctatttttcacagatcgttatatcggaaaaatcttatgttggacaaaattctacttgggttttagtgtgttagttttgtcccctgtatctggtcttagtgtctcctcttacataattattgaactatcagtagagactaaatgatcatatgtcaacatctttgctaaaagataaaccagtttttatttaaatataaaggtatactttgatttgatttcatattctaagatgtgcatttcagagaaaacacattcactaatatgaatttgagcatctgtagattttgctacaggatagtttttaatcttccatgtagttctgatgccctggttgaaatctgttctgtctttgtaaactttgatcttaaatgtgggaagagcagtatgtattcatcacaaaattatcatattttaattatatatatggtaaagttggctgggatcaattttatttggttgctcattttgacaacacagagattcagtgctcctaaagattttggagaaatttacagttaaccttaagtattaaaaaaagccatctctctcatgagctgtcgtaaacatgcccttaagtatataactgtaaagttttaaaatgtaaaatatgctgagaattgtattttcttcatataatttttaatagtagttgaaagttttgatgtttcatgacagcctatcccataaagatcactgaattgacatgctgttggcagtaaattttttaaagtagaataactttctatgactatataagcaaaatatttccataattaatccacatggtaataagagatgggtaaattgaagaaatgtccttgaagttattcttttaacagatgttcttaactattagcttcatgtttttacccacctaaatttccaaataattgaataaaagttaacatatgctttcctccccttaatgggcagagcccataattgatacaaagtttaccacagtagagaaattaccttcagtggtacttttctaatgtttttctttcttctaccctatcactgaccatcctgttcaccaattatttttccttttttttttaatatagagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaaggtatttccttgcattttgatttaatgtatatgtatttatataatacatagtatgcacatatgcacgtgtatagatatatatacacacttcacttttttgttgatataatactaagataatgaaaaaattgactgagattttattgagctgtgacagctcatcatagtagtcttcacacacacctccacactgaattaatgaatgcagtagaaattcaattatttgcattctgattatgtgactttcatttagtcagacttgaattattcgcgtttaaattatctagctaaaaaaatacccaactgcactccaaatggctaattaaaagtccaaatttcctgtctctctttgtgactggagataattaaagttctcctctgttactcaggctttgagtgtgttgtgaaaaccaatttcctctttttattattttccccctctcttcttttccagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaatcaactttgccggatcacttattttatacaagagaatatattctgccttagacccaaactcagtgttttttattttttatgaggaaatttggtaaaacatggtttaatattagctatagttgtacatatttgaggcttttagccttggtttagttgtttcaatgtccacacactggcttcttaaaactgatttcttgcagctgagatatttagatgaacttcagttcccagtggttttcttgctttgtctcttatttttctctggcatattttttataaagctttctttaggaaaaagaaaataattactgatgtagctaacttgaatagatgtttatttaacactatttttaatgtgacttaaatgtaaagaattctaatcctggattctttatgattacaatacagcaaaactgcattttccctggctgattcttaaagggtaaactattcacctataaagccaacttacgtgttttgttgtagaactagatttatatataacccaaaggtgtcaacagcactgaacgtcaacaacctgttacttcggcttcttataaagtctcacttagaagaaagttacttaattctagttaaaatttcaagttttaaaaattactagggacaaacaagtatttatttttaagcagatactattccttaagatatgaagtatcttgccagtttttcaaacctagtccacattttattgaataattaaatacaaacaagtgatatgcagtataaagtaaaagaacaaagtttcttttatgacaattaagaagttaaacaacttcatttagcctggccacaataaccgttatatccaacagtaaactggacgttgttttgaatttggtttgtatttgttggatgccttaaggattcattattattgagctactgtggtaccaataaggttttcagtatttgagctataaaagacaaccccttttcattagaggccccttaacattttaaacgaaaataacaaagcttattctgtttctaaatagtcttcctcttaatatttaaattacttagctggtatcctgtgaatacaaggcaacatcttttcaatgaaggaaacaatttcagtacaattttgtgtttttgtttggaatatagaccttttcttagtttattatatataaacacattttcaaatacaaaatactgtctgaaattagttactgcaatttgacattcaaagcatagaattttctttgcaaataaaggtcataagaaattaataattttaatagagtggagttcaaaaatttcagaaggatgtaaataagcaacaatttctttaacatttgctatatatacaaaggactttggttctattctttgccatatgcatcttacaaacgagtcaccattgtccctttttagcagacacaattgcgcttcactcctactgcaaacttttctagatcatgagcagtgcattggacactaatttattttagctgcgcaaactctggtagttaatgaccctttctctttctccaaaattccaaagacttcttttcaaaagatatagaggaaaagagaaaaaaaaccattaagctacaatttcctgctgaatttaaactctggtctaaagacactatgtaaatggcttatgctaaagaggaaaataccctttctcccccgacgagaagtgtagattcatccaaccccacaccgcttgtctttgctgctagaggcacagcacgggcataacttgtggttgtgtttttgctagtttcttacctctgggccttctttatagctttgccccccaccccactggcggtgcgctcccgcggctgcaccctcggccgcctgttggttgcgggcctccgggcccaccgcattcccccgcgctgcgtcccgcacacggcgctcccgccggctcccgcccgggccgctccgctggcgcgcgaactgggctgcaggtagcgagccagccggcctcggtcccgtaacccatggcaaccgccctggtaacccatggcaactgcgcggcggaaagaaaaaaaagaaccgtggtggggcggggggcggcgggcggtgaatgggaacaacgaccgcaaagagacagcgatttagccgcgcgggcctgcggtcccggcgcacctgctgcaggagcgccgcgaggccccattcccgcgctacggtgacgattctggctgctggggaaaagagcaataagcagaaagccctcgtgcagaggggatccgggcggtgcacttggtgtgggaggctgccttaaacgctcgatgaccctcccggcctcccgtgtcccggcttccaggcccgccaggctggagagcgcgcg

SEQ ID NO: 8459 - DNA, 6928 bp, Homo sapiens
atggcagtattgagcagaaaaagaaaacgctgggaaataatgagtctaatgtacagtaaaattggaaattgaattatagctcaagaaaaaggacagtagccttgaggtcccgatcaacctggactctgatcacttttgtttgctgtacccatgtgttaagttactagcaagttaataacaacacgtgagcagttcaaggctcagtagaattgcttcagacatgaaataaagctaaaatgaatttgtgtccaatatcattggcattagtgctcattactgttgtggtgtaatgcctcaaaccatctaaaatcaattttaaagattacccattattttataaagaaaataaaacacatttccaacagaaacaaagccacgagtacaatcccatgaacagttccttgtacttatggcaggcaggaaaccgctgacagaggccacaggaaacactctgctcagacttcacagacttcacgatccaagttcgtattaatggattgttgctctataactcttctcttaatctgaagtatttaaaaacaagaatggtgaatatttgtaaatgtagaaaataaatctcaaagagtagtaagagggatttactacttagctacgtgtacttggtaaattaatcattatcatgtgacatggtcatcttttgggaggacccagggcggaggacacagagggaaaaagaaggatttagctgctttgcttgaggttttgccttttaaaaagcacaaaggttttacttttccttctaatagaccagtaaagaatattttctcaaactgtaaacctgctgaagcaaaggggacagctagattttggttttaatactgtgcatttttaggcatttttgcctttgttaagaaataattgttttattttgtagaaaaggatttggtattataatgaccttggattttcactaaattgatattaatggccaaaagagatttactttccttattacttgtttaaacaagcagaatataaggtaaggttcatttggtctgaaatacatgatctatttttcacagatcattatatcggaaaaatcttatgttggacaaaattctacttgggttttagtgtgttagttttgtcccctgtatctggtcttagtgtctcctcttacataattattgaactattagtagagactaaatgatcatatgtcaacatctttgctaaaagataaaccagtttttatttaaatataaaggtatactttgatttgatttcatattctaagatgtgcatttcagagaaaacacattcactaatatgaatttgagcatctgtagattttgctacaggatagtttttaatcttccatgtagttctgatgccctggttgaaatctgttctgtctttgtaaactttgatcttaaatgtgggaagagcagtatgtattcatcacaaaattatcatattttaattatatatatggtaaagttggctgggatcaattttatttggttgctcattttgacaacacagagattcagtgctcctaaagattttggagaaatttacagttaaccttaagtattaaaaaaagccatctctctcatgagctgtcgtaaacatgcccttaagtatataactgtaaagttttaaaatgtaaaatatgctgagaattgtattttcttcatataatttttaatagtagttgaaagttttgatgtttcatgacagcctatcccataaagatcactgaattgacatgctgttggcagtaaattttttaaagtagaataactttctatgactatataagcaaaatatttccataattaatccacatggtaataagagatgggtaaattgaagaaatgtccttgaagttattcttttaacagatgttcttaactattagcttcatgtttttacccacctaaatttccaaataattgaataaaagttaacatatgctttcctccccttaatgggcagagcccataattgatacaaagtttaccacagtagagaaattaccttcagtggtacttttctaatgtttttctttcttctaccctatcactgaccatcctgttcaccaattatttttccttttttttttaatatagagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaaggtatttccttgcattttgatttaatgtatatgtatttatataatacatagtatgcacatatgcacgtgtatagatatatatacacacttcacttttttgttgatataatactaagataatgaaaaaattaattgactgagattttattgagctgtgacagctcatcatagtagtcttcacacacacctccacactgaattaatgaatgcagtagaaattcaattatttgcattctgattatgtgactttcatttagtcagacttgaattattcgcgtttaaattatctagctaaaaaaatacccaactgcactccaaatggctaattaaaagtccaaatttcctgtctctctttgtgactggagataattaaagttctcctctgttactcaggctttgagtgtgttgtgaaaaccaatttcctctttttattattttccccctctcttcttttccagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaatcaactttgccggatcacttattttatacaagagaatatattctgccttagacccaaactcagtgttttttattttttatgaggaaatttggtaaaacatggtttaatattagctatagttgtacatatttgaggcttttagccttggtttagttgtttcaatgtccacacactggcttcttaaaactgatttcttgcagctgagatatttagatgaacttcagttcccagtggttttcttgctttgtctcttatttttctctggcatattttttataaagctttctttaggaaaaagaaaataattactgatgtagctaacttgaatagatgtttatttaacactatttttaatgtgacttaaatgtaaagaattctaatcctggattctttatgattacaatacagcaaaactgcattttccctggctgattcttaaagggtaaactattcacctataaagccaacttacgtgttttgttgtagaactagatttatatataacccaaaggtgtcaacagcactgaacgtcaacaacctgttacttcggcttcttataaagtctcacttagaagaaagttacttaattctagttaaaatttcaagttttaaaaattactagggacaaacaagtatttatttttaagcagatactattccttaagatatgaagtatcttgccagtttttcaaacctagtccacattttattgaataattaaatacaaacaagtgatatgcagtataaagtaaaagaacaaagtttcttttatgacaattaagaagttaaacaacttcatttagcctggccacaataaccgttatatccaacagtaaactggacgttgttttgaatttggtttgtatttgttggatgccttaaggattcattattattgagctactgtggtaccaataaggttttcagtatttgagctataaaagacaaccccttttcattagaggccccttaacattttaaacgaaaataacaaagcttattctgtttctaaatagtcttcctcttaatatttaaattacttagctggtatcctgtgaatacaaggcaacatcttttcaatgaaggaaacaatttcagtacaattttgtgtttttgtttggaatatagaccttttcttagtttattatatataaacacattttcaaatacaaaatactgtctgaaattagttactgcaatttgacattcaaagcatagaattttctttgcaaataaaggtcataagaaattaataattttaatagagtggagttcaaaaatttcagaaggatgtaaataagcaacaatttctttaacatttgctatatatacaaaggactttggttctattctttgccatatgcatcttacaaacgagtcaccattgtccctttttagcagacacaattgcgcttcactcctactgcaaacttttctagatcatgagcagtgcattggacactaatttattttcatgcgcaaactctggtagttaatgaccctttctctttctccaaaattccaaagacttcttttcaaaagatatagaggaaaagagaaaaaaaaccattaagctacaatttcctgctgaatttaaactctggtctaaagacactatgtaaatggcttatgctaaagaggaaaataccctttctcccccgacgagaagtgtagattcatccaaccccacaccgcttgtctttgctgctagaggcacagcacgggcataacttgtggttgtgtttttgctagtttcttacctctgggccttctttatagctttgccccccaccccactggcggtgcgctcccgcggctgcaccctcggccgcctgttggttgcgggcctccgggcccgcgcatcccccgcgctgcgtcccgcacacgcgcgctcccgccggtcccgcccgggccgctccgctggcggcggcgactgggctgcaggtagcgagcagccggcctcggtccggtaacccatggcaaccgccctggtaacccatggcaactgcgcggcggaaagaaaaaaaagaaccgtggtggggcggggggcggcgggcggtgaatgggaacaacgaccgcaaagagacagcgatttacccgcgcgggcgctgcccggcgcacctgctgcagacgcccgcgaggccccttcccgcgctacggtgacgattctggctgctggggaaaagagcaataagcagaaagccctcgtgcagaggggatccgggcggtgcacttggtgtgggaggctgccttaaacgccgatgaccctcaccgcctccggtgtcccggcttccagggccgcgccaggctggagagcgcgcgtggag

SEQ ID NO: 8460 - DNA, 518 bp, Homo sapiens
attgtgagatttttcaaatatattcatttttcttcagtcttaactataatctcccttttgtattcttgcccctgagtaattataaacttaaagtcccttctaatagttatgaaaagaaagttataggctaaaaaatataaactcagtaagtctctaactatgaaaaatggaattcctactaatttttaggtttgaatgggattttcaatttaggtttgaatagatttgttcatgactgggagccgcttcccttctttactgaattcatcccattaatacaactacatttaccctacagtttagactttagtatcatggttttgtatttcttcaaatattaaggaatattaaagattttttacaaaaggctagtgttgaaccatgacagctagttttacacacacacgatttttatgtctttgtgttcaatagagggcaccacagcatagatcatgaatgtcttcaatgaagatttgtaggttttattttttcttatagtaagagctaaacaggctgag

SEQ ID NO: 8461 - DNA, 518 bp, Homo sapiens; identical to SEQ ID NO: 8460

SEQ ID NO: 8462 - DNA, 2635 bp, Homo sapiens
accctctgaggtagcattaatgaactggaaccctctgccaggtcctctcctccccatgacttccctgagagatgtctgtagctgatttcctgccagcatgtgaatggggatgggtacgtctgttctaggaagagcacaatgtcttacccatttttagaagataggaatttgctggacacttggacaccagagctggaggcacttggtaaacctcagactttccatgatcccttgtgttctggaggccaggaaagaacagagcaaagaggtcagggccttggccgttattggagattgactctaggacttctcaccacccctccccctcctctaatccatctaggttaatacttgacatttggaattatgaagttgtgtgccccatgatggggagtggactttgagatgagacactggcctgcattataagggacctgtcatttccactggattttagtttgtgtggcttaaagagaatgcctttccagttaggtatgctcgtggctttgaatataaatgggaacagtctaacgctagctattttgctcctttccttctgattcccagctggtggaaatcggtgctgcgtactcagcaaccttacatagggcaggtatggtctcatgagctgggagcaagacaggttttctttcttgaaatgaggtccccccacttccctttgtctttgctgctttgctgctttctttccattgtctttgctgctttccttcctttgatctgtagacactcagagaactgcctggccagaccctatagaggtacaattaggtcactctagggcatctgaccatgggtggcagtttccacaaaattcacttgttctgtgggttgaaggaaatatcaaaccagctggcaagttctaggcctcttgtcttcttggtatcttctagtcaaatttacagtatatcccttctgatttaatatttgcaggaaactgatgcatggagatgctgacatcccacgtgttaattctggggcaccctgatcctattctctaggatggcattgccctttctgagccatcaatccaagtcctttccccgtttttctatgtggttggtatataattcagtgagacactctttcttgctcctgtacttgaatgtaggagtgtattgcagtggccctgaagatcccagtagagtctggggagggttgattaggacagagtgatttccaccctgcccctcctcaagcagaggagctttcttcaacctttttctctttgaagaaattgagactcagggaagaagtattgtcgcagatgtgatgcggtgagtcactggtttttaaacctctgttttggcgatgggctgggtagggatgagttaaggtttattcccctaaatctgtattacactctaagtcaacattgtgtccttaggctgggcgcagtggctcacgcctgtaattccagccctttgggaggctgaggcgggtggatcacaaggtcaggagatcaagaccatcctggctaacacggtgaaaccccatctctgctaaaaacacacacacacacaaaattagccgggtgtggtggcaggtgcctgtagtcccagctactcgggaggctgaggcaggagaatggcgtgaacccgggaggcagagcttgcagtgagctgagatcacgccaccgcactccagcctgggcaacagagcgagactccgtctcaaaaaaaaacaaaacaaaaaaacaaaaaaaaccattgtgtccttaaattgaatatccttgatagaaaagggtagggccttagcgtactggctctatggaatacgtactctctgtctttcagtagaattcagcagtcattgttcacctgctttttgccagatgttgagctaattgctattggagtaggatggtaaagattggtcttggtatgcttggttgagaaggcacaactttttacacatgtgggcctgcaaatatctatgcagatttttttgagactttaaaaagcatgtttaaaagattatttcttctaatagagactccaaaagtactcaattactgtcttatcctctgggatcctagttcctattacttgtgcttgatttccctctgctgattagataagttaccttgaaagaggcaaagaaagccaaatgggaattgacttgtttttcttcctgtcattaaaaaaaaatggaaataatttcaaatttatagaagttatacaaataaaattatacaaagaatatttgtaatcctttttatccagaacctcctattgttcgtgttcattttaccccatttgctttatcatttgcacattctctctccatgtatcaatacataattgttttctgaatcattaagaggagagataattggcccaggcacggaggctcacacctgtgacctgagtactttgggaggctgaggcaggaggattgcttgagcccaggagttcaagaccagcctgggcaacagagtgagatcctgcctctaccaaaaaaaaaaaaaaaaaattagtcagacatggtggcatgccgctagctactttggaggctgaagtgggaggttgagactgcagtgagctgtaattgtgcacctgcgctctagcctgggttacagagggagacccttgctcaaaaaaaaaaaaaaaaaaaa

SEQ ID NO: 8463 - DNA, 2636 bp, Homo sapiens
accctctgaggtagcattaatgaactggaaccctctgccaggtcctctcctccccatgacttccctgagagatgtctgtagctgatttcctgccagcatgtgaatggggatgggtacgtctgttctaggaagagcacaatgtcttacccatttttagaagataggaatttgctggacacttggacaccagagctggaggcacttggtaaacctcagactttccatgatcccttgtgttctggaggccaggaaagaacagagcaaagaggtcagggccttggccgttattggagattgactctaggacttctcaccacccctccccctcctctaatccatctaggttaatacttgacatttggaattatgaagttgtgtgccccatgatggggagtggactttgagatgagacactggcctgcattataagggacctgtcatttccactggattttagtttgtgtggcttaaagagaatgcctttccagttaggtatgctcgtggctttgaatataaatgggaacagtctaacgctagctattttgctcctttccttctgattcccagctggtggaaatcggtgctgcgtactcagcaaccttacatagggcaggtatggtctcatgagctgggagcaagacaggttttctttcttgaaatgaggtccccccacttgcctttgtctttgctgctttgctgctttctttccattgtctttgctgctttccttcctttgatctgtagacactcagagaactgcctggccagaccctatagaggtacaattaggtcactctagggcatctgaccatgggtggcagtttccacaaaattcacttgttctgtgggttgaaggaaatatcaaaccagctggcaagttctaggcctcttgtcttcttggtatcttctagtcaaatttacagtatatcccttctgatttaatatttgcaggaaactgatgcatggagatgctgacatcccacgtgttaattctggggcaccctgatcctattctctaggatggcattgcccctttctgagccatcaatccaagtcctttccccgtttttctatgtggttggtatataattcagtgagacactctttcttgctcctgtacttgaatgtaggagtgtattgcagtggccctgaagatcccagtagagtctggggagggttgattaggacagagtgatttccaccctgcccctcctcaagcagaggagctttcttcaacctttttctctttgaagaaattgagactcagggaagaagtattgtcgcagatgtgatgcggtgagtcactggtttttaaacctctgttttggcgatgggctgggtagggatgagttaaggtttattcccctaaatctgtattacactctaagtcaacattgtgtccttaggctgggcgcagtggctcacgcctgtaattccagccctttgggaggctgaggcgggtggatcacaaggtcaggagatcaagaccatcctggctaacacggtgaaaccccatctctgctaaaaacacacacacacacaaaattagccgggtgtggtggcaggtgcctgtagtcccagctactcgggaggctgaggcaggagaatggcgtgaacccgggaggcagagcttgcagtgagctgagatcacgccaccgcactccagcctgggcaacagagcgagactccgtctcaaaaaaaaacaaaacaaaaaaacaaaaaaaaccattgtgtccttaaattgaatatccttgatagaaaagggtagggccttagcgtactggctctatggaatacgtactctctgtctttcagtagaattcagcagtcattgttcacctgctttttgccagatgttgagctaattgctattggagtaggatggtaaagattggtcttggtatgcttggttgagaaggcacaactttttacacatgtgggcctgcaaatatctatgcagatttttttgagactttaaaaagcatgtttaaaagattatttcttctaatagagactccaaaagtactcaattactgtcttatcctctgggatcctagttcctattacttgtgcttgatttccctctgctgattagataagttaccttgaaagaggcaaagaaagccaaatgggaattgacttgtttttcttcctgtcattaaaaaaaaatggaaataatttcaaatttatagaagttatacaaataaaattatacaaagaatatttgtaatcctttttatccagaacctcctattgttcgtgttcattttaccccatttgctttatcatttgcacattctctctccatgtatcaatacataattgttttctgaatcattaagaggagagataattggcccaggcacggaggctcacacctgtgacctgagtactttgggaggctgaggcaggaggattgcttgagcccaggagttcaagaccagcctgggcaacagagtgagatcctgcctctaccaaaaaaaaaaaaaaaaaattagtcagacatggtggcatgccgctagctactttggaggctgaagtgggaggttgagactgcagtgagctgtaattgtgcacctgcgctctagcctgggttacagagggagacccttgctcaaaaaaaaaaaaaaaaaaaa

SEQ ID NO: 8464 - DNA, 5894 bp, Homo sapiens
ggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgagtactgcgtgcccccgggacacccagagagggcccgggcctcctgcactttccccgcggcccagaaccttgtggcacctccagagggacccccaggactggctgcgaccgagctttaagggtctagtcccgggggcagccagtcggccaaggccccgggtccctgcgacggcgaaggcatcccggaggccgcacccagaccggcccggcaagctgcagggactcggactgaaaacctgcccgttacccctggtcgctcgcaggcgcacgggcgatctaaccccgcgccgtccattccgctgatgggggtctcggaagcaccgcaggagagctttgcggagcagggagggggtcgcgggtgctcggggccgtcctcagagcccaaagtgccgcagccctctcggctttccaccccgaggctgccacgacggtgccagcgcgcggctgctcccctctgtgctcccaggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcccccctgcgcagtggtcttcgctgctgggtaagtacagccccctcctcgcctcctgctccaccaggagggctgcggcgccggagccccccgcacagctgcacggcggcgcttcccagtctggggcgtgctgacgtcgggagactctaacaccagaatgtttgccgagcgcctgcggtgtgcggttccggggatgcggtgggggcagggggcgctcacggggagggcgcaggtgggtcgcggcaggggcagccacagggtgtcacggtccgacgtgactgggggccatggttccctgcgggcggcggggagggatttcctggggcgccccctggaatccaagcccgaccgcagtgtctgaccatggtccgcggcgcggccgggtggtcctgcaggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtgagcgcggggccggccgggggcggggtccggggggccggggccaggcgcgctgagccgctgtcgccgcaggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgaggtgagtgggcaccccgcgtgcgcaagggccgctatggcccccgcggtggggacggggctggggcctggctgcaccctcgcctcccagcccaggacagccgcttgcggcttttgtgtggaagaggctctgcttctagcgccagcagtgagcaagggggtgcagccctcccatactctcccaacccggggtcacagcaccgcagggaggacagcgggacgcgcgtcccgaggaggctgccccttcctggcctcggtttccagcccgtgttccgtgggatggctgagaggagtacatgggaccctgtccccaacagtggtgcagagggcacgctggacgctgggcagtggccccagtgaggccatacgcataccagaaggtgggcttctcggaccccaggccaacctcctcttcttcctccccagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcaggtaacggacatacaggtcacatgggacacacagcagccccgaaccctgccacagggcgaccaccaaacccgaacctaaggctctgagaaattccaagtagggattcgtagtgcgtactgcaagatggtgcctagaagatttaggattctgttgattcacacactgaagatgtgactcttgcacattatttgcagttgaaagcatcttacagggccacagcccagaggaaagaatgaaaggaggctccagacagtacctgagagactctgtcctgtcagacacgcacccacaggtgacctgtgtgtcacagctgacaaggaagcttgctaggatggccctgtgtggccaccgggtgacagctatgctgcagggcacctgtgggggtctcgggacccagccaccacacagctcggggctctgctcacaggcgccttggcctggggcggggcaggtgctgatgagcattctcctagctcttccaggcacctgctggacagggcaggctgggaacgctggggccgagtggcagttccctccctactcagctgggtggcagccactggcctcacggagcgcctgtggtctggagcgcattgctgggtcgtgggtcagggcctgttggctctgggtctctgggtctcacctgatatgggtgtgggacagtcagtgtaggccccagacaacagcggacttcagactttcccgaggaggaactggagcccaccaacctggccatgggccccgtcgtcctccaccctccatgttgctggctggagttgaggcaggtacggggccgccccacacctgccccccaagccatgtggtagggacagatgtcgtcttgaggagcagcagtaattacaagcttactgtcagccgtccctggaagcaagggccaggtcaggtcagacaggaggccgcctggctggcgggaaccactccccagacagagactgtgcccagtcctgggtccctcctcatttgggatgaactgggcctccctgtgccagcctcggtgctgcccctgcccagtgcaggcttgggctcctcactcatttgtccacgcggatgccccattccaagcagatgtccccgagccacttacccaacaggcagacgtgccagcactgttcgtggtgtgcaactggtctggcgggaagagcccctcgtgggcagagggtccagagaggtgcggtttgccccacatttgggggcactgggccacagtgggcaggggagcacatggccagtgccctgggctaggagagggataaagtcagctgtggccaagcagaagcagtattgcaggggaagggtggggagagactgtgctatgagctctgagcaggaggcaggacatggagagaagggtgggagacggacagagccagctgtgccagccgagggaccagagtgggcagtggggacggagcacagaccaccgcccacaagggtctctcctgtgacttctggcttcccgagggcagaggctgggatgggcatgtggcggctggcacccaggaggctccgccaggtccacgccaagccagcctggctcagctctggcttcctgctcacacgctggatgcctgtccccaggcctcctgacagggctctgcagcattggagaggcttgtggtggggccctcgctgtagaacaggcactgccagtgctcactgactcctcattgcagccagggcaggggcgctcccaccacctcggtttcagtcaggaagctggggggtgctgggatctgccagcagctctgtgtgctccccaggtgggctgcccggggccctggctctctggcttctacaccagtgcccctgcgaagcctcagcgcccaaggtctttgcaagccctgttcctgcatctctggagagggctgctccaggtgtgggcctggccagggcttccagaccagtccaggcactgcacctgcacattgacccccttctccactctctctcatccttcagtagccacaaagctggcagcagggtactcgcagatttgtgaggagagccgagcccttgctgactgtcctcccgtgcacggcagagtgaggcggggctcctggcctccttaggggctgcccgctctgggccacacagccagagaaacactgtccatctggctggcttggcctgtggggtgcaaaagaggtgttttcactttgctttggaaacatggaaattaccaagtgacttaaccataacaccaaatgatgatttttaaatttatgaaaattatggaaccagatgggacacagggaaacgagaacgatactgaaaaggtctgagtcctgtggggggtccaggtcccgcaagacagctaatcaggtgcccctgtctgttattcgggtaaatgtagcagctgggtccaggctcgggcagagcagctttctacagcaggggtgtccgccctctcccggggttcccacggggttcccaggggccccttactctgccacgatgtgggagttccaccaccacagggacttgagcggcagctccggctcttacgtagaaacgcgcaactccagtccctaggttgtgtccgaggttgctatggtgccatcccatcttgccgctcactctgcgactgtgcggagaaacgcaagtgcccccgaagggtgggcgtggcctctgatgaatgcacacgttggtgggaggtggcttccgtttgtacgaagcgcctcttcacgcgagcgttcacctcggtctcccctttgcttggtccagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaatg

SEQ ID NO: 8465 - DNA, 307 bp, Homo sapiens
agcccattgcatgagggcaccttttgctcccatgctctgatgggcacacggcggctttcgagggctgcaggccagagcaggcacctgacaaggctggtaacatacgcagccaaggctggattttcttcatagacttcaaccaacagcacatctcagcagatgaagtgctggagccgatatgggaatccagcttccactaagccggacaatacaaagattcgcaccaacgtagaaccacgccacttttctcaggcgggtttttcatttttaaaagtatgattgcttttcataaaacattatgctattt

SEQ ID NO: 8466 - DNA, 17094 bp, Homo sapiens
cagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccaggtattcacgcccttcttttgtgtctgtgcatgtgtgcacatgtctgtcgcatgtgcagctgatgtgttggtacttcgttttcctgagcatgggcataagcctctggttgggagagtggaaggtagtgggggagggaagattgaagatgcatccttagggaagctgccctgtactcttggtttgcttggagcctggggaggggcccatattacagccgtccttgatctggctatattgaaactattgatctggctatattgaatctggcctcagatccaggtatttgaagatggagcagatactacttccccagagacacctgattcttctgcttcaaaagtcctcaaaagaggtaacaaccacccacttaaagttgcctccccatagccaggaggagtccccaggacttctcctcataacatggggccacagtagatcctaagatttttttccgtcactaccatattcccttattatatctccccctacctctctatacaagtacacactttgtttctgtttgctttctacagagggaactgatacaactgcaaagactagcaaactggtgagtgatttgggggtgggaatggggaataataaagggaggggaaggagaaagaggagggatacccagtgctaggcaggtagaagtagtaggtgagtctgatttgccttctagtctctccaacttccctaagaaggaggctttctggggattaattgctgtgttagagttacagtaaagatggtagaagggaaaaactcataggctccagaagttcagggtcaaatgagattgagctgagggtgataggaaggacaggtctggccctagtagtgtagccaacttcctaccttttggtacccaaagatgccaacatctaaagggtctgagggtaaggttaaggtagaagatagaggaagaagcaatctcctattcacaagtgaatggcaaggagccgggccctctgcctcctgttttaagctggatgcagagagtgcttcctagttcttctctgctactctgtgcaggatgtgtgtgaggtggggctgcagactctgcagcttctctgggccaaggtgtgaacatcctggaagctgatctttgaggggctactcatctcaccctgactcccccctacccgcgtctaacctgtgtaagcccgagttggtcttaacacctatgcccaggacatctgttctctaactctgccctttcctactcctcatgcagcggggactgaagcctaagaaggtggtgtgtttactatttgtgcctgggtggatgggggccatgagccccttccccagctgtcctgcatgtccctgggctgctgcatgcatgtgtgtgtgaccttgggctgggatggccagaggaaatggtggccttggctttcagagttcctttgaagggtgcaagaacatcaggctcagtgtccatacccaggtagcactcattagggatgattctctctgccccaggactccaagtcaaagattccccaatcaaaaactataagcatttgactgtaaatagcagcagtgtgaaatagatcatttactgggttacagtgtgttctcacttagcccgagcttggacgactgtggaaggatagactgggggaatggggctgaggaaggtaccaagtgagggggttttgcaggaagatgggaggtcagggaacagagcctaggaagaacagtcccaagttggaaaacctaagagccttcatgtgcctgcctgtggatgggcacagccataaatatccccacaccccacaactctgccccatcagtctgtccctgtctccttcctctggtggtgtgcctgaggcctacctcctaccccttgcagcctttcatcaaccatcattggagtggggctcaatcatgtcacgtcccctccccttcccaccatagactctttaaactcttagatcactgccatgaccacttcctcaaaccagcccctgccttgggcctctgcccaagctgtttttgacctgcatgtgcctgtctggcctgtatgtactgtgctgtatgtacaattctgtgatttccttgtcgtcagcctatctcaggccattctgacattgcatggagagctgctggattggggctgtgggagggaagaggaaaacatctccttttccagggggaaaccagctcctggttggtgatgggtcctttggagtcttgccatggtagagaccacatgctggtacttgctttggtagggaatggggatataaggaaaataatgctgtgaaggatcctgggcccatttcagagtcatagaaacttggctttgtcctttgattattgtctcctggttggggcttccatttcacctcaggccttgaatagagaagagcatgaaactatggtctgatatttatggagttctggccccagcctggtctgaccctgggctggggcctgagcaatgcccaaatccaggggctttggcagctgcctggggaaatgtgaaaaagcccagcctaggccacccatgctgcccttctgcactcacgttggaaagtgtcaatcagacagttgagtgcccccaccccggagcaccccagtcttcctctccagtagttatttttcaaagcagagggcccctgctctcacccatgtggatcagggagctggttccagagcaaaagaatatgctttgaaggggaaggcagaagaaaactcagatgtctctgcaaagtgcctagttctttttggaaaccctttagagacaggctttaacctgtctacaaccaggggatggttggagaggagcccaacagtcattagagctgctgctacccagatgcgtgttccgcagggtttcgtagtcactgtgtgtgctcctcagagctgaagcctgttgctggaggggcactctagatgtgtgtgccagatgagagactgtaagggtgttgccaggttgtataagagacagaagtggagttaatggggctgtgggtaggtgggtggcgggggcagaatgtgagtatgatgagagagactgctggagcagagaggccatgtgtccctccccagtgatgccctggccccatagaatgccatttctgggatagcccctggcccagttttttggagcacgctcttgggggtgggcaagggagggaagagaggagccaaaacctgttctttggagaaagaagcaggacaagctctgcgcatgactgtcatgaggaggaggagccagcaaagccctagatggttgctaggtgactgaggagcagtggctccacccccatggagcagaggagggtgggtgcatgacgtcaggtggagctggtgctgcggccactgaggctgccatcagcctaagctggtgaactgggccaggcaccgctccggtgcctgccggagcctggcgatccagctgcacgtctgcgggggcctctgtgtcagagcggcggccgtttgcaggctgggaagctgccgcaccgggaggctgagactgcattgttgggatttgatgcactaatctcctgtctccgccgcctttccctctgttcggtctcttgccctccctcccttcgtctgtccttcctccgtgtgtttgtctatcctcctctgtccctcctctttcctctccttgctttctttggttttctgcaatgatgagacaggcaccgacagcccgaaaggtactcttgcttgctctcgtcctgctgctgggttgccagggcaatggtggcagcaggctgctggggtgggggtgggggctgattgacttcatctgtctacctggtcggggaggcgggtgaggacgaaggtgggttagggagaggtgtgtgtcaccactatgccccacaccctgggcatttgcttactgccttgcctgcttttggctctgcctgtgttccaggccttaacacccagtggcctcacaggcttgggcttcaggcagcctctaccgcataccggatctgggagggtttcctgtggtagaacctagggaagcaggcccaggtatctcagtgcctctagcaggcctgcctgcctcacccaacctttgctagaatacctcttggttgttctcccagtatcccccaatccccaggatttgtatcagggcactttaccagggtgggatggggaacctagaatagtctttgacccacagctgtggaagcttagcccagggtagaagaggtgggaattggcctcagtgtatgctggaaatagggcccaagccaaatcttgtcttggctagagcagtgagatactgggtagcaagaacactatttggaaattggagttaattgtccacttaccattttgcagtaacctgaaggggctgtagtttctctgtgctgctgcccacccccacctcctttcctacagctgggtggggttactttgctgagctctgggcttctgctaatgcaatattcatggtcctgacacctgagccctcttccctagtgatcgggactgctgcaggatctggttctggggaagggggttgggggagggaggacagcagcattgttctaccctagggacctgatctcccatttctgggcttagattacgctcgtcacatggggtttctagggagttctgtgtagagtctagcacttgaaggaagaggctgacctgggaaagtccttgggagtggtggctgggcggggcctctggctctggactggagttggagagatcgttagcaggaggactggtctcatgggaccttctcactagctgcttccttgttctatggctcagcctagagatggacttctgggatttctggggtgtctgaaggggtgaggcctgcaaggattggacaaaagtgggagcaggaaccaaggggaacaggaattctgggttcctgaagtaggaatacagtgattcactgaagggagaaggggatgggatgggggggagggtggctaactgtagccccattcctgttatttcttctgctctcattgctgtcccttttgctctctgtctttctgccattgtcctttctttcctgactacttctcttctggctcctgttgcctgtccagaccacaactcggcgacccaaggtgagaaaacaggcccctgtgtgagccactgctgagtgtacacacacgtttcaggcatgtggatgtatgagggcacgtgtatgagcaagtgaaagttcgtcatagtgtatcctgggttctcttcagaggaaagggtgggggttcgcagtgctggcaggcacctcctggggaaaatggcttttggcttttaggaggttgtctaagccagtagcttgaatgcaaaagagaaatgaatggggttgtggtggttaatcaaagcaggctttcttgaacaagggaattttgaccagttttgatgggagggattggaagaaagatgaacttggccatgtaaaatgtcaggggataaggaggtgagtgtgtctgtgacaggccttgggtggggatgtctgaggattgcacatgatctctgagtgtcagcccactgggagaccttggggctcagcactttgagcacattggcaggcctgtctgctccagggcttgaacttcaggtcagctcctctgcccaccttctcccctgccccacaggggcatggatagtgttgccagatcgggggagatgacgaagagttgtttcaagggggagtctaggggtacaactttcaccttggcccttttacctgcagggtcctctgaaatagactgagagagggagattcagcttgactcccaaagagggcttagcaggggtagagagcctggcacccccacttttggcccaaccttctgtggaaattagattgtactttttccgtctaggggtggagggcatagacctggagcaaggatgggactgagagtataatggagttgctagaatgatcacaagtgggtcatagatgggggttctagggaataacggattctgctcttaagggtagtgccagagctaggaggaatgtggagtcagtgccaagcgaggagccttataatcttatgtctttctcttatcttttcctccctctctcctctgcctccatcctccccctgtcctttgtcactatctctctctgcctctctgtatcattttccttgtccccttcattcttcttttctcactgtgctttgatactctctttctgctttttcccttttctgtctccttcccttgccatattctcatattctgtttctgttcctcttactacccctatcctctgctttctttctggtctgcctctaccctttctgaatagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggtaaggcctggggtaggggtaaaggagaatcaagacacccagaggcttgtggctacccgctgtgtcttgaaaatttcctggggttggcaaagacctagaacttggatcagaaagggtgaggacatagcctatggatatcttgctactgactgagccatcctttcctttcttgcccttatgccatactttccccatatatactgtgctacggtttcctctcagatgttcttatgccactgactgttggccaccctggggctgggtgatgtttgcacactttcttgtgttctttgcgccagctcagtgttggtggagaggaggagtgggctgtgcacagaccgtgaggcctctcctttgcaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggtttgactctggatgaagggggtggctggggcagcctgagacctaaggaagcatgctggaaactagactggagctggagcctggaacatactgtgagaaaggcctggggcatctctgtgctggtaccccctcccacctccacttcttcctcaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggtaaggggcccacagctgctgggggccaaacggtcaggtgagaaccatgcctgaaagtgttaatgatcttctccaggctcagatggcgctgcatccagttatcagctcaagcagcttgaggagcagaatgcccgcctgaaggatgccctggtgaggtagggtcttcagtgcttgcctctgatgcttactcttgtgtctccaaatgtgttagagcacccatcgccagagactctgacacgtgctttcctccttctgccttcctcacatccctgcaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtctggggagcccagcccctcacccagaatcccccacctgactctcctatcagttgatgcctcctctttctaggtaccttccagcagcccttctccctatcctccccgtaacacaggtggatgctgctctgggtgctgaggagatggtggagatgctgacagatcggaacctgaatctggaagagaaagtgcgcgagttgagggagactgtgggagacttggtaagagaagagcagacccctgacatctgacttggacctgctgagaaaaagattgacatgtgacccttggcctttgagcagggtgtgcggtgagggacccagcctgggcttgctaccctgaccctgccttttttttttttttttttttctgagatggaatctcgctctgttgccaggctggagcgcagtggcgcaataatctcggctcactgcaacctccgcctcccaggttcaagcgattctcctgcctcagcctcccgagtagctggtactacaggcatgcgccaccatacccagctaatttttgtatttttagtagagatggggtttcaccatgttggccagcatgatctcgatctcgacctcatgatccgcctgctttgacctcccaaagtgctgggattacaggtgtgaaccaccgccgctggccgaccctgcctttctttagcccaaactatggtgtggtgtcctaggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggtacatgcccactgtttgctctctgcccaccatcaccccagggcttccttatgacccagctgtgcttcactgtctctcctcctaggatgtgaatcgggaactgacaaaccagcaggaagcatctgtggagaggcaacagcagccacctccagagacctttgacttcaaaatcaagtttgctgagactaaggcccatgccaaggtcaggaaagtgtgtgggtctgagggagccctgcctgggatgaactggtatggggtctgggcttcagattcctgggggaaggggtgctttgtgtggtggtttggaagactctggcctgggcttgccctagaagcaagggatctactggagcaaggcatgggaattttggggctctttcagctctggctaagagtcctcctccctgttcacctcacaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggtatggccaatcaatcacatgttccacagaaatctagtgaacttgccatgaaccaggcattgaagatgctgagtgaagacaacagagtctctgcccacaaagagtttatggtatagtggaggaacacagcaaagtcaccgattaatatatattacaaatggtgtgttttcaaggagagataggttctgtgagagagcacaattagagatttgatttagaggtgagcagggtgtgactgagggaataacattgtctgagggccaggaggtgcctaggggttaaccttggggatgatgggcaggatagcattctaggtggagagatagcaggagtggcagctttaagtcaggaaagaccttgattccaccggtcccactaccctttcattttcacatcctgactcctcacaacctccagtaatcacatcactaccctttccccatgcaagattccccacccaggtaagagctatttctgctttctctcccatgtgtgtccatgctccccacatagttaagctctgagtactatattcctgagtctctgttctccatcctctgctctgaggcccaggttcctggtgctttttcccacaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcagtaagtgactcctgactccctcaccccagggtgggggtccaggattggccagaactgagattgcctggcagactctagcctcacagtgcccttctctggtctctagtgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcaggtgtggggcaagaatttgggcttggggcaggaggcagggaagctttcacttgatgggggctcttactaatatattcaaggttgtatgtcccatgcttgctgcttgaggcctggtttgctcttagatgaactctccatatgatgcagctgcttgagggctttggattctcttgtacctccagagacccatgatgaccagggctcaaactacagtttgggaagaactccccacccgctccagggcctaaaagttgtctgtctgttatctctcctcagcatctgtacagcatccaccttgccgaacagcctgaggactgtactatgcagctggctgaccacattaaggtgaagtatctgggccagtgattgagcccccgtggagatcagaaatggagggcatcaggtcaagagatcaggcacccaagaagtgtcacataagactagggcagagttaccaaagccatatcagggaaactagaggacctacttatgtatgggggtcagcagaggatggggacttcttagagatgttgataaggcagaagggctcctgctgggggctgatgattgcatgcttctatcctcacagttcacgcagagtgctctggactgcatgagtgtggaggtaggacggctgcgtgccttcttgcaggtgagaacacatctagatctgtgtgagctcctcttctttcttagtcctcacttccttactccgagccttaatgctaacttggttctccatccattttctttttcctgagtagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtttaaggctgcaactggggaagggaaggaaactgagtagaaacatgaagggtatagcacttgaagatctggatctggttaggggacaaaaatggttttggggtagctggaaactgtggtgctgaacccagggttgactcctgactctggcctggcacacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcaggtgggcctggatggctgggtagaaggtgtggggagagttagtgaccagtgtggggcttttacttctgcccttggctcctgcagatctatgggaccccctccagcagcccctatgagtgtctgcgccagtcatgcaacatcctcatcagtaccatgaacaagctggccacagccatgcaggagggggagtatgatgcagagcggccccccagcaaggtaggtggagatttccttggagaagttgcagaggcctgtaggagtaagacttgcagagctactgctagttgtgggaggacggggagacaggaggaaggcatctggagagcaccatcctgcctagaaggcagggttttccctgtaactggatctctctgtaaggagcacagtgatgatctcttctctccaccctcactttctcaccccctaccgaccattccttagcctccaccggttgaactgcgggctgctgcccttcgtgcagagatcacagatgctgaaggcctgggtttgaagctcgaagatcgagagacagttattaaggagttgaagaagtcactcaagattaaggtgagggtagtgtaggctcaggatctgggggccaggaaattggtaggactcaggaaagcagtgagtgttggggatcgggaccaagacggcttgggagttaaggggagaagtggggcctgcaatcaatgggagctgtggtgagccctcagggaacctactatctcatggtctagcccccagtttccagggactgtggggaggatgtcagggatctagaagttctgtccttgtccagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaagtcaggcactttccctggggccttgcttcctctaatcctcccactgctggagctctctgcctcctaacccatacccctactcaggttctcttatagtgagactccccattttctttacccactgccaaccccattgcatcaccccagcctaagcctgtgctgctctgccctggcttctcactggcagggctattccaaggacctctcaggactgaatagtcaaggagtgctttagagaagggacactgccaaagcccagattctctttcacagagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggtgagtactgtggaataggcagcactagcacagaggagattgtcttctctcctgtccttggcctcattttgacctctgccccaccccccttacccccgggtattcagccaggaacatgcttacacagtttcactctgtgccagttttcaccaagttttcccttccgctgaagatgtgtgctgagtttctctgggcaaaggagggcattactaaattgttaatgaggctcagaataatgatgacagttggtctctagtagatgtcctttctggctctgtaatctgacctttctgcccagccctatatcccagagggttgtcagccagcagcaggctgggctgactctcctggggcatccagccctgcccgatacctgctcttgattgcttctctgcttggacactgtgttttctcactgagttcatgtggcttcattttatgatgtggtcatatcttccactgctgaattatcccagtttcacttggggcttgtgttttgacctttgtctagtcactcagtatagtcagggctcctcacctagagtttttctggttaccagttctagcctccccagttacctgactcaggaggtggctgctgctgtctttgttctcctctgccctatagtttgttttgtttactctccagtttctcacttaaccttctcacctccagaagacaggctttttgccctggaattaaacccttagggcctccagactttcccagctgctcctgagtcttgtcagctgacctcacctacatagagtctttgacaaagtctctgttactgacaccccttgatcttgggaggtgaccaagtaccttcttgactttaggctcttgtggtacagacagctctgtgttctttggagagagtttccaggattactactttgtgttgtttttagcactcttgaaacaaacattagcactctttaaacaaacatagttctgaatttatgaaacttcccaccaaaaaagaaggtcttttgcctcagagcaatggggaatccttaggagcaagggagtgtgtttgcatccccaacttaagctttgctgctggtgagcactaagggtgcagacatattggggtctctggagcattctccgtgcccttcttggagatggcatctgagacagggaggcaggaacagcctcatgttccaagtactttgtacagtgcacactctctttgccactgttcttcacacattgtaccctgtcttgtggcctcactcctgtttggtgtctttctttaacacttatctgctcgtccccaaagataggtggcagagagtcttgttagagaaagtatgatgattaggaaaagggttttcctgcaggttgtgtccaggattcctctggtgtgtccccgtaacccccaaatcacctaactcctctctcctcttttcctgctcccccatgggctatcccgagcacagaagaacagcagcgaggtagagacccactctggccgggggttaccaggctggtgggagttggagctaagggagcagggtggagggggaagccaggactggagatgggtgatggggggatgaggaaaggggaagagtaggaatggagcccaattttcaaccctttccacttggggctgatgagattttttatggtccccacaggagccatccctgggcaggctccagggtctgtgccaggcccagggctggtgaaggactcaccactgctgcttcagcagatctctgccatgaggctgcacatctcccagctccagcatgagaacagcatcctcaaggtgagggagccacggggaggactgggatgggagatggagcatatttgccccattgatgatagatgacaggggcctcctagcacctcttaccactatccttcttttttcatccacagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctggtatgtacctgccaacccccaagatgaataaaactgccccctccacttggcccagggatttagcccctgctcaggtggttcccccaccacagaagctcttcccagcagtgttctttggcttcactgttcagtttgtttgattcacccactctctctcaagtacttgttctgttagagagtcttatacctgcacccctaacccttaatccagtagaactgcctgcctgcgccttggtgggcctcaccagctttctctccccacagctgccaagagcccgtcggcccaacttatggagcaagtggctcagcttaagtccctgagtgacaccgtcgagaagctcaaggtcagctcagtttgccaggcagagctcacttcacagcataaactggtggagccaggcacttgtggagttcctctgagcccagccctgtgctagacagcaattggggaggagatggaagggaaggcagggttcttgccttggaagctcactgtctcagtgcaaacagaagacagattctcataacaaaatggataagctagggtaatctttagagtgactggttcaggctttagcttccatcagcgctgagatcattgtggggtagaacggttgggcatggcttcccaagagcggtagaatgtgagttgggccttacaggatgaggacttgcaaagtaaggaggagtgctggtgtggggatggggttggagatgagagcaaaagtatgttgatatagaggactaagtccctgcccccctggtattagtgtctctgtgaaaccacgtggtcttgtgctagcctgtgggggtcccataaatgaacccttgtcttcctctccccttccctaggatgaggtcctcaaggagacagtatctcagcgccctggagccacagtacccactgactttgccaccttcccttcatcagccttcctcagggtgagggggagcatggggtggaggatgggacagtgtggagagctcaggcgggcccccctctcctccagaattggaggaggcctttggagtctcaggtctaacaactgcataccttgggttatctggccaaattttacttacaagtaactcagaagtgcttacagtgctttgaaattccaatattttagcacctaaacaccttccgtgacttttgacaccaggagggcctcaaaactcccttgtcagattatgtatccccattcttatttgaaaaatgtggtcacaatagcccaggatctcagaagccctagtcacccaggagctgccttggtctcagtgctcagggaccccttcagtggcccacagctcaagtgagcccctgacctggagtctttttctcctcatcaaccaccaggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtg

SEQ ID NO: 8467 - DNA, 191 bp, Homo sapiens
tgtgtctctgggttcaggaatcctcaggcagcagaggggacttgctcctcagcccccatcactgcccccacccctacccgtgtaggccaccgagtgaggcccatggactggggagggctgtgcctgacgactcctgtgtccctctatgagggcccagcgccctgaccctcctgcctaggtttctacctttt

SEQ ID NO: 8468 - DNA, 521 bp, Homo sapiens
agttactctaaccaaggaggaaagggctagacttaggactaggtacctaagttcatttatggagtcaggagggctgggagggtgtagcctctgccaaccctgcctctgcttcctgtagcttccactgctctttagtccaatttttggagctggagtaatgatatgatcaccaccccagccaattttctgatgtactggccagtcttcccataagacctggggtctctcagagggaatatttactaaataagggaaaactaaagtggcatactagtaaaggataggaggtacaaaagctactcccaaaccccaccataaattagtatcacctggggagtttcttttaaaatgtaacagatttctggtcttgacccagacctactgaaaatacttgcagagttgggactcattaggctggtaaacagcaccccagcattgtagatattagccccagtttagattagttggctagctcctttatattctctttttttccctcttggggagagaagtccagttca

SEQ ID NO: 8469 - DNA, 23083 bp, Homo sapiens
ttctggtggtgatagttacctttggcataattctccctctgtgtctcttgaagaacttaggtaaggacagattttgcttttatcatattctgcagtgcccaagtgaatcagaaactgaataaaaatggacagtgttgccctctgcttcccctctgcatgcactcaaagattaagtacatgataaattgcaagtattaatcggtcccaactttaatatgggataaaaataacagtcagtatgtgacctcctaaacaatccctctactgagctgtggaggggagaagggaggtcctggggccaggacagacagggctattttcagtagtacaacttatatgctactctaagaaaagtccagaaaatgcaattctcttcatacgaagtcttaaataccctcattatttagataaatacattttcaaatctaatatggagacagaaagctgcctagatttatacccacaagtattataaatttagagagtctgaccagcctcaattatttctcttcgaagtgggagagagaaatcaaaagtcagaaatggcggataatctccaagtcatatccatttggctttgatctactacttgtttttatgcttgtatttggagacaaggatgcctgatgttaagggaatttcatacattgaataatgtgaccagactgccatctagtcaaaaacctataaaatgtatttactttaattctgggctaattcaaacagaagtttggataaaagctctccaaacaataattatgagccttagttttttgttttgttttggatacaaaacaaaacagctctgtagttgttctgtgaggtttataaatagatttttttaactacttaattttctggtttctgcctctgtgttttctgtacctatagaggtagctcttttcagttaagtagagaaaagctcttcccctgggttgaaaataatgcagtcccgagaggctacttaactctacctttctggaggtcatggtagcaattggagatctcccaggcattctaaggggagctactaaagagccccagatactcaatttaccactagaaattcgcttcatctactctctgtcatctggggagaaaagtattataactgacattcagtatgcacacaataagtgcataataaagagctattgaggggatcaaggagtaaatgggtttgcccataggactccatcagggtccaccaacacagacttacagcaaaaattggaaggctcttttctgctggattctgggaatctgtgttctctagtgtgccagggagagttggaatcaaaacacgtaatataatgtttctattcagagccccatttttttgccaaataaagtagcactgtcaaataataaatcttgtattcacttgggcatgtatgtttattattggatctctaaaatatgcttcaaataatgcactgaaataagtgaggtgatgaattttgaaataataacagtttatgatgggtagctccaaaatttttaaaaatggaaaaaaatgaaataatttattttttacttttttttaaagggtatcttggctatactagtggattttccttgagctgtatggtttttttcctaattgtggtaagtgctgattgcaatggttggtttggttttgtgatagtacaatggcatgtaataattattcattggctttactaaagtccatattgcttctactatacttcttaataccaggttatttacaagaaatttcaaattccctgcattgttccagagctaaattcaacaataagtgctaattcaacaaatgctgacacgtgtacgccaaaatatgttaccttcaattcaaaggtaagtttcctgatcctttgcagatgaaacaagcatttttattaaggacattctatttctcatgcttgtaattgcactggtttgaatgtattagttctcaaaagaacacatgataccattgcttccagattacacatctatgtagagatccttgagaaatatacaaatattatattttacactctctcttaccattaagcattctctgtgaaaatcccattctggataattgtctcagctttttctgtgtagagtgctaggtgatacttcaaaaacagactaacaacatccttagctcccttcttctggcgatgacagaaaggaatactgcagacttcctcaggttgcacagttgaaatatagatgccaccacaaactggcacttaaaaaactctcatactattaaaatattgttgatacaatgggaaacagaggattatggagtcagtcaggcttggatttgaatcctcaggcaagtcacccaaccccttgagtaaaaataagtattctattctgtatcttacaaggttttgttagaatgtgcctggcatagtgcatcagcagagttagggcataagataggttagttttcacttctttttgcataggaagttagattgagtgtgagagtttcaaagagccttatctaagaaaactaaatagatcgcgatctttctccttctctctgattgtaaggatatagccaaagtagtgcaatatggaacagattttcttttcagagggtatcttttaagtccgattccatgcacctgatgtagagcgaagagcagtaaactagaggtgggagtgctgggccagtcgcctgacctgttggagggagccaggagaacagccacagtctgcctactgcttgggattgctgtggggacccagcgagctatcctaggaagagtgccatgtaactggctcatgctgtataaacagggggtgttgtatacctggagtatataaaatacaccataggtgagccaaatccgaagtccctctgtgacaagtggctaatggctcgagctagacaagctgtcttagaaaagctgcttctactttagagatcaaaacctccctaataaccgaataatccagggattctgaagagctgtcagataaaaagacagctcagaaatactggagctatgtcctttttatggtaaaagtgtttttcctaatgtctattcttttctctcaaatagaccgtgtatgctttacccaccattgcatttgcatttgtttgccacccgtcagtcctgccaatttacagtgagcttaaagagtaagaaatttgtttaattttttatcttaatcgttttacatcccctcattaataggcaagtatgcaattaaaataaacggacttgtctaatgaacgtcagcggattcatcacccagcttcaacatttactcacattgtgccattcttaaacaagcattgtattttaagaaacaagaaagcaagaaaaatcagaaacttgcagtattttggggggccataaacataaaaagtagccaaccatgtgggctttttcattaatttggtttttcaaatattgtatcaccgaggaaagtttaagtatttgtgttgctttccattacgtatgcgtattttgcaagtgggtgataatcttcagatttatctgtaaactgctaaatacatcgtctctgatttgcctgtgggtttgggtgaaaaggctagtaaatcagacaataagaaatcaatattaagaccacaaactaggaaaagagaatattgctgttcatttttaactattaagaaaattctatggatttattgatttatttttgattgctggttttgagaaaattaaggcctgcttataaacttcttcatgtctctttttagcctatggttatcaaacataaacaaaaatagtcacaatagcgtatcttaaaaacttagaaaagatcgacaatatcagtatttatttccagtttgaaacaaagttgatgtcatttagcattgaatccactcatatatctttggcgtcttttaatagttcagcttttagttttagtttttaattttctcaagcgtatacttctcaatttttctttatttatttttttttttttgagacagagtctccctctgtcacccaggctgtagtgctatggtgtgatctcagctcactgcagtctcaacttcccagggtcaagcaatcctcccacctcagcctctcaggtagctggaactacaggcacatgccccatgcccagctaacttttgtattttctgtagacacagagtttcaccatgttgcccaggctggtcttgaactcctgagctcaggtgatctgcctgcctcagcctcccaaagtgctgggattataggcgtgagccaccgcgcggggcctacttctccgtttttcttgttttccatacttctatggcatcctagattccttgacataaccaaatgttatgactatctgtggtctgttatttattgaatacaagtgttgcagattaattgtttgggcagttaaagaaacttagagggtcatcccaaccccagagtgaacttgacctgagagatggagcccttcatcattccagctgtgatctcttgggcacttgctgcgctggagacctacagacttccaggtgcatccctgaggccacccaatgggaaaatcagaacctgaaacagcagctttagagacagaacacctgaggtcaagttccagctctgccactaatctctggagctaggagaacagcattgatttttttctgccttttttcctttgcccagctagtgtggagataatatcaagcacaaatattaaaaaaatgctgtctgcccttccgatgagaactcgatattcttttaaaagaatggggaagaacgctaacgggagtgtagttccacagatctcaccctcaataccaattcagtataagagaggttattttcaactggcataactgccaggggtaatttcagctgttcagatcttccctaacctgacagaagcaaagttaaattagtattcttcaatgttaacactggtgcttaaattcagtcatatgatttttaatttttaacatttatttgtttttagccgatcacagaaaaaaatgcagatggtttcaaacatctcctttttcgccatgtttgttatgtacttcttgactgccatttttggctacttgacattctatggtaagtaatttctactggtacataaatataaatatttgtaaacaaattagtaaaaattagtgttgaaataacttttaacatgaaaggcaaagaaagcaacaaagctatccattggtttttctagttttttcttcgacttaaagcaatggtgatcttttcatgttcatgcagactgccgaataaaataattactcaaacaatatttataatttttttctcctaacagtgtccttaatagaaattgcattttagaagcatgctacctttactgaggaaggtttaaaactacatcagagaaggctttcctaattgacaccgcaaattgggtcagattccattaatagaatggagagacagagacagatgctgaaagtgagaaagagcagagtgctacactcatgacactctgagttaattaaaaatgaaacttctaattgttcactggaagtcgaagccttgcaaagatccaaaggaatgatagaaaattttaaaaaatgaaatctgaaaaagggaacaagttttcatatgtaacttttactgaccctgaatgaacagtttaccggcgtttactgcttcttcatcctctcctattcaaattatcctgaagcttgatttaatatctttcattatctttataattggggacctaatttaaatatatatatgtgtatatatatgtgtgtctatatatatgtgtatatatatgtgtgtgtatatatatatatatgtatgtatttcacaatcttctctactaaataataattctttgggactttttttcataaacacaaatgtctcaaaattaaacacatttaaaaagtattaattcagcctggagaaaaaggctactctgattatacagatattattattgttttcactagcaatagagaatggcattgtctaatgaattcataaataccacatttaatttttacataaaaatggtgttgctaaggtgcatacagagttgtacagggagagagaggcggagaacttaatgttagttgaagtctcactgttgtcttgttgaagctataatttttctttgtagatgcattatttttcacatagaatagaacaccaaacacttttattactcttggattaaagaaaaaggattagctattttttaagtggttagttattttgaattaaggaaattagaactagtgagattggtattataacttatggttcttttttggaaactgagaccaagctaagctctatggtacagattagcatttgaattccatgctgaggaccttgagactggtgcagtgagaggcccttgcaggagacaggaggggaaattacctcttgtcaaaagagtgagcagttccatactctatgtgactgccattctagctttgttagtctttgaaataacactttctgaagttctggattgagaaaaagttcaaagtagtacataaggccaggtacggtggcttgcacctgtgatcccagcattttgggaggccaaggtaggtggatagcttgagcccaggagttcgagaccagcctgggcaacataatgagacccccatctctacaaaaaaaaaaaaaatacaaaaattagccaagcatggtggcacatgcctgtagtcccagctactcaggaggctgaggcaggaggattgcttgtgcccatgaagcagaggttgcagtgagccaaaatggcactatggcaaccatattccagcctgggtgatagagcaaaaccctgtctcaacacacacacacacacacacacacacacacacacacacacacacacacacacaaagtagtacataaactaatttttttttttttacaagaacaacatacatgaaagagtggaattatttcctgatggtgaaatttcaactagtgtctctgctgcttggccacttgaagttgacttaacaagagaagagtttgaaacaagctccaaggtggcttgtagctctccccaccccaccccctccctgagcaagcctgtggcagtttggtgtggtttgaagagtggagggaaagtctagattaagagcagcttcgcgtttcaactgtatgtttcattctcgagcccagtgtactcctaggtttaatttagtctaaattaagcattcccactccatgtagcttcttccagtgattactttaaatttctttgctaagtcgcgtatgcacagtggagcatgtcttacatagagatttttctttccaacctgattgttttaatagacatttcgaaacattgcttttcttgccctttagtttacagattctttgtttttcagaaaaactgtcattcagctatatactttgtctccttttaaaaccctcttgcttttccctcattttagacaacgtgcagtccgacctccttcacaaatatcagagtaaagatgacattctcatcctgacagtgcggctggctgtcattgttgctgtgatcctcacagtgccggtgttatttttcacggtgagtaagggcctctgtgcaatatgagaaaagctgaggtctcggctttccttctgcctgcaggagcccgttgcagagaaagcctgccccaggtaactttcctgggttattgaatctgcatctgggaaagatcccaagactcggttcaggctctttgaaaagcaagtggcattcagtgcgtcagggagcctctgatgcagtgaatctccattctaattaatctgaccctgttctttccaaagaaatgacaatagaatgttcaaatctcagtagacatgaagagagaatataaaaagaacagaaatgaacattcaagtcttagataaaccaaagacagaaattacaccccccaacaagaaaactctactactcataaataaaaatactttccctcttaagtcaagcccccgtacttccaaaactgttaagctatctataaattcactaggcattacaaaacatttcatgaattcctgtgcaccaataaatcagttactctgcagagaaatgtcaatgttggcatgctgtaggcacttacagaatctttgttttcttttcttgcaggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggtatggcttcatgactttgtgcttgtcattctacagtagctgtttgcagggaaattttcacaatagcaatgctaaactttctcttttgtcttattttacaggagttacatctgctaacatgcttattttcattcttccttcatctctttatttaaaaatcacagaccaggatggagataaaggaactcaaagaatttgggtatgtctcttgccagccactctaacttttctgattagttttccatttaaatttacaaaataaatagtccacctctctatcaagactactttcagttgccttgaaaggaggcagaagccctgtagctttgctacttgggagatatttaaaatatcatatcagaatcttctcccatccctccaaatatcttttctggttttactctttttttttgagatggagtctcactctgtcgcccaggctggagtgcagtggccagatctcagctcactgtaagctccgcctcccgggttcatgccattcttctgcctcagagagtagctgggactacaggcgcccgccaccatgcctggctaattttttttcttttttcttttttcttttttgtatttttagtagagacggggtttcaccatgttagccaggatggtctgtatctcctgacctcatgatccgtctgcctcggcctcccacagtgctgggattacaggcatgagccatcgcgcccggccctctggttttactgttattgtgcctcagcttttgttctgatccagggcatggccagtcagaagaatggacattcatcctcctgtgtctctataggacagtgtctagtcttcagcaagagaggaagtgacgagggactcacagatgttatgcagtccactgtttccatatgatttctagtcatgtaactcctccctacagcccagggaacatgcaatgccttaattaaaatgtctgagttagcttaaatagtcttttttattatttgacagatatgctttggaacaacagacctggattcaaaaactacctttctatattgggattcttgtttccaggtctggtgaagttcaagggcatcttgaacgtggtgcacttggagacagtgagggaagcaggggtgaagtggctgctacctgagtcccttctggagctccattttgcttggtcttggagaaggcttctcagctgccctcccagctagtgtaagcactgcaattgtacctgttacctgagtcaacagatccagatgagaggtgtaggcaggagggtcatctctgtgcatttaggaaaagcagcactgatgctagtagagcatccagttccccaacatgatcacccctgaagccttaattcccaaatccttccaagccttatctgtaggggcttaatgaggacagagaggaagaaacagtcactctggcacaacaggacaatatattcagattaaatctgaaaatggtggaggcctgctgcccatgaattctgagcctctccaaccctggtcccataatgaaactagtagtagggtcttccaaatggcattagacaagggttccatctgtgtaaggaccactgggagttagactggacccaggatggtatgccatgtgcagccatgtcaacccccaatttgctcctctccttccttagctctttctcttcctccagtttccagtccagccctgttggctctcagaatgcatcatccttctccctgcagcgctctcactgaacatgctcaagcgcaaggaacttataatcttgtgttctctggattctggatttagtaatctgtattagtctgttctcacactgctaataaagaaatacctgaggttgcttccaagatagccaaataggaacagctctggtctgcagctcccagcaagatcgatgtagaagatgggtgatttctgcatttccaactgaggtacctggttcatctcactgggactggttggacagtgggtgcagcccatggaaggtgagctgaagcaaggtggggcgtcacctcacccaggaagcacaaggggtcaggggatttacctttcccagccaagggaagccatgacagactgtaactggagaaacggtacactcctgaccaaatactgcacttttcccacagtcttagcaactggcagaccaggtaataccctcccgtgcctggctcagtgggttccatgccaacggagccttgctcactgctagcgcaacagtctaagatcgacctgcgacgctgcagcttgatgcagggagaggcatccaacattgctgaggcttgagtagctcacagtgtaagcaaagaggcccggaagcacaagttgggcagagctcatcgctgctcagcagggcctactgcctctatagattccacctctggaggcagggcatggcagaaaaaaacgcagcagacagcttttgcagacttaaacgtccctgtctgatggctctaaagagagcaatggttctctcagcatggcattcgagctccaagaacagacagactgcctccccaagcaggtccctgacccccatgtagctggactgggaaacacctccccatcaggggctgagagatacctcaaacacgtgggtgcccctctgggacgaagcttccagaggaaggatcaggcagcaatatttgctattctgcagcctttgctggtgatacccaggcaaacagattctggagtggacctccagcaaactccaacaaacctgcagctgaggggtctgactgtgggaaggaaaactaacaaagagaaagcaatagcatcaacatcaacaaaaaggacatccacaccaaatccccatctataggtcaccaacatcaaagaccaaaggtagataaaaccacaaagatggggagagaaaccagagcagaaaagctgaaaattccaaaaaacaagcacctcttctcctccaaaggatcgcagctccttgccagcaagggaacaaaactagacggagaatgagtttgacaagttgacagaagtaggcttcagaaggttggtaataacaaacttctctgagctaaaggagcatcttctaacccatcgcaaagaggctaaaaactgtggaaaaaaaaaaggttagatgaatggctaactagaataaccagtgtagagaagacctcaaatgacctgatgaagctgaaacccacagcacaagaacttcgagactcatgcacaagcttcaatagccgattcgatcaagtggaagaaaggatatcagtgattgaagatcaaattaatgaaataaagtgagaagaatacagaaaaaagagtgaaaagaaatgaacaaagcctccaagaaatatgggactatgtgaaaagaccaaatatacgtttgactggtgttcctgaaagtgagggggagaatggatccaagttagaaaacactcttcaggatactatcgaggagaacttccccaatctagcaaggcagcccaacattcaaattcaggaaatacagagaacaccacaaagatactccaagaagagcaaccccaagacacataattgtcagattcaccaaggttgaaatggaggaaacaatgttaagggcagccagaaagagaggttgggttacctacaaaaggaagcctgtcagactaacagccgatctctctgcagaaaccctacaagccagaagggagtgggggccaatattcaacattatgaaagaaaagaattttcaacccggaatctcctatccagccaaactaagcttcataagtgaaggagaaataaaatcctttacagacaagcaaatgctgagagattttgtcaccaccaggctcgccttacaaaagctcctgaaggaagcactaaacatggaaaggaccaaccagtaccagccactgcaaaaacatgccaaatggtaaagaccagtgactctatgaaaaaactgcatcaattaacgagcaaaataaccagctaacatcataatgacaggatcaaattcaaacataacaatattaacctcaaatgtaaatgggctaaatgccccaattaaaagacagagaaaggcaaatttgataaacagttgagaaccatcagtgtgctgtattgaggagacccatctcatttgcaaagatgcacataggctcaaaataaaaggatggaggaagatctaccaagcaaatggaaagcaaaaaaaaaagcaggacttgccatcctagtctctgataaaccagactttaaaccaacaaagatcaaaagagataaagagggccactacatagtggtaaagggatcaattcaccaagaagacctaactattctaaatatatatgcacccaatacaggagcacccagatccataaagcaagtccttagagacctacgaagagacttagactcccacacaataataatgggagattttaacaccccactgtcaatattagacagatcaacgagacagaaggttatcaaggatatccaggacttgaactcagctctgcaccaagcggacctcatagacatctacagaactcttcaccacaaatcaagacaatatgcattcttctcagcaccacattgcacttattctaaaattggccacataattggtagtaaaacactcctccgcaaatgtaaaagaacagaaatcacagcaaactgtctcttagacacagtgcaatcaaattagaactcaggattatgaaactcactcaaaaccacacaactacatggaaactgaaaaacctgctcctgaatgactactgggtaaataacaaaatgaaggcacaaataaagatgttctttgaaaccaatgagaaccaagacgcaatgtaccagaatctctgggacacatttaaagcagtgtgtacagggaaatttatagcactaaatgccttcaagagaaagcaaggaagatctaaaatcgacacccctacatcacaattaaaagaactagagaagcgaaagcaaacaaattcaaaagctagcagaaggtaagaaataactaagatcggagcagaattgaaggagatagagatacaaaaacccttcaaaaaatcaatgaatccaggagctggttttttgaaaggatcaacaaaattgatagaccactagcaagactaacaaagaagaaaagagagaagaatcaaatagatgcaataaaaaatgataaaggggatatcaccaccgatcccacagaaatacaaactaccatcagagaatactataaacacctctacacaaataaactagaaaatctagaagaaatgtataaattcctgggcacataaaccctcccaagactaaaccaggaagaagctgaatctctgaatagatcaatatcaggttctgaaattgaggcaataaataatagcctaccaaccaaaaaaaagtccaggaccagaaggaatcagagccaaattctaccagaggtacaaagaggagctggtaccattcctcctgaaactatttcaatcagtagaaaagagggaatcctccctaactcattttatgaggctagctcatcctgttatcaaagcctggtggagacacaacaaaaaaagagaattttaggccaatatccctgaggaacattgatttgaaaatcctcagtaaaatactggcaaaccaaatccagcagcacatcaaaaagcttatccactatgatcaagtcagcttcatccctgggatgcaaggctgcttcaacatatgcaaatcaataaatgtaatccatcacataaacagaaccaatgacaaaaaccacatgattatctcaatagatgcagaaaaggcctttgacaaaattcaacagtgcttcatgctaaaaactctcaataaactaggtattgatggaacatatctcaaaataataaagagctatttatgacaaacccacagccaatatcatactgaatgggcaaaaactgaaagcattccctttgaaaactggcacaagacaaggatgccctctttcaccactcctattcaacatagtgttggaagttctggctagggcaatcaggcacaagaaagaatgaaaatggtattcaattaggagaggaggaagtcaaattgtctctgtttgcagatgatccctgattgtatatttagaaaaccccattgtctcagcccaaaatctccttaagctgataaggaacttcagcaaagtctcaggatacaaaatcaatgtgcaaaaatcacaaccattcctatacaccaataatagacaaacagccgatcatgagtgaaatcccattcacatttactctgaagagaataaaatacctaggaagccgacttacaagggatgtgaaggacctcttcaaggagaactacaaaccactgctcaacgaaataaaagaggacagaaacaaatggaagaacattccacgctcatggataggaagaattaatatcatgaaaatggccatactgcccaaggtaatttatagattcaatgctatccccatcaatctaccactgactttcttcacataattggaaaaaactactttaaaattcatatggaaccaaaaaagagctcacatagtcaagacaatcctatgcaaaaagaacaagctggaggcatcatgctacctgacttcaaactgtactacaaggctacagtaacgaaaacagcatggtactggtaccaaaacagataatatggaccaatggaacagaacagaggcctcagaattaacaccacacatctacaaccatctgatctttgacaaacctgacaaaaacaagaaatggggaaaggattccctatttaataaatggtgctgagaaaactggctagccatatgtagaaagctgaaactgaatcccttccttacaccatatacaaaaattaactcaagatgggttaaagacttaaaggtaagacctaacaccataacaaccctagaagaaaacctaggcaataccattcaggacatagatatgggcaaagacttcatgattaaaacacaaaaagcaatggcaacaaaagccaaaatagacaaatgggatctaattcaactaaagagcttctgcacagcaaaagaaactaccatcagagtgaataggcaacctacagaatgggagaaaatctttgcagtctacccatctgacaaagggctaatatccagaatctactaagaactcaaacaaatttacaagaaaaaagcaaccccatcaaaaagtgggcaaaggatatgaacagacacttctcaaaagaagacatttatgcagtcaacagacacatgaaaaaatgctcatcatcactggtcatcagagaaatgcaaatcaaaaccacaatgagataccatctcacaccagttaaaatggcgatcattaaaaagtcagaagacaacagacgctggagaggatgtggagaaataggaacacttttacactgttggtgggagtgtaaattagttcaaccattgtggaagacagtgtggcgattcctcaaggatccagaactagaaataccatttgacccagcaatcccattactgggtatatacccaaaggattataaatcatgctactataaagacacatgcacatgtatgtttattgtggcactattcacaatagtgaagacttggaaccccaaatgtccatcaatgatagactggattaagaaaatgtggcacatgtacaccatggaatcgtatgcagccataaaagaaggatcagttcatgtcctttgcagggacatggatgaagctagaaaccatcattttaagcaaactatcacaaggacaaaaaaccaaacactgcatgttttcactcataggtgggagttgaacaatgagaacacatggacacaggacagagaatatcacacaccagggcctgtcgtggggtggggggcccggggagggatagcattacgagaaatacctaatataaattacaagttgatgggtgcagcaaaccaacatggcacatgtatacctatgtaacaaacctacacattgtgcacatgtaccctagaacttaaagtataataataaaaaaaaatacctgagacagggtaatttataaaggaaagaggtttaattgactcacaattccacatgactggggaggcctcacaatcatagcggagggcaaacaaggagcaaagtcacgtcttacatggtggcaggcagagcgcatgtgcagggtaactcccctttataaaaccaccagatctcatgagatttattcactatcacaagcacagcatgggaaagacccgcccccaggattcaattacctcctaccaggtaactcccatgacacgtgggaattatgggagctaaaattcaagatgagatttgggtagggacacagccaaaccatatcatcatctgtccacctatggccttcatcagcccttcaggtaacttagtttttgacacctgtttcctatttcacttaatcaaatctattttgcttttgtatgttttttttccactttttcaaacagaaatgtttgcttgccagtgataagctaagttggtaggtaatgaataacaaaatgacctggatattttctaaggcctttattcccccttggttgtaatcttagtttgagagaagccataaggatacccagttatttgtagaatggatacatacacttgaggtgaccatgaagtcaaagaatgggacatagaggactactctgcttagctagttttttttttttcctattttcccatccttgcagaatcagattcataaaattttagaaagattctcacagttcagccatggttgtgacaaactctgaataccagaggacacaaagggagaggaaaaactgttctattttttttccccaggtacatgtggaaaaattttgctgcactgaaaataacccttgcctttctcttgctccaggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgctggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcatagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggtctcaaagtgtggcccctagaccagtagcatcagcatcatcggggacctcattagaatgcagattctcagccccctcccagacatggtgaagtcagaagctctcagggagggactcagcaaatgatttaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcaggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaatatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatctgcactgaaatagaagtctctaggatctgcatataaacaataaatgtttcctagaaattagtggttttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagtatttaaaaa

SEQ ID NO: 8470 - DNA, 385 bp, Homo sapiens
acatgagccaacctcattaaagatgtagataaccctggaaaatgttgtagctacatttggcacaattgtgttttgactccctcttgtttaacagttcttgtcagtcttagtttctctgttttctttcaagggagaatcgtagaagccagagtctctagtgttctcaggattcaaggtcaaatccaagggatcagggagagagaaatgtctacctgtagtgacttgtttctcactgatactagcccagcaaaacaaaaaggagctttctctttaaataattgataggacaagttgtaatctgacagaatgaaatgtgtgcattcagctttgaaaccatgtaaataattcaaaagaatgccacatttagccaatgggaaaaaaaaaa

SEQ ID NO: 8471 - DNA, 640 bp, Homo sapiens; identical to SEQ ID NO: 8187

SEQ ID NO: 8472 - DNA, 606 bp, Homo sapiens; identical to SEQ ID NO: 8188

SEQ ID NO: 8473 - DNA, 628 bp, Homo sapiens; identical to SEQ ID NO: 8189

SEQ ID NO: 8474 - DNA, 640 bp, Homo sapiens; identical to SEQ ID NO: 8187

SEQ ID NO: 8475 - DNA, 513 bp, Homo sapiens; identical to SEQ ID NO: 8191

SEQ ID NO: 8476 - DNA, 612 bp, Homo sapiens; identical to SEQ ID NO: 8192

SEQ ID NO: 8477 - DNA, 462 bp, Homo sapiens
caacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgmtattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8478 - DNA, 640 bp, Homo sapiens; identical to SEQ ID NO: 8187

SEQ ID NO: 8479 - DNA, 640 bp, Homo sapiens; identical to SEQ ID NO: 8187

SEQ ID NO: 8480 - DNA, 654 bp, Homo sapiens; identical to SEQ ID NO: 8195

SEQ ID NO: 8481 - DNA, 414 bp, Homo sapiens
tgaaccatcaccctaatcaagttttttggggtggaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgggtaaccaccaccaccgccgcgcttaatgcgccgctacagggcgcgtccattcgccattcaggctgcgcaactgttgggaagggcgatcggtgcgggcctyttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8482 - DNA, 647 bp, Homo sapiens; identical to SEQ ID NO: 8196
  misc_feature (29)..(29): n equals a,t,g, or c

SEQ ID NO: 8483 - DNA, 640 bp, Homo sapiens; identical to SEQ ID NO: 8197

SEQ ID NO: 8484 - DNA, 640 bp, Homo sapiens; identical to SEQ ID NO: 8198

SEQ ID NO: 8485 - DNA, 571 bp, Homo sapiens; identical to SEQ ID NO: 8199

SEQ ID NO: 8486 - DNA, 640 bp, Homo sapiens; identical to SEQ ID NO: 8187

SEQ ID NO: 8487 - DNA, 639 bp, Homo sapiens; identical to SEQ ID NO: 8201
  misc_feature (88)..(88): n equals a,t,g, or c

SEQ ID NO: 8488 - DNA, 397 bp, Homo sapiens
atcaagttttttggggtcgaggtgccgtgaagcattaaatcggaaccctaaagggagcccccgatttagagcttgacggggaaagccggcgaacgtggcgagaaaggaagggaagaaagcgaaaggagcggacgttagggcgctggcaagtgtagcggtccgtgcgcgtaaccaccacacacgctgcgcttaatgcgccgctacagggcgcgtccattcgccattcgaggtgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8489 - DNA, 648 bp, Homo sapiens; identical to SEQ ID NO: 8202

SEQ ID NO: 8490 - DNA, 434 bp, Homo sapiens
gggcgatggccccactaccgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 8491 - DNA, 624 bp, Homo sapiens; identical to SEQ ID NO: 8203

SEQ ID NO: 8492 - DNA, 509 bp, Homo sapiens; identical to SEQ ID NO: 8204

SEQ ID NO: 8493 - DNA, 654 bp, Homo sapiens; identical to SEQ ID NO: 8205

SEQ ID NO: 8494 - DNA, 546 bp, Homo sapiens; identical to SEQ ID NO: 8206
  misc_feature (20)..(20): n equals a,t,g, or c

SEQ ID NO: 8495 - DNA, 654 bp, Homo sapiens; identical to SEQ ID NO: 8195

SEQ ID NO: 8496 - DNA, 1564 bp, Homo sapiens
ttgctgatggagacggtgggctccgacatccgcagctgccccctctgccagctgggtttccctgtcgggtacccggatgatgccctcatcaaacacattgactcccacctggagaacagcaagatctagggcaccagccccacccactggctgtttctccgtcctctcctatcacccccaaacactcactttgaatgctgcatgaatctcgtggggggtccctgcccttgcgacccccagatacctccacttgctaccgagtcaacgtgtgtgccatcttccctggtccaggcaccactcagctctggctcttcctgggaggtcagccgaggctccccccatgctcctggtttctgcttaggaggtggggacttgggctgggatggggacggcatacccctcccaggcctctccctctgcctttctgttcttaatcagggttggatccaagaaggtgtccagtgcttgggcctggggtggggggaaggtgttagaggactccaggagctcctgcacccctccccaaatgtccatctttctcagacggggctctgtctggggagcacccacaggctgcctttggggtcccagagcctgctctgtgcactgaccccagttcctccatcctgtggccagcctagggctcatggcatgggcccccactgggggagggaggcatcttgtttcttgtggttccctgcaggccagtcctgtcctcctttccctgttctgcccactctggggaatagggaggggaggagaggagaggagagggaggatcctggaggactgggaagatctagcctaaagaggcttctctgagggccagggccctacagcatgcccctacggccaggggactgtctgccagcctcccaggcccatgccctcctggtgcccctggcactgaggcacagatcgtcaaggcaggtaccccctcaacccttcttccactggagcccctgacaccacaggtgccctggagcccttgtgtgactcagcctctgttagctgggtgggtgtcatcagcccctgcctcccaggccagaacctgagaacgggcccagggtgctgtggagatcaacttcaaaagagctaaccccttcccacactccacccacccacctacatttcctctgtgaaatctacctcagagttgtaccctcagaaggacgggtaagcaggaggccagggggtccccagggctgaggtggggagccttctacggcgaaagcctgccaccccacaatgaatccaccctgctccactgcgcgcctctcccaggtctcagctctgggtggggagcagtggccgctaccgacagcgcatgtcccgctcttatccaactcttccaggccccacctccctgcacccctcccctctatagagcaggggagtgaaggggtatgtcaggcggggaaggggccaaggacacgtcattgtaccctgagcgtccccagggagtggaaatggggaagggggcctggagaggggaggcaggggcccctgtgctctctgaacaagttgaaagtccaaataaaacttacctgttccatctgtgctc

SEQ ID NO: 8497 - DNA, 1670 bp, Homo sapiens
ggaaatcttttacagtctttatatgtaagatccaggcgggggcagggggaatggcttggtctgttatctgccagggtttaattttgagacatggccgtttcacaactgcagggtgcgggaagattagatgacctgaatgctggtggtaagtaaagcctcacacttcacattattccttaattgtctgtttttaaaaatttgtcttaaaaaaatattaaggtggcaacatattcaggtggcaacagagggtggggtgaccagtgacaaactgacttccatgtctctggctaatcttgatttctggagccaggctccagactaagtctggacaatcaattaattagcctttctatatgtattgcctgatgaatgatttcaatgctggacattgaacaatggtctgttgcaacagggtgaggccattgtctctggcaggtggggagatgggggctcttgttagctccatttgattacaagagccttgaatcaccaaaacataaagatgtactcgaatagaagagtccgttgtctgactggtaaatttaaggatgtgtttgaccctcgtgcattaaaacagacaattggccgggtgcggtggctcacgcctgtaatcccagcactttgggaggctgaggcaggcagatcacaaagtcaggagatccagaccatcctggctaacacggtgaaaccccatctctactaaaaatacaaaaaattagccaggcgtggtggcgggcgcctgtagtcccagccactcgggaggctgggacaggagaatggcgtgaactcgggaagcggagtttgcaatgagccgagttggcgccactgcactccaatctgggcaacagagcgagactctgtctcaaagaaacaaacaaacaaacaaacaaaaccagacaattgaggcggccagctgcatttcataattcctcccataagcttcctcctatttgccacttgtttagcaatggaaatggagaacgaagatggcctcaaagtgactacatcaccagtgttacaaaaatgggccagaatttaaggcaagaattatatgtttcttaatagagggatgtttctctgtgtgtggctacttgtattcctgtggatttttaccagattataagagctgctaatttctgatcagaacagagaccaaaaattggagatatggatgtggggatgattcttttgggtaccgatagactgcaggaatcgcagggcttcctttaaatccattacagcttataggctagtggatgaataagataagtggagattttctcttgaaatatttccttctatgaagaaaaggccttgaaatgtgcatcctctttgggttgactaatttctatgcctttacagctttaagctgacattataagattattctagtttggatcttgtaagataattaacaaaatggaaataaaatgttttgtttttaaaaatgctaataaattatttattttcctttgtcttagttagttttaatacatattcagtgcttaaagaacaccagtgcaggaaaactcaaactaaatggcatcatcccccatctctataattctatatgcagtagccattcatgcgaagttagaaattagaatttatagcactaagcattctaagaaaaattaagccagtacgtttatctcttgaaaaaaaaaaaa

SEQ ID NO: 8498 - DNA, 266 bp, Homo sapiens
tcacgcctgtaatcccagcactttgggaggccgaggcaggtgaatcacaaggtcaggagttcgagaccagcctggccaacatggcgaaacctcgtctctactaaaaacacaaaaaattagctgggtgtggtggcaggtgcctgtaatcccagctacttgggaagctgaggcaggagaatctcttgaacctgggagggggaggttgcagtgagctgagatctcaccactgcattccagcctgggtgacagtgcaagactccgtctca

SEQ ID NO: 8499 - DNA, 15789 bp, Homo sapiens
gcagaatgcaaggggcggcctcgctcccctggccaccgcgggggtcgcggcctcccattacatagcgcgtgtctcgagccctggcctgctctcggcaccgccacaacgggcgtaatatggccgctggtgccgggacctgccgggcgcgcggagggtcgggccgaggtccgggatccggaactgctcccggcattcctcgcgagtgtatggcgtgggctcccttccccctctgtgggtcccgcgaggagactctcgggctttgaggtgagacctgaagttccgctggccggtagtgtagcaggaaagggcaggtcctcccgggtcgtgagccagtagcctcctggggtggcaaggtgtagagaggggggcgttgaaaggacacccgctacccggcctgctttctaggggtctctttggattgaggacatcagcagcagtggaagggattttactggagacctgtcactgtcagagccttaaaatatcaccgacggggccttaatgtcaccgaggtagagagaaaaggcagtagccctagagactattgcgacacagtgtgcccctcataagtttttccagggaggggttctgtactgagttgacgccccaggagctgagcaccaggctttgcatccttgggaactcagcaaacgtttgttcagccaattgcaggtagcatggcccagggcttgattgaggtggagcgaaagttccttccagggcctggcacagaggagcggctgcaggagttggggggcaccctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtaaggtgctgcgggctgacggcctgggggctggagatgtggctgctgtgctgggcccactggggctgcaggaagtagctagttttgtgactaagcggagtgcctggaagctggtgctcttgggagctgatgaagaggagccacagctcagggtggacttggatacagccgactttggctacgctgtgggtgaggtagaggccctggtgcatgaggaggctgaagtaccaactgccctagagaagatccacaggctcagcagcatgcttggtgagggagacaggcccttttgtgcttttcctgctccccacttttctcttttggaggcacctgctggaccatgcagtgggggagggcctccggattaaaaattttttttttaatagagacaaggttttgccgtgttgcccaggctggtctggaactcctggactcaagcaatttgcctgcctcggccttccaaagtgctgggattacaggtgtgagcctctgtgcctggcctggattatttttgtaatgggaattgttttagcaattttctaagtttgcttacagttctgtgaaatctcgttttctctttaacagtagctaatttggatctagtccttccacgtgtctaattccagccaacctgcctcatttagttctcatacctatagccagatctccttcagtttcatttctcagttccctgctttgactcttccttcccccaatctcttttttttcttcttcttcagtcaccactcctccacaaggagtaaaaagtaagcctttttacaaaagctgccctctgggaggctcagacccaggatcttcagatcatgagactgatgcactgcccactacactgagagtccaaccagtcttgtccttttgttttacaattacctagatccttttaatttgtccttttggctttttgtaaaggacaataacattatagttatgtgagacagtggggcatgatttggcagatttgttcctaagcataattcccttgtagacagttcatccacactaggaattgtgcatcccatggggccttacagccctgcagtgctgtttgagccccctcagcaaacatacactgagttccttgctatgtgcccagcatgctgccaggcactaacaacaagacactggcaacaggcagttccattctcacctcaccatgtagaggcgagaattctatgtgaatcccaccccatggctatagcttccctcctcttctttctatagctcttggtttctatgtgtacatctctgcatgtgcttcattactaagctaatgagctttggcctggtctagggctttaatcttgattgcggaacagggtaataactgaaatgagctgacgctgaggcatccttcgtttatcttggtgcctgggtgcctcttcgccatttctccttgctggaggagagaggctgaggtgtggcttctagtcccactcttgcctgaagttgctcttttaggtcccacttccacaggcaggcagggagtggactagtgtgttacagaagctgggtgggtgacattcagaaccccagtgtggctttggaaacatccacggagtcctggctaggtgggcagggagcagagtccaagtgcttgtggctctgtccatttctctcctcattgtccttttacctgtaggtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaaggggaagggaactctgggtctaacggagtccactcctgggcccactgtgcctctcccctcagtgtcccttctgacagtgactcctctctctccagcgctgcctgtttcttccccctcctctaagctactcttccttgagccctccctggctgcttcctctcgctcatccgtcagatgcaatctgtgggccgcccctctcccctggccgctaagcagcctccattgatttccgctcgtgtttataggatttccacttagccgtgatcagtagttaagcacaggaaaatcccttgccaccccccctcccttggtcgatgccattgattctgccagcggctcctaaaccgccttacagctgagttagaagatgaggagaggcagcagggatttccctgccttgggatgtgggaaacagaagaaaagttgaggaaatggttgggaatcgctgttagaactctagaaattctaatctgactttgccactgtgcccagctctggcccagagggtagagtgcctcctgtggaagtttaggggcaaatttgttccctgacctggagagggttagaaagaaccaacagctgccccctccccgcccccgtgttgagacaggttctcaaggctcaggggaagatgcatacctcctatgtaagaatgctcttcccttgctgttattcatacacactttccacttcaaatatacccaaatatggctttcctcacttctcaggctttattgggctttatttgtgggagaagggggctggtccccagtttttgcagtgcaaagccagagcgccacctgctggtagccctcaggtgtaggttcgaagctgctggggccccctggggtttgggacacaggagaatttcaggctgtgagtggagacagttactgccacgattccacaggcaagttgttcacctcaaagatctcctgcaccgactggtgaaagtggtcgtaggtgaggcgcagctttagccgcaggggggcctaggaataggagagcagggaccagggttagcacccacggcttcttctatccctgggtcttgtcttgggggaactcctgaagctcaccttgttaggattgaggattctgaagagctgggtgataggaaggccaccccgagctggaactgtgttcccactgggggcctgcagctgcagctggagactctgaacacaggagtttaacagagcacagtatggcagtaggtagggctcaggcagcccctctatactcagtggctccacacccttttcctgtaactccccaagtgctgatctccagatgactcaatcccatctcacactgtctcccacccacctcctccacttagtggccttttctcctggagtccccaggccacctctgaactctgatctttacaaaccttgggcacagcagcctggcagatgaaatgggtgacatcaccctctgagaagttggtggcagtgatggtgattaacagcaaagcagggttttcagggggtcgaatgaaagacagattcagctgtactccctcacgctcaaacactttgagatctgggatgggagctggagtagggagacagaagcagctcagtgtgcaggtttgagagaacatgtttgttcattcattcaacaaaaattgagtaaacacctactggccctgcactactcgaaaggctagtaacaaagtagacatgtagatgaggatggagcttactgtctaatgggggagagaaacaataaaaaaaggccgggcgtgagccagtaatcccagcactttgggaggctgaggtgggtggatcacctgaggcccggacttgggaggctgagacacaagaacagcttgaacccgggaggcagaggttgcagtgagccgagatcacgccactgcactccagcctgggtgacagagcaagacgctgtctcaaaaaaaaaaaaaaaaaaaaaaaaaaaaaggcaagataattacagaccataatagatgctatgaaggaagtaagtcatgccagaataactggggagaactgacttaaataggagtggtaggggaaggcatctgacattttagctgaagcctgaagagtgagaatgagctggtcatttgatgtgctggggaaagaacattccatgtaaaaaagaacatgaaatgccaagggtgggagggtgtgaggagctgagaagggggcagtgagtgggtagtgggaaagtggtataagaagggttggggaggaagcagggccctgtaggccagggaaagaagtctggaacaaagggaagacagatgaccatgattgacttcattcttttacctcctgagatggcgatgggatgggggacacacaggaagaagcagggtccatgagcctcagcccttggcttaggaggaggagcagtacatttccacctaccttctctaagacatcttccctttgcttaggcttacctgggggtggaggtacacagggaaggtcaagcaggtgtaccagggcacctcctggggaggggtccagatggggaggatgctggacatccccagaagccccatccaggagatctagcagatccaggagctgtgaggcctggcagaagggacagaaggggcagggctgggtatgaagctcagcccgtcttcctaccccagagtttctagccttctcacctggggctctgtgggcactggggctgcttctgaaagctgggctgcttctttgctttcctttgcttcctcatcagcctgagggccatctcgctccacaagaggcattttttccaggatggcagccctgagaggatggaatgcaagtgtgcctctgtgtggtctctgggcctttcacaagaggcatctaggatgaggactaggaatatggagccctgggcacatggtggctcagaagtacccttctgatttcctaaaatgacatgttgttgctgattttcagatgaacaaggagggttggaagccagcttagcttcaattaacagtgggtgggaagctctcaccgtggatatggaagaacacaggtgaggatgaggcccttgtacctagaaaagggcatttgggagagggcaggggtttgggtcccatgctgcagcacagtgctggacacacctcatgtggtcgtatttccggaagagtgtgtcatactccacagcccgctgctgcagctccacgtccaagcagctcccgtagatggacaccacctggcggatgcggctgggccagtgtagtatgtaagtggctatggcagtgtgccactgcaggatgtggcaagaaggaaaggcccacggagcagggaaatacccagatttggctcaaaaacaagaacctaagggctagggggtagggagggctgggcatgtatgcctggaaagaaactcaaaaatgggtggacccagtgacaggccatctctcaaggggctgggaccccttcttacttgttgtccccacagaggcgagtgctgagcttcatgagggctgtgagggcatatcctcgagtggctggcagggacatgtgggactgcagcaccttttccagcaatgccagcacttcctcttcgtccaccttcagacatggatacagttagtggccctggtgcaagtcctgtccccctgacaagtccctcctcagtgtacccccaatgaggtctcacctgaaggggctcaatctcctcgcagttccctgccagcaggaggtccccatactccccaatgcaccaggctgccacctgcaccagtggttgctacatgggataagaaactgctgggctggccaggcatggtggctcaagcctgtaatcccagcgcattgggaggctgaggcgggaggattgcttgagaccaggagttcaagaccagcctgggcaacaaagcgagaccccccccatctctattttaaaaaaaaaaagagagagagagaaagaaagaaacactgctgggccagtgtctgaggtcccctcctcacttccagacctggcaatatccctttaggcagtgcagagatggtggggggttggaggagtggggaaagggaagtttgttacctggctcccactgccctctggtggccaagcatcagaactacatggcctaaccaaacaggatggaaatgtgagagggtccctcccttgtggaaggggtggatgatgctttctgcccaccctatttaattaagatggaaaagggggctatagatactggctggcatctgttaattcattcagcattcaaggtaataataaaacctcataaacacaagagctttaatctcaaggcagctctaagaggcagtcagggtacatggagcataagggaagttagtcatctgtagttacataaccaggaggtaccagagtcaggacaaaagcccagatgttcttaaaaacagggctctgtgctcagatgtcttctgcactgtgtaagcagctgtgaccttgagagaaaaattggaatctagtagggaggaggtggcccaggatgggcaagggagtggttgggcagccctgggcctaggtaggtgggaatggtacctgggaaatgtcttctgccagggcattgtagaggcggcgcacagagtaggcatgtagctcctgggcccccccaatcagctgggtcaggttggccactgcatcatcccgcacatgggtgcccgcctggaaggtgtgggcatggccaagtcagtgtggtgaatcttgaccacttctgcccagctctctgactggcccctgcctcaccgttgtcagcacatgcaggatggtgtctatgtgccagcgtttggttggagcaaacctaggggatatatggctcatcagtcctggtactgacgctccccagattctaccctcttcgactcctgggcacctcacctctctgcagccagcaggatgcctgaggcacagtcagcccgtaggtcaggagggcaggactccagaaaggcctgcagctcttgcatcatggctcgcacattggagctatttaccagagccaggcttagttccagggctctcctggcaggagaaagaggtttccatgcaggtagcccaggtcatcctggtccatgcctcaggccctctgcttccccagggacctgtcccccttagtccccttactccagctgctctaaactggctcgagtcttggccacagggcactgggaacctctgccctgccctcctgtcccctctatcactgctcaccggctgagggaggcatcagtttcccgtagacattccaccacagtgggccgatgccgctgcacagcactgtgatcagactgcaccagtcgaagcagtgatgtcagggctacatacctggtcaggatgggggaggttctatcataccatggccatcagcccccactccccgtcctgtcctgggtatagggataagataagagagaaatggatcaggaggctctggaggaaggagggcagagggccaggggatcagtggcacagcctaggtagacagttgggactattacctaatgttcctgtcactgttgagtaggaagcgaccaagaatgttgacagctagaacctatgagaggcagaagttggggtcagtcggaaaggagcaacctgctcagccattgaggactgggaacacattggcgcaagatgatggggctaggagggagaaaccagcaagcaggacctgtgtgggtgaggtggtgggcggggccgtagtgggagaggcataaggggtgatacccgtaggccagctgcagagcggatatccatgatggtgagtactgtctcaaacaggaccgcatttccggcatttcggctggtgtccgtgttagtggccacctgagtggatgagagaggagatgtatctgctcaaggccctcctcaggtctcctttttttgatacagggtctcactctgtcgcccaaagctcactgcagccttgacctcccaggctctgatgatcctcctgcctcagcctcctgagtggctgggactacaggcacatgccaacaagcccaggtaatcctcaggattcttgaaggactccaacatgttatctgtccatccttcaaccatccaacaaagttccctgaggctctactatgtgccagggccagcctgggcactggggcaatagcactaagacagactgtgtcccttcttcatggagttcactgtctagaggagatggagaggcaattacacggccactgcacagtgacgagtcatgtgaggggcacccagggctgatggggtctccaagcaacacagctaaccagtgccctcccaggccccacctgggccagcaagtcattcatggtctcactgctctcctcgtggttccggcccaggatccgaagcagacgaagtatctggacctgaggttgggttgaaaatggaaagttggaggggttcataggataaggagtcgtggggctgaggagaaaactccaacatgtgagggtctggctcgctccctagagccttcccccacctcctcacctccacaggtcccttggtcctaggaggggaacagaggtgtgtgaggccaggggagtttaggacaggcttaaaaaaaaaattgttaacaaactgtattttcctgacttttaggcattccctctcccctcacaggtcctgggatgacccgagcaatcctgtgcctgctactctgctgcccaggacactgagagaaccagtgttctctgggaggaaaccactggtcatggtcttactgctatgccctctctgatccagggatacagcagtgaaaggtcaccccacctgcaggaaggggtcgctgactccagatatgctgtgttctgtggagtatcccattgtcaccagagtccggaggatgtgtaccagctggggtaccacctggagggagggcacaactttgggcattcgttctaatcctctccagctaaagccccattccttccccactgaccctgtcttccaggcccagggcctgccccttcaccagcccacctttcggaagtgcctgagggctgcagggcttcgttcgcagagctccgtgatcagcgtgatggtgcccagcaggatgcctggggtcagcgtcggggaagtgaatggtgggggccaggggcaagagagtctattgcgtgtgtgcctgtgtgtgtgcactacccttctcctgtgagctggggttcccatccgattttcaattcttctgtccatagacctgaagcaaaggatggggggccccacagccttaccatggtgacgctcatgaagcagttgggcacagggtgggaggaagacactggagagttcagggaccttccggatcatgtgcactgcagtcagaatagcctgcagaggtcaggggcctcagacaggggtcagaggagatggacccctgcatctactactatatagcacgcagcaggcagtgtgcaggagcacgtgccaggagtcccgccatctcaccttcttgcgcacgtagggactgggctgcaggagcagtttctccacctctggggccaggtctcggcacatctcagcagagcccatggtgctcaaagtgcacaaggccaggccttgtactggctgaatcccctggctcaggtcactgcagggtttgggaggacggtcagtcaaacctctgagaaaatcagtccttttcaatacccacaacaggcagtcccctgggatttccaaggtccctactctcccatctccctgattccaagtgattgccagaaccctctcacttcttgatgctgttggtaatgagcaggtgggcatcgtgcctctcatccaatagaagcatggcccccaggtagcccaccctcttgtctgtgaatctggaggaggcgatcagtttcaggcactccatctatagtgaagggggcagaccaggaagaggcaggggtgaaaccatagacactcacatccctgttccatcttcctctttaaaaccagattaacctgtggggcatcatatctcatcactctcccttcaacaagaggagaagcttaggaaattcaggcgttagtgggtaggaggaactaggagttgaggaggatgggagcggagaggaggagatgcctgccctaaaggaggctggccagagaatgaagggttcaggccagctgatgaccagtaggggtagcaatggggaaagaggtttgcagtgcaggctgtgaagactctgaaattgtagaatttaaaaaaccagggcataaacaggtgagagagtctgggactctgccccactagccttcatcaagctcaggagggaggtattcctggccagtacctgtccaaagtgggcggggtagcccaacatgtggacgtagagcagtttggccagctgccggtgcctgtgcactgggtccccgtcgcggaaggaggcccggatgtgggcacactccttttggatcacctcccgctcctgggcctgagtcttggccccgcgaatctcttcgatgaggtcctgaagcttcagcgaaggcaccaccatcctgactggcagagtccgggagtggagaaacactctctggtcgggcgtgcctgggctttcggcccaggcccgtcctgtgtcaagaccctaagagcccgggtcccacaggtaccctaaaattgcgcccgcattttacctttcccgaagtgggtctccaaattccgcgcccaccccaccgcccgagaagcccactacgcatgcgtccgcaccccaccggcgccccttcctattgagcatgcgcgggagccccacctatttctctctaccgtttcctccccctacctggtaccccatccctagctcagccattgcttttttttccacgaccctccgctgtttcttccgcgagcttcctcccccgatttccatctcaggcagcggcagcggcagcgacagcctgcctaccccaggactccagcctcacctggcttctgcctcaactccgctcctctgccccccagcgcttcctggtacggggccgagcaggggttggtgctccgtgcggtccttccctctccccgcctccaccacgggaccccgccctcctgggccgactgcagagccttcctgaatcctctgacctcgggcctcaggctttagcggagagacagcatgataggcctggagttcttcaagaggcctcctcgcacatccttaccacccggagagcctcagtttggatttgaagccatcgcaccccaaaggagatgacaatccccccccttttttgaacttttttattaatatattttttttgttaaatttctttgtatttttttcctgcaagacttggtgttggcggcactgttgtagtttaacttcaatcccaaattccatgaaatagaaatcagaagtaaaggttgagaggggaggaaggagggaggcaagccaaggaataaacaagagtttgactagaaaaaaagaagagggtatgtgtggtgggcattcctgggcaaggccattccttgagggagggggttggcaggcagcttgcctctgcctcatgcaggggagggaggaaagatcccctggggaccctgcagtcccctcttcctagggcttcctgctcccaggggaaaaactaataccagagagggatcagccacaacctcaaacagggctctccacccacctgtcacccgggtttgactcccacctctgccctgcctgggaagcatgtgagatcagctatctttgatcccctccttctgttgttttcccatttcacaagattctgatgtaaagggggaagggatataacccattttgggactactaaacttgtcacagcttctgcttccatgtgagctcctgttatcttgtctggtcctatcccccagaagtgcctcctcccaccacaactcccagagttgggatgtgggggccttgctcaagtgcctctaaccctctgcagtagaaatgtcttcttcaggccccttaggaatttaatcaaaggccacaagtgagtccagaccaaccaaataaactattatgggggagacagaagggtgggagaagtcagtggcaaagtctgggcagggtggacttgactgcattggatattctctgttcctttacacgttgctcttggcatggcatgccaccagagggggctggaggaggggctggccgatgaggagaaaaagagggaaatgctggggagttactctacttttcacttcccttctctccttcagggaaggatggaattgggcagtaacccagctcagtgcttggaggtaagataatagcctccaagattagaggtggaggatgcacctcctgcagctttttcactaggcctcagagggacagcaggccccttaggctagggagccacagcagctcagccagtgccttgcccgacattcaatcactccttcttcattttcttcctcctctccattcagcttccaggagtctccttaggacaccaaacccccacccgcagcgaagttgaggtctaaagaaaaggtgggagggcgtggagcaatggtctgacttagatttgtgtgtctcagagaagacagcaactctgagagagaaaagcccttcatatgtaaacaatctagagaaagaaggggttgggatggggaagggagtgaggaatacagagacagatccagaagaaatgagataatctgaaagaagacagggaaagaaaaagcgagagaaaaaaacaaaggagcacagaaaagaaaggaagaagagaaagaaagataggagaaaacacagccaggaagaggagaagagaaaaaaggcaggtcaaaggggtgaagaggcacgcaaccaaagccagaaccaggccaggaagtagcctcaggtgaggagctgggagaacaggaatgccaggctgaggtccaggagggccacggctcccaccaccagggggttggcagctccctagagagacagagggggaagcagactcagtccccgaggacagggcccaccttcctgccctgactgaggtggcagagctgaagggtctcaggcacctccctgcacagcctggagcagggggatcgccaacatttgttttggattgcaaaaccccctcttctcccaggcagggccccacctttcctctgacaccttcaatgcagggacagcccttccacctcctccctctagtcccctcccatcagcatatcatgtgtcccaggcaggaggtgcctggccttagtagcagacattggcagcagcagccagtactgcagtaaggcagagggatgaaggggtgaggatgtggttgctaggaaacagaaggcctagagcccaatcagagtagagggttctgggcaaactccgcctctcccggttttctgccttcttctctatttcaacttcttcccgggagagggagggagagtcagggtagggagggaacaatcttttccttttttatttctgggcaccaaagagagaaagtgcggaggtgggggtgggggtggagtaggaaactgagagctggaaatgatatggaaggagaacgggggaaaaatgttctggctctcccattaattattagtttacaaccctgggcaagttacttttttttttttttttttttttgagacagagtctcgctctgtcacccaggctagagtgcagtggcgcgatctcagctcactgcaggctccgcctcccgggttcacgccattctcctgcctcagcctcccaagtagctgggactacaggcgcccgccaccacgcccggctaaattttttttgtatttttagtagagacggggtttcactgtattagccaggatggtctcgatctcctgacctcgtgatccgcccacttcggcctcccaaagtgttgggattacaggcgtgagccaccgcgcccggcctgggcaagttactttaagtgctctgggcctcagttcccccatctgtcaaatgagggagttgggcttgcaggtgtgtaaggttccttccagctcgaacgccctctatttttttgaggtgggatgtggtccaagactggccaggcagaggaagccgagtgagataaaaagcccccccggtgatcagacagttctggaaagggtgggaggcaaggctttgggagaagagggcacacagcagggacagaggatctcaccggctgggcaggcctctcggttgcagcgggctccccgagctcttctgtcaggcacccagcatcaggacccctcgaggacgagcccctcaggaccagcatggcgatgggctcaggctccgtgcctgctggggccctcagcgggggcaggggctcttcatcctccccctcctcctctcgaagacttcctgaactgtcgctgcagcctccgaggagtggggaaccgtctctgggccctggcccttgcatcccagcctcatcctcagcctcatagccagctagttcctctgcctgtgcgcctgcccccccccactcctcaggccaagctttggggctggagaagggaccctggtcccctccaggaggcagtgggctccggcaggcagggggtcgccagggttggcgggaggaggcaggactgctgggcagttcaggggatccctctgagggggtcagtccgttctcatataccccagggctgtcctcatccaggggctccgtgtcggaaccttctgagtcctgcctgggtctgcggcctgggtagggatagctgagaatcagaggggcctaactggccttgggctggagtggctgcagctttattcctgactgggcacttcccaggactttggaattcccaggctcatagcctctcaccgccagaccccaaaccccccattatcctactgcatacattcccaagtcccactccccagactaccaggtctggcccccaccctgtgttccttgcaccctcattccttgttttttcccatccccacttcccttgcagggcttctcatctgtttccccacacctgagcctctctagctccctaggggcctcactgccctccccccagctgtccatgcctcacctggggcctctagcatgggctgcaggtcctgggctatcagtttggccattcgagctgcctccacggcc

SEQ ID NO: 8500 - DNA, 6752 bp, Homo sapiens
ccacctgggccagcaagtcattcatggtctcactgctctcctcgtggttccggcccaggatccgaagcagacgaagtatctggacctgaggttgggttgaaaatggaaagttggaggggttcataggataaggagtcgtggggctgaggagaaaactccaacatgtgagggtctggctcgctccctagagccttcccccacctcctcacctccacaggtcccttggtcctaggaggggaacagaggtgtgtgaggccaggggagtttaggacaggcttaaaaaaaaaattgttaacaaactgtattttcctgacttttaggcattccctctcccctcacaggtcctgggatgacccgagcaatcctgtgcctgctactctgctgcccaggacactgagagaaccagtgttctctgggaggaaaccactggtcatggtcttactgctatgccctctctgatccagggatacagcagtgaaaggtcaccccacctgcaggaaggggtcgctgactccagatatgctgtgttctgtggagtatcccattgtcaccagagtccggaggatgtgtaccagctggggtaccacctggagggagggcacaactttgggcattcgttctaatcctctccagctaaagccccattccttccccactgaccctgtcttccaggcccagggcctgccccttcaccagcccacctttcggaagtgcctgagggctgcagggcttcgttcgcagagctccgtgatcagcgtgatggtgcccagcaggatgcctggggtcagcgtcggggaagtgaatggtgggggccaggggcaagagagtctattgcgtgtgtgcctgtgtgtgtgcactacccttctcctgtgagctggggttcccatccgattttcaattcttctgtccatagacctgaagcaaaggatggggggccccacagccttaccatggtgacgctcatgaagcagttgggcacagggtgggaggaagacactggagagttcagggaccttccggatcatgtgcactgcagtcagaatagcctgcagaggtcaggggcctcagacaggggtcagaggagatggacccctgcatctactactatatagcacgcagcaggcagtgtgcaggagcacgtgccaggagtcccgccatctcaccttcttgcgcacgtagggactgggctgcaggagcagtttctccacctctggggccaggtctcggcacatctcagcagagcccatggtgctcaaagtgcacaaggccaggccttgtactggctgaatcccctggctcaggtcactgcagggtttgggaggacggtcagtcaaacctctgagaaaatcagtccttttcaatacccacaacaggcagtcccctgggatttccaaggtccctactctcccatctccctgattccaagtgattgccagaaccctctcacttcttgatgctgttggtaatgagcaggtgggcatcgtgcctctcatccaatagaagcatggcccccaggtagcccaccctcttgtctgtgaatctggaggaggcgatcagtttcaggcactccatctatagtgaagggggcagaccaggaagaggcaggggtgaaaccatagacactcacatccctgttccatcttcctctttaaaaccagattaacctgtggggcatcatatctcatcactctcccttcaacaagaggagaagcttaggaaattcaggcgttagtgggtaggaggaactaggagttgaggaggatgggagcggagaggaggagatgcctgccctaaaggaggctggccagagaatgaagggttcaggccagctgatgaccagtaggggtagcaatggggaaagaggtttgcagtgcaggctgtgaagactctgaaattgtagaatttaaaaaaccagggcataaacaggtgagagagtctgggactctgccccactagccttcatcaagctcaggagggaggtattcctggccagtacctgtccaaagtgggcggggtagcccaacatgtggacgtagagcagtttggccagctgccggtgcctgtgcactgggtccccgtcgcggaaggaggcccggatgtgggcacactccttttggatcacctcccgctcctgggcctgagtcttggccccgcgaatctcttcgatgaggtcctgaagcttcagcgaaggcaccaccatcctgactggcagagtccgggagtggagaaacactctctggtcgggcgtgctgggctttcggcccaggcccgtcctgtgtcaagaccctaagagcccgggtcccacaggtaccctaaaattgcgcccgcattttacctttcccgaagtgggtctccaaattccgcgcccaccccaccgcccgagaagcccactacgcatgcgtccgcaccccaccggcgccccttcctattgagcatgcgcgggagcccccacctatttctctctaccgtttcctccccctacctggtaccccatccctagctcagccattgcttttttttccacgaccctccgctgtttcttccgcgagcttcctcccccgatttccatctcaggcagcggcagcggcagcgacagcctgcctaccccaggactccagcctcacctggcttctgcctcaactccgctcctctgccccccagcgcttcctggtacggggccgagcaggggttggtgctccgtgcggtccttccctctccccgcctccaccacgggaccccgccctcctgggccgactgcagagccttcctgaatcctctgacctcgggcctcaggctttagcggagagacagcatgataggcctggagttcttcaagaggcctcctcgcacatccttaccacccggagagcctcagtttggatttgaagccatcgcaccccaaaggagatgacaatccccccccttttttgaacttttttattaatatattttttttgttaaatttctttgtatttttttcctgcaagacttggtgttggcggcactgttgtagtttaacttcaatcccaaattccatgaaatagaaatcagaagtaaaggttgagaggggaggaaggagggaggcaagccaaggaataaacaagagtttgactagaaaaaaagaagagggtatgtgtggtgggcattcctgggcaaggccattccttgagggagggggttggcaggcagcttgcctctgcctcatgcaggggagggaggaaagatcccctgggaccctgcagtcccctcttcctagggcttcctgctcccaggggaaaaactaataccagagagggatcagccacaacctcaaacagggctctccacccacctgtcacccgggtttgactcccacctctgccctgcctgggaagcatgtgagatcagctatctttgatcccctccttctgttgttttcccatttcacaagattctgatgtaaagggggaagggatataacccattttgggactactaaacttgtcacagcttctgcttccatgtgagctcctgttatcttgtctggtcctatcccccagaagtgcctcctcccaccacaactcccagagttgggatgtgggggccttgctcaagtgcctctaaccctctgcagtagaaatgtcttcttcaggccccttaggaatttaatcaaaggccacaagtgagtccagaccaaccaaataaactattatgggggagacagaagggtgggagaagtcagtggcaaagtctgggcagggtggacttgactgcattggatattctctgttcctttacacgttgctcttggcatggcatgccaccagagggggctggaggaggggctggccgatgaggagaaaaagagggaaatgctggggagttactctacttttcacttcccttctctccttcagggaaggatggaattgggcagtaacccagctcagtgcttggaggtaagataatagcctccaagattagaggtggaggatgcacctcctgcagctttttcactaggcctcagagggacagcaggccccttaggctagggagccacagcagctcagccagtgccttgcccgacattcaatcactccttcttcattttcttcctcctctccattcagcttccaggagtctccttaggacaccaaacccccacccgcagcgaagttgaggtctaaagaaaaggtgggagggcgtggagcaatggtctgacttagatttgtgtgtctcagagaagacagcaactctgagagagaaaagcccttcatatgtaaacaatctagagaaagaaggggttgggatggggaagggagtgaggaatacagagacagatccagaagaaatgagataatctgaaagaagacagggaaagaaaaagcgagagaaaaaaacaaaggagcacagaaaagaaaggaagaagagaaagaaagataggagaaaacacagccaggaagaggagaagagaaaaaaggcaggtcaaaggggtgaagaggcacgcaaccaaagccagaaccaggccaggaagtagcctcaggtgaggagctgggagaacaggaatgccaggctgaggtccaggagggccacggctcccaccaccagggggttggcagctccctagagagacagagggggaagcagactcagtccccgaggacagggcccaccttcctgccctgactgaggtggcagagctgaagggtctcaggcacctccctgcacagcctggagcagggggatcgccaacatttgttttggattgcaaaaccccctcttctcccagcagggccccacctttcctctgacaccttcaatgcagggacagcccttccacctcctccctctagtcccctcccatcagcatatcatgtgtcccaggcaggaggtaccttgccttaatagcagacattggcagcagcagccagtactgcaataaggcagagggatgaaggggtgaggatgtggttgctaggaaacagaaggcctagagcccaatcagagtagagggttctgggcaaactccgcctctcccggttttctgccttcttctctatttcaacttcttcccgggagagggagggagagtcagggtagggagggaacaatcttttccttttttatttctgggcaccaaagagagaaagtgcggaggtgggggtgggggtggagtaggaaactgagagctggaaatgatatggaaggagaacgggggaaaaatgttctggctctcccattaattattagtttacaaccctgggcaagttacttttttttttttttttttttttgagacagagtctcgctctgtcacccaggctagagtgcagtggcgcgatctcagctcactgcaggctccgcctcccgggttcacgccattctcctgcctcagcctcccaagtagctgggactacaggcgcccgccaccacgcccggctaaattttttttgtatttttagtagagacggggtttcactgtattagccaggatggtctcgatctcctgacctcgtgatccgcccacttcggcctcccaaagtgttgggattacaggcgtgagccaccgcgcccggcctgggcaagttactttaagtgctctgggcctcagttcccccatctgtcaaatgagggagttgggcttgcaggtgtgtaaggttccttccagctcgaacgccctctatttttttgaggtgggatgtggtccaagactggccaggcagaggaagccgagtgagataaaaagccccccggtgatcagacagttctggaaagggtgggaggcaaggctttgggagaagagggcacacagcagggacagaggatctcaccggctgagcaggcctctcggttgcagcgggctccccgagctcttctgtcaggcacccagcatcaggacccctcgaggacgagcccctcaggaccagcatggcgatgggctcaggctccgtgcctgctggggcactcagcgggggcaggggctcttcatcctccccctcctcctctcgaagacttcctgaactgtcgctgcagcctccgaggagtggggaaccgtctctgggccctggcccttgcatcccagcctcatcctcagcctcatagccagctagttcctctgcctgtgcgcctgcccccccccactcctcaggccaagctttggggctggagaacggaccctggtcccctccaggaggcagtgggctccggcaggcagggggtcgccagggttggcgggaggaggcaggactgctgggcagttcaggggatccctctgagggggtcagtccgttctcatataccccagggctgtcctcatccaggggctccgtgtcggaaccttctgagtcctgcctgggtctgcggcctgggtagggatagctgagaatcagaggggcctaactggccttgggctggagtggctgcagctttattcctgactgggcacttcccaggactttggaattcccaggctcatagcctctcaccgccagaccccaaaccccccattatcctactgcatacattcccaagtcccactccccagactaccaggtctggcccccaccctgtgttccttgcaccctcattccttgttttttcccatccccacttcccttgcagggcttctcatctgtttccccacacctgagcctctctagctccctaggggcctcactgccctccccccagctgtccatgcctcacctggggcctctagcatgggctgcaggtcctgggctatcagtttggccattcgagctgcctccacggcc

SEQ ID NO: 8501 - DNA, 410 bp, Homo sapiens
ttttttttttgtagaaacagggtcttcctatgttgcccaggctggtctcaaactcctggcctcaaatgatcctcctgcctcgacctcccaaagtgctaggattacaagtgtgagtcaacacacctggccaaaatgccatgtctttaaaccagtgtccttctccctataatacctctcactggtcatgtatttccagaaacatactggtgagagggcaggtgttgagaacatggcacttctcacccatcataggaaggagtccaggagttaagagccacggttcctcagggagcttcctcacatggaaggtcagacatatagttagagtctccagataaccatagtcctcagagggagtaagaaggaatcatctctattaatattttgtctcccaaagcattcaaagggcc

SEQ ID NO: 8502 - DNA, 1373 bp, Homo sapiens
ccctttgcaaaattaactctatttaaaatgaagattttagtcctttgaaatctctgcttcacaggagcattctctacagagggcctcccaagctctatgttcccattccttcaaggtaggatctcaacatgggagtggcccagcctgagggggagacacagaggctcaagcaactccagtgcaacagaaaggaacagtcagttttggattttggttgggtggaatatccaccgtataaactcccttggattcttccttcctcttgcttccagggggcagacagcatatgctttgctctctgattacacttagaagtctctttctggagtcagtgcagttggccagcaaaggatgttctgagcaaaccttttcagggttaccctacagcacagaatttattcattaaagaattttaccactacaatataaatgggaaataagaagatatactgctaaaatgagacataaaattgggtatataaattgctattttctgattaaatctggggagtacagtcactggggatggagtcaaattccttcaatacatttccttatgttttgacgagacagggtcattttgacctttcaaatgcgttaatcaaattccaggtgtctgtggttgacacatgggatagaaaaagtaagaagaaaataaacaattttatgctttaaatctgtgggagatgagtaaacaatgtgagtacatgaataaaattcctgtttaggtccaaaacatcccacataaacagattatttttataaaatggttttggtaaatgttatatattcaaactatttaaattgattcagtgtaaaaatgaaagtacctcatggagtaaaactttatgttaactcaatgtatgtctattttcatttatatcacaatttattattaatatctattaaggtatatatagtgccatctgtatttgagataattcattcaccctcagtttaaatatactgtcactagcaggcttcagataacataagagattaggcaaaatgcaaagcagggaatataacagaatggacactttatgttatattctgttactaaaagatgcagagaggctgggcatggtggctcacacctgttatccaagcactctgggaggccaaggtggcagatcacatgaggttgagagttcaagaccagcctggccaacgtggtggaaacccatctccactataaatacaaaaattaggagggcatggtggtgggcgcctataatccaagctactcgggaagctgaggcgggagaatcacttgaacccaggaggtggaggttgtggtgagccgagattgcctcactgccctccagcctgggcgacagagagagactccacctcaaaaaaaaaaaaaaaaa

SEQ ID NO: 8503 - DNA, 4145 bp, Homo sapiens
cgtcgttaatgattacatgttggcacaaggataccttgctagattagatccacagcacattaaagactgtttgctttctcactccccttctttccaattaagttggtgaaaaatgtaactttagtgttttacaggacagggtaaaggtgtttcatctaggtgatgtctatattataaaaataaaataaaatatataaatatgtaacacaaacccagtgcctattgttaaataaaatatacaataaaagcagaccttttaggaagattgattttaaaatatgctattatgatttaattataaaacacttgaaaacaatcttgagattaagatgaaataaccagatttctcagccaataaaaaggtaagtgtgtagcattctgtaactggatacactgacaaaaatgaagattacaattttatatcaagttgctcacttagaaattcatcagggagttctgaaacattctctcctagtatagtactttaatataaaaatattgccttttttttaattagatccatcggattgcacagtactgtttcaaaactctattaaagttgactttagtgattacagacagaaaattcctgggaagtcaaataatctcttctagtaacataaaaaatccattatcaatttacaatggaatttctgtgtaaattactttgcataaggaagtatatattttaaaaaatcatctgttatgcaacaacgcatataggggttatgagtatgtgtatgtgcatatgtgaacaaacatgctgacatacacacagaggatctgcacatttctggaaattatttttaaattaataaaagagaatgaaatcacaggagtgtgtagcaggataacagtcttttttttttaatgacaggataaaaaataaatgcccattggaatagaatattcaaacagtcccagaaactatacaatgtaacttgttagatccagcaagtaagatgtcatgtcaatgatctgatcaagaatacctgccctggtcactctgcggatgtttctgtccacttgttcacattgaggaccaagatatccttttttacagaggcacttgttcggtctaacacagacacctccatgacgacatgctggctcacattttgctgggagagaaaaagagcaagaacatcacactctcattctgtatgtcagaaacaggactgagcatgagaccaacaaatatttgctgaataagggaagcgagggaaaaaaggagggagatagttacaaaatgatctgaaagataaatatgcaagtaggaaacaggcttttacacccatagttatttggagacctgaactcagcagagaatgagagacatttctagagaagcagagatcatgagaaacaattgcaaccctttgcaaaattaactctatttaaaatgaagattttagtcctttgaaatctctgcttcacaggagcattctctacagagggcctcccaagctctatgttcccattccttcaaggtaggatctcaacatgggagtggcccagcctgagggggagacacagaggctcaagcaactccagtgcaacagaaaggaacagtcagttttggattttggttgggtggaatatccaccatataaactcccttggattcttccttcctcttgcttccagggggcagacagcatatgctttgctctctgattacacttagaagtctctttctggagtcagtgcagttggccagcaaaggatgttctgagcaaaccttttcagggttaccctacagcacagaatttattcattaaagaattttaccactacaatataaatgggaaataagaagatatactgctaaaatgagacataaaattgggtatataaattgctattttctgattaaatctggggagtacagtcactggggatggagtcaaattccttcaatacatttccttatgttttgacgagacagggtcattttgacctttcaaatgcgttaatcaaattccaggtgtctgtggttgacacatgggatagaaaaagtaagaagaaaataaacaattttatgctttaaatctgtgggagatgagtaaacaatgtgagtacatgaataaaattcctgtttaggtccaaaacatcccacataaacagattatttttataaaatggttttggtaaatgttatatattcaaactatttaaattgattcagtgtaaaaatgaaagtacctcatggagtaaaactttatgttaactcaatgtatgtctattttcatttatatcacaatttattattaatatctattaaggtatatatagtgccatctgtatttgagataattcattcaccctcagtttaaatatactgtcactagcaggcttcagataacataagagattaggcaaaatgcaaagcagggaatataacagaatggacactttatgttatattctgttactaaaagatgcagagaggctgggcatggtggctcacacctgttatccaagcactctgggaggccaaggtggcagatcacatgaggttgagagttcaagaccagcctggccaacgtggtggaaacccatctccactataaatacaaaaattaggagggcatggtggtgggcgcctataatccaagctactcgggaagctgaggcgggagaatcacttgaacccaggaggtggaggttgtggtgagccgagattgcctcactgccctccagcctgggcgacagagagagactccacctcaaaaaaaaaaaaaaaaagatgcagaaaaagtagatattgttaggcagcaaaggaagcagagagataataaattagcaggaatttgaatatcattacatttgaatactgattctcatatttttggtcaaccaacaaaaagacagagaagatgggtaaataacatgtaagcatttgttttaaataatgtaattacttaatttctgttgagttttaattttgataactccttcctagatacataaccatagtattaatcacacacataatgttattaatgctgaagcaatgtaagtttaaaatatatcctctatatgtggttttaaatgttggtttttttgttaggcaatataaaaatagacaagttatagttataattttttgaaatacatcttgaggacaaacaaaaagatagcatttatgaataaataatattaaatgttaatttgaggttttaattttcattggcaataagtattttaatatttgaaatagccgagatcaaaatcatttctaagtgatggtatatgctggttgttgattatgcattttcaacatacacattttaaactctaggtttctaaatttatctaattttctgacttcacaccaagtagaacttaagcatcattgcacataattgaggaactatcaagttataggctagaacaaccctggaataaatctcctttgctctctctgagcagatgcacacctagttgatggttcacaggggagtggcaaaaagcatgaaaaaaaatctcataatatgtctctagataattgcattttcccgttttatttaataacacccactgaaaagccctgtttttagtctgctgtggtaggaaagcaagcagtaaagccagggagggcatttacagggtgtctggaaaatgctagcgcttggagaggggctttgcaaacactaagtcattggctagtgtgaaatttcagaacccaggaccaagaggcctaaagagatgatctagttgtgctatttgcattttttactttttgaaaggactcagtcatttaaaggttttgtatatttataattaacttacataagtgaattgtttacattaagaaaatgaacaagattttacttacaagctcataaacagatgagcattaatagtattgtaaatggctaaatacttttgaacactatattattgtagaagaaacaatcaatgttgagttcttgagtacctaaggattggctcatccccagtccttttcaggtgaaaacagaaatactaaccagttctgcagaagtccccctcccagcctggactgcagcagcactttcccgtgggggtgcagtagccgtttcgacagagcctggagcactctgaagtcagtgtctgtgcaggttgtaccgtggctctgcattcctcaggcattaaaggtc

SEQ ID NO: 8504 - DNA, 1115 bp, Homo sapiens
cgtcgttaatgattacatgttggcacaaggataccttgctagattagatccacagcacattaaagactgtttgctttctcactccccttctttccaattaagttggtgaaaaatgtaactttagtgttttacaggacagggtaaaggtgtttcatctaggtgatgtctatattataaaaataaaataaaatatataaatatgtaacacaaacccagtgcctattgttaaataaaatatacaataaaagcagaccttttaggaagattgattttaaaatatgctattatgatttaattataaaacacttgaaaacaatcttgagattaagatgaaataaccagatttctcagccaataaaaaggtaagtgtgtagcattctgtaactggatacactgacaaaaatgaagattacaattttatatcaagttgctcacttagaaattcatcagggagttctgaaacattctctcctagtatagtactttaatataaaaatattgccttttttttaattagatccatcggattgcacagtactgtttcaaaactctattaaagttgactttagtgattacagacagaaaattcctgggaagtcaaataatctcttctagtaacataaaaaatccattatcaatttacaatggaatttctgtgtaaattactttgcataaggaagtatatattttaaaaaatcatctgttatgcaacaacgcatataggggttatgagtatgtgtatgtgcatatgtgaacaaacatgctgacatacacacagaggatctgcacatttctggaaattatttttaaattaataaaagagaatgaaatcacaggagtgtgtagcaggataacagtcttttttttttaatgacaggataaaaaataaatgcccattggaatagaatattcaaacagtcccagaaactatacaatgtaacttgttagatccagcaagtaagatgtcatgtcaatgatctgatcaagaatacctgccctggtcactctgcggatgtttctgtccacttgttcacattgaggaccaagatatccttttttacagaggcacttgttcggtctaacacagacacctccatgacgacatgctggctcac

SEQ ID NO: 8505 - DNA, 232 bp, Homo sapiens
cagaagatttttatggttcttactgtttttaaaataagatgtcatttgagctgggtcaggctggagtcatggtcacaactgctcattacctaatcttcagggaaaaaaatatccagtggcactttcctatcagtcgctgttacctgtgccacagtgtggtgagaagtttcttttcagttaaggaatgtaaacaaatgttttcattgacagtcaaatcaacagcattaggacg

SEQ ID NO: 8506 - DNA, 597 bp, Homo sapiens
tctccatgctcatttaatcctgagacttctttgaatagactgtcaattgaatctaaattgtgcaaaattatgcatgcactttttaatgcaggctattgttcactaagcactgaaccaagatttctcaacccatttccatttggcatgaggtcacttgaaacttaagtaatcatatatggaagacaagagcagtgtacttaaccaatctttctacattgtggcttctatataaatgcttactgggctttaattgcaaatctctcaccttaaaacaatagagaaatactagctacaatatattttttaaattgaggcttgtattcctaaaggtaaggagaaggtttagaaagtcagctggcgctgcataatctatactgctctacaatttagattctagaggaatggatgtttacagaagaaggacagccatagtgggtgtgcacttgtcatgagtagacgtgttttttcactagtgcaaagaggccttatattttgttaaaatccaaacgtggagagctggctttgaaaaccatgaagaaaaatatctactagactttttgcagttttaagtcagaacatgtcatctctgtaaaaccc

SEQ ID NO: 8507 - DNA, 2517 bp, Homo sapiens
agattattttcgaaataccagtatttcgactccagggggatgttcatttctatagtattttcagccccactgctggtgaatgccatgatcattgtggtacgtagatgacactttcagttgtctttcttcatgtgtatgtttttcaaatctaaacatgtctcaaacaattgtgtttaggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactgggaatttgatttgaagaagtccatgtcatatgtgtaactagtactaattataaatataaaatacacaatataaaatatgaaactcaataataaacagtgccacctgtacatgggcaccatgccctcctcctcgtgctgtgttttctagtgcatgccacagttcgcagtagagggtgttttcaccttccaagacatggggcaaagtttggagacacctggttgtcactggagggggtggtgctcctggcttctcctgtggagcccggggtgatgcataaaatcctgtgtgcctgggtcagccgcatcacagacaatgacttgacatgaaatgtcagctgtgctggggcagagagaccttggaaggaagctcttggaaaatacgttgtatctcagtttgatgaaccaattcacaagaggctaggccctctctagcaaagttatgggctgctttactgaaaacagaatggaagccctgaagtcaacactccatggagaagcgtgtctttcctaatgtcctggtgttctgttgatttaggtgcttgggaacacaatgctcccagttctgttaggacaggcatactgttactttgcaatatccactttataaaatagctcctgcccagtggctcttggttcctgtcaaatgtggacctgtagtttaagaatgacaggtggttagagacccagatatttaaaaataggtgttcaataagggaatactgattgtgcattgtatctggatagcatgcctaattgtgcatttctgaaagttaccaattcaaaatgtaattggaacagttatctttgattagacaagcctgggaagagaatgttgaggtgcagagctcaccagccaagttcatgcccctctcgggcctttgtggctgagaagtgggacagaaagatgattaaggtaatgtgtcctccctgtagcattgtccagggccgttgtgtagatatttgacttcactgacagaaaagaaaccagggagtttgtagagactgtgcatttttagtataacattttcaccatctgatatggtttggctttgtgtccccacccaaattgcatctcaaattgtaatccccatgtgtcaagggagggacctgatgggaggtgatgggatatgggggtggtttcccctatgttgttatcataatagagagggagttctcacaagatctgctggttttaaagacagcagtttcccctgctgtcactgtctctctcctgctgccttgtgaagaaggtgcttgtttctccctctgccatgattgtaagtttcccgaggcctccccggccatgtggaactgagtcaattaaacttcttgtttataaagtaatccaggtctcaggtagtatctttatagcagtgtgagaacagactaattaaacatctatatgttatttggacttaatatggggccgtgtgattgaatctcagtttgcctgtgataaagtagtgtaacagtattgctagctttgcatgaatttgatgctgatgacatgtcagtgtgaaaccatgacgtgtggtctttgattttcattctgcatgtgtgtgtctgtgttttggaacagttatattttggttttgtaaaaacaaccttcactttatttttaactgtgtagtaagtttatattcaatgccttaaagtgcattgttaacaattgtcttgatatgttgtcctcattttagggaaagtcatagaagccaaaatgatcagcagttgagtaatttacgaaagcacaggtgcaatcccactttaaagcactgggggttgcacagagcacactggtttcaggctccataaatgtggatgactcactggagagcttcatctgtttaagtagaacaaatgtttttactctactgataaagtacaggaaaggaggtttgggatcaaaattatttttcacattccaaacctgtgacaccttacgtttatcgattgctatgcaataaaatacatctttaataata

SEQ ID NO: 8508 - DNA, 436 bp, Homo sapiens
gcagcgtcgtgtcttcatgattcaccgagatctcctggtttcaaaagcgctgggttttttgcctgtcccacctgtgtggactgggcaccaggacgtctaacaaacatctcaaaattcacaattcagtcccattggtctgctcccccctcttcgtaggggcggcttctccctccagcttcttagaccagagacgtaacagggcattgttcaggaagctccgtccctccacctttaagatcagccacgagcccagtgtgttccatgcccttcaccccaccctcgccgacccgctgctgacatgcagcggtccctaagccgtcccccgactgcccagcctcttgggcatcctggggaagcgtgggcctcagagccaagcactgcccctcagaacgttccagagtgtccccagctcccccagagtaaacgcggagtcctg

SEQ ID NO: 8509 - DNA, 6882 bp, Homo sapiens
gaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggagtaagtgcccgagccccaggtggcgacgccatcctctcccagcacccccgcccccgcggagcgtctggcattttcctcctgcgcatccctcgcccctgactgccttcctagccctccctcccacctgccccctgcccttgctctgcggtttcctccgcttcacccttctcctgccaccccctgccccccaacagcaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccaggtgaggcggccaggcgggccgcgggtctgggggcgggcagagagcggcgagggcggggcctcacgcccgctgcacccttctcacatccccagtgggatctggtgtgtgacctgggctggcaggtgatcctggagcagatcctcttcatcttgggctttgcctccggctacctgttcctgggttaccccgcagacaggtgagggctgtcgtgggggcagggctggtagaaaggagggggtgctagggaagctaacccaagcagcgggcgtttacaggaggtcgaagacgattcgctggactctgcagtcttctctggacttctattcaatggtctatccatgtctcaacttcactctccatcaagaaataccccttccctacctcttccgcgcaagggaatgactcgacctctatggactattagtcccattcccactaattagtggccccctatccgtgaatcaatggcctcatctccaaagagaatagtctcatccccactaacagcccacatggactgttcgctccatctcagtgacctcattcctgaagatcaatatgttaattcctaaacaccaacagctccattcccactgatcaatagttcaacttcacaaacaaattaccccatttctgaccagcgacccctcccctacaagtcaactaactatctccaaagacaatatcctcagacccagtaacccacagtcccatgcctgccaccaaatgacccaacgctctgtaggggaatagcccatagattagcagtcataccctcatggatcctcagggctttgagatcctctcaccgaaatccccgtttccatgagtcggtagcttcacctctagagatcaacaacccaatcccagcaaccaataactcttcccacagatcaaaaatctcatctctgattctggtcaccttcaccactgaccagatgctctcactgcactaaacttccgattagactcagccccattgatccacagttccatccaagtggattaataactcaacttctgtggatcaaagccatcccaacattcaatagtccagttccttaaaatcaatacccatcctcactgcccaatagtcacacacctctgtgggccaatgatccgaaacccacaggtcaatagcccatccctatgcatcagtggcctcattgccacagaccagtagcctcattcctatggaaccatggtttcatccccaaagatcaataatttggtcttctaaaatctgtagccttcagcacattaaccaataagcccatcctcatggaaaaatgccccaccccattagatcaatagcctaactcccagggattggtgccccttttgcaatgaccagaggctccctatcttcatctccatagatcaatggtcttatccccaaagatcaatagcccagcctccaagaatcagtaaccatgtcttcactaactcatagttagtgaccataatcacttaccaatagtctcatctcccctggtctgtgaccttatccttactgattattcccatggattaatagattcatcccactgatcaatagtcctaccttatggattaatacacccatgtctatgtccccactgatctttcttttttctttcttttttttcttttttctttctttttgagatggagtctcgctctgttgcccaggctggagtgcagtggcataatctcagctcactgcaacctctgcctcccaggttcaagcgattctcctgcctcagcctcccgagtagctgagactacaggcacctgccaccacacctggctaatttttgtatttttagtaaggatggggtttcaccatatttgtcaggctggtcttgaactcctgacctcgtgatctgccagcctcggcctcccaaagtgctgggattacaggtgtgagccactgcgcccagcctgaccattcttaatgtattaatagaccaatgtcccacctccatggaacaatggcctcatctccaaaaatcaattactcagtcccctaatatcattggctttaccttcactgaccagtagtatcctcatgcacaagtggccaatggcctcccctccacaggttaatagttccaactccgtatatcaatgaacccccctcccacatctcctctgaacagtctgagcaagataagctccaggcccactgaccattagctctgttcctaaggatgaatggtcccaaatcccctaagcaatatcccatcccctctgttgagtgatgtcacatccattgacaagtgccctaatctctgaccaatagcccaagagtcaatgttcccacctcttaaagaaccacaaccacaccccagtgcccagtagccaggcatcacccacccatggtccccatccctccccatcttctcaagcctctgtccaactcttgctcccagaacttcattctcatacctctagctctgaagtgtgcagctgggtcttacccagcaactttcccaccaccagagagtctgggtgaccagaagcccttcccactttctagatttggccgtcgcgggattgtgctgctgaccttggggctggtgggcccctgtggagtaggaggggctgctgcaggctcctccacaggcgtcatggccctccgattcctcttgggctttctgcttgccggtgttgacctgggtgtctacctgatgcgtaagtggcaccctcccagaattccctcccttgggtctcatgcctacctgcctgcatcgccaggccatcctcactgccccctaggccacatttcagctgcctagaatctcagctatctttctgcccaggcccccttgaagaatccagggctcttgcttctctctacacctatctccccctcccgacaatctttaaagtctttgtcctggacttactgctgccaaggaataaggtgctattcccctgatagcagtaagtccagggacaaggattgtccctagctgtgtgaccttggacaagggttgatgtgaaggtcaaataagaggcctgatgggaaagggcctataaattggaaatgttgaacactcacccaggactctggccctagagccctcctaggtttgagcaggagaggagagagggctgaacagtctccccagtccttgccacccagaggttagcaagggaggcaatggctgcagcctccactctgggtctgacctctctctctgtcctcctccctccctctttcttcttctctcttatgccttcttcctccctggcctccctctcctctctccacccctgctgtatctccaggcctggagctgtgcgacccaacccagaggcttcgggtggccctggcaggggagttggtgggggtgggagggcacttcctgttcctgggcctggcccttgtctctaaggattggcgattcctacagcgaatgatcaccgctccctgcatcctcttcctgttttatgggtcagtattacccttcacctgtcgtctggcaattcccatctctgcctccaaactagccctagcccggagacccctcctcttctccaactacccctggtccaggcctaccccagccccagtccctcagaggtgcacatttcccacccctagatcaggagaagggaggcctcacagtataccccttcccccctgcccccagctggcctggtttgttcctggagtccgcacggtggctgatagtgaagcggcagattgaggaggctcagtctgtgctgaggatcctggctgagcgaaaccggccccatgggcagatgctgggggaggaggcccaggaggccctgcagggtaagagacagggatccctgtgagtgttgcctcacttgcacacatgatggtgccctctgcatggctgtagctgtgccaccttctcccagggtccccaccacccatgtgggaggatcctgggatctcagggttttcttctgacagctcctctctctctcccaaagacctggagaatacctgccctctccctgcaacatcctccttttcctttgcttccctcctcaactaccgcaacatctggaaaaatctgcttatcctgggcttcaccaagtgagcctgggtgtctgggctgagggccaggccagtagctggaatgggggctggctgggtgggaaggcccggggacccctgcggaggaccatcagcactgtagaaggctgcgggaggggattcaggctctgttcgttgcttccccaccccttctcacagcttcattgcccatgccattcgccactgctaccagcctgtgggaggaggagggagcccatcggacttctacctgtgctctctgctggccagcggcaccgcagccctggcctgtgtcttcctgggggtcaccgtggaccgatttggccgccggggcatccttcttctctccatgacccttaccggcattgcttccctggtcctgctgggcctgtgggattgtgagcatcctatcttccccacagtgtgggctcaacaagggaaccccaacagaggtgcttcagacaggcacagccatttcttctggcacaggcctcccaagacaagccccagaccctgcccagctcttccacgagcctccacctggccccacagccccatctgctctcccagtcaattactgaatgcccagagcctgcccagctagagccatgggaacagagagccaaggggatgacacccgggactaggccagccttgacctccccacctgcattcatatcatccctcttgcttctgcagatctgaacgaggctgccatcaccactttctctgtccttgggctcttctcctcccaagctgccgccatcctcagcaccctccttgctgctgaggtcatccccaccactgtccggtgagagcaggggtgcccccaggggcagagccgggccccctcgcctcccgctcccccaccccacccctgaggacagggcctgcgggctggaggaggggggctgcgggagaagggcccagcaaggctacagctgtgggctgagctcctcctctgtctccccccaggggccgtggcctgggcctgatcatggctctaggggcgcttggaggactgagcggcccggcccagcgcctccacatgggccatggagccttcctgcagcacgtggtgctggcggcctgcgccctcctctgcattctcagcattatgctgctgccggagaccaagcgcaagctcctgcccgaggtgctccgggacggggagctgtgtcgccggccttccctgctgcggcagccaccccctacccgctgtgaccacgtcccgctgcttgccacccccaaccctgccctctgagcggcctctgagtaccctggcgggaggctggcccacacagaaaggtggcaagaagatcgggaagactgagtagggaaggcagggctgcccagaagtctcagaggcacctcacgccagccatcgcggagagctcagagggccgtccccaccctgcctcctccctgctgctttgcattcacttccttggccagagtcaggggacagggagagagctccacactgtaaccactgggtctgggctccatcctgcgcccaaagacatccacccagacctcattatttcttgctctatcattctgtttcaataaagacatttggaataaacgagcatatcatagcctggacttccctcccttctgtttgtccttctatctcttgggggaaggtttttctcagtggaatgcacaccgataacaagctcccctctccctccttgtgccctgcccccagtggtgacttacagacaactgtcaccacttactgactgcttgcactgctgccagaactggcctaagcacttgacacacttcgtatcatttaatttttacagcattgcaaggtaggtgtttggatcaattaggggttgttgttgttgttgttgttgttgtttgttgttgtaagcaataaaaactggctctaatgaactt

SEQ ID NO: 8510 - DNA, 392 bp, Homo sapiens
atcactaccaatacagacccctcctgcagttgcgtcaccccgctggacttcaatcattgcctcaagaaccgggaggataatggcctgcccatgctcagcaccaatgccatgagctggaagacgatttctgcaatggagaaaaggggagcaagagagactcagcagcaaaggaagagagtgtttagaggaagaggggtcaacagtgccaaatgctgttgagaaatggagattcaaacaggatgggagtgatgaaacccaagaaagtggtctccttgtagaggactgaagctagggctgatacagggccaagacagtcttccatatgcataagttgtactgtaatagccagtttacatgtctgtctccctggagtaaaggtctccaaagtggaa

SEQ ID NO: 8511 - DNA, 6708 bp, Homo sapiens
gtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcaggtacgctgcggcagtgtccgctgctccagccccgcgggcggatcccatctttgcttccgtacctttaccagtgtccctgtctctctgcagtccgagaatgtcgaccggggcgcgggctccatccgggaagccggtggggccttcggaaagagagagcaggctgaagaggaacgatatttccggtgaggctcaccgggtcccaagtccagccctggatctcccaatggccttccaatccttaaactgccaatcgccccacccgttcctacctggtgccttgggcgccccatcccccaacagaactcccgggccccaatccagtataccctaacccttgatgtcccgaccgttgccacgtatagggcactcccagttacctgcacaacagtttcaggcccccaaaccgtttccaccggcgggtctccaaaacaacccacggctcaactcctcctttatcattaccatctcccgcgtggagttctcctcaggtcgtgcgaaacacccccagattcttcgcacagtgtctagatccgaccgcccaacgtttgcctcccagcctgactccctcggcccttacccacctgtcaccccctctacgctctccttcctcgccagcacgccttagctttgcaagcctgcatgcattcaggcttctcaggtgtttctagacccccgactccgcaagagtgaggatgatgggagctggtcatgggagctacttatggttggacaccatcttctaaaggcttttgccctactcagcccaacctagacctgtagatttccctctcctgcttaggagtatggagtgggctgggcctccctttgccagccttgagttatctttaactgacttctgtccactctggagagcagtgaggaattaatcttgcttttgcttgtcctttggcctttcacttctgccttctgttgagaattatcaccatgacacctgccataccgtatagagagccaaggtacagccgttagagactatctaattgagcccctacattttgtagttaaggaaaactgaggcctaaatgtgaccaaaccaacattgtaatccagtcccttcttggaacctaaattgaactgccaagtactgcgcatgcaagagaccctttattggccttacagtgggccattcatttctataggcaaagaaagctctagacagattggaataggaaatggatatttgccttttagctacacccctttgtctgtcttcctcattttgttcctttttttttccctaaaggggagtcaagttccctgggttgttcccctcataaggtattagggacttgtgtcacatctctctggagttttctattttaaagaggaatctgaaagcaataagctctttggtcttcttaagatggctacacctcaatttaagatggggtattctttcactagttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaactgtgtttgatgccttcttctatctggaagagatagacagacaccaatggactgctaaaatggattagaggcgtccctgcatccaggaacccacagacaatgcacagtgtgataagtgctatgaaacaacacgagttggggggataggtgtgacacagacaaagtacccctccccgtctaattagaggtgttcagagaaagcttcctgaaggataaatcccaatctgaagcataaagatcaggaggatcctggagatccgaaggagtcattgcttcaaaagatacaattaggccaggtgcggtggctcatgcctgtaatcccagcactttggaaggccaaggtgggtggatcacctgaggtcaggagttcaagaccagcctggacaacagtaaaaccccatctctattaaaaatacaaaaattagccaggtgtggtggcacgcacctgtagtcccagctactcaggaggctgaggcaggaaaaccacttgaacctgggaggtgtaggttgcagtgagccgagactgtgccactgcactccagtctgggtgacagaatgagactctgtctcaaaaaaaaaaaaaaaaaagatacaattgaaagtaccatcagttaaaacagcattttgcatttttaaaatggtttagaggatacttaatatgagctagtcatccttgttctaattttgtagattgagagaactggaattagaaatcatgtgatttatacagtcactcagcaccttggcagtgagacttgtgtccaggttttttgactactaaaccaagtctgttattagcagaaaatcagaattatttcttaggttatattttgctttgccaagtattttgtttcaaattagacttgagggcctagtataactaaattattatacaaactagttgtgtaactcctctaggcaaaaaaatttgaggtgacatttgggccattagcaaaacattttcagttcaccagttcagtagagtatttgcccaggattgtaatgagttatttgttctaagaccctatctatctcacaagggcctgtaggaccattgagtgataaaagcttggagaagtcgcattgaccttgtctgtacagacaaaacactagatagtttgacttgcccatgaaactgaacacagccaggtgtggtatgtgcctacagttcagctacttggcagtctgaggcaagacgattgcttgagcccaggagttccagacatgcctgggcagcattttgaccccatctctttaaaaaaaaaaacaaaaaacaaaaaactaaactttgaattataatgattataatgttgctgaatctcagcactgaggcctcagtagtgcctataaatcttgcaagtggccagcaacaaaataacctgaaaagatgaagttcaagaaacaatcatactaagtcaaatgccttttattttaacattattaacagtgcaacacttgaaaagtttaaaaattggaaacaagtattagcaaacatctttaattttgcatatttgtaaccaaaaaaacaaggtatacaaaatcccctgaatttgtacatgatggtgtttttttgacttataatcaacaattgccttactaagagtgatgttcctgaattgtttcctcagtaaaggtgtaccataggctgggtgcgatggctcatgcctgtaatcccagcactttgagaggccgaggcaggcggatcatctgaggtcaggagttcaagaccagcctggctaacatggcaaaaccccatctctactaaaaatacaaaaattagccatgtgtggtgttgggcacctgtaatccccgctactcgggaggctgaggcaggagaattacttgaacctgggaggcagaggttgcagtgagctgagattgtgccactgtactccagcctgagagacagagtgagactccatctcaacaacaaccaaaaaaagattaaataggctaatttaaatatatctgaactttgtgaaaatggtaactcatggtctttttgttatgatatacctgtggttaatttttctatcatgctgcagtaaaagcaagatgtaaatactgagtaatatcacaaacatgtttgaatcctaaaagaatttatgtgacatgagccagtaaccactgaaaaaacagcacaggtcataggtggttcttagaatcaggataatttggaaaatactacagcagtggttccatgagccagcagtgtcagcatcacctgggaacttgttagaaatgcaaattctcggcagggcgcggtggctcttgcctgtaatcccagcaatttgggaggccgaggtgggtgggtcacaaggtcaggagttcgagaccagcctggccaatatggtaaaaccccgtctctactaaaaatccaaaaattagctgagcatggtggcgggcacctgtagtcccagctactcgggaggctgaggcagaagaatcgcttgaaccgggaggcggaggttgcagtgagccaagatcgcaccactgcactccagtctgggcaacagagcaagactccgtctaaaaaaaaaaaaaaaagaaatgtaaattctcaggccccaccacaaacctgctgaaacgaggggtttgactcagcaatcctttaacaagccctccggttgattctgtcatgtatgcaccaaagtttgacgatcattgtagtacaggtagtttctcatggaatctgctggcatttttgggtaaacacttttataaagacagattattaggtataataaaagtaactatatatgtttaatataattcataatatgaatgtgactttagaatttagaaataaatggttcttgtatggaacttgttaacatttgagaacacagcattccacagaatacagtttgggaaatacttcacttgtataatatatttattgccttagtcaaaattctttttgtcctccgcctcccactgcttcacttgactagcctaaaaaaataaaaaataaaatcctttttgtttacatgtaacagaaaccagcactggctgtctaaaggggaagaaaaagagtaatttactggaagaaataggggctattgtctcacagaatctcaagaagatttcagcaaacaagactcaggaaaaaaagggacagcagtagccagaggagttctgtgaacttacaggagcagatctgtctaagcaacttctaaaccctctgggtcagaatcgggctggctgggctgggcgcagtggctccccgctgtaatcccagcactttgggaggcaaaggcggacggatcacttgatcccaggagcttgagaccagcctgggtaacatgaccaaaccccatttctgcagaaaatacaaaataataataataataataataatggcggtacaggcctgcagtcccagctacctgggaggctgaggttgaagtgagctgtgatcatggcactgtactccagcctaggcaacagagtgagaccctgtttccaaaaaaaaaaagaatcattggggtgcttttttttatatatttgaaagagttctatagaattttatgcagtgaagttatttaacaatcgcagaattaatggagcactttaaaattatttgctcattaaatctcatatttttagcaaatagatccattccattagtttaattttataaccatagtaaccgaagcagggaattgtgaagtaactttcacaaggtcacatgatcaggtttgtgctgatcaaggtcttcacttcagaactcttgctcccacaaccttgagttgcagttccaatccagtgcttcagttgcctattagctagctccctcctcaatctgggggagtgggaggtacatgggtagcggggtatgggtggtaaaggcaagggctcctggaagtaaatatagaagtgccagcggttggtgttggcattagctttttggctgtaacataaaccccgtcagcatgtctatgcatgcctatatgatgcaaacacatgtttgcaatagaggctagtttgagattttcacaacagtaagtctaaagttgtagttctcaggccgggcgcaatgcctcacatgtgtaataccagcactttgggagaccgaggcaggcggatcacctgaggtcaggagtttgagaccaacctagccaatgtggtgaaaccccgtctctactaaaaatacaaaaattagtcaggcatggtggcgcacacctgtccagctacttgggagactgaggcaagagaatcacttgaacccaggaggcggaggttgcagtgagccgagattgcaccactgcattccagcttgggcgacagagccagactccaactcaaaaacaagtaaaataaaataaaataataaagttgtagttcttagcacaggtggcacactgaaatatgtggagagctttaaaatctcttccgcagctgggcgtggtggctcacgcctgtaatcccagcacttagggaggctgaggcggacggatcacgaggtcaagagatcgagaccatcctggctaacatggtgaaaccccgtctctattaaaaatacaaaaattagccacgcatggtggcacgcgcctgtagtcccagctactcgggaggctgaggcaggagaatcgcttgaacccgggaggtggaggttgcagtgagccaagattgtgtcactgcactccagcctgggcaacagagcgagactccgtctcaaaaaaaaaaaaaaaaaaaaaaaaaagaaa

SEQ ID NO: 8512 - DNA, 5062 bp, Homo sapiens
cgagattactgaattttacaagcttgacattttctattggctttataagctcttctcatgtttttattaccctcacatccaatccgttcgagctacacgctaaatcaaattggtattttatatttttatttttttagaggcaggatctcgctctgtcacccaggcaggagtgcagtggcacagtcatggctcgctgcagccttgacctcgcctcagcctccccagtagctgggaccacaggctcatgccacgcacgcccggctgaagctagttttaactgaagaaaactcaaagtgttctctcgccgttaacctttattattgaggcattggctctgctataggaaaacgaggtgacgttaatgtcggtggttgacattaaccactggcaagtgacagtgtggctccttgacaagtggttgctgctcataaatgtcatgaaacaaaaacactgattttagagaagtgggattctacagttaatatcgccagcaaacttttattaagctctcactctgtgccaaacacatgcttgaagttggggtgaatctgtgaccattaagatgttggctgttcatgggcacgttatcaagcaactggggtgtgagagcgaatgataagagggtgaatctggatgaggagggacttccagggcacaggtggaggagaggcattgcagccatagagaggcccaagggaacagtcaagacaaggcggggacagtggccaggaggcgagggcagcacttcctgggcagggaaggcttgccagggagaccagactcctgtctctgtttggaaagaaaaggaaccgcactgggggtcagggaggctaggcacggcaccagcctgggatgccagtcccgcctgaggggccaaggcaaaggggaagcattcacagaccccacaccaggctctgacgccaagtggaagaagagggagatagaagcagaagcctgggcttccaggcctggttcctgggcgggtgttgatgggacccagggagagtcctgtggggatactttgggtctgggctggcaggggctctggaaggagaggcatggaggtgcgaacctggtgcccaggtggaggtgcagtgggggtaaggtggccaggctgcagacccctgcatcagaatgcctgcgaagctgtgggttttttgtttgtttgtttgttttatttcgagacagggtgtcactctgtcgcccagactggagtgcagtagcgccgtctcggctcactgcaagctccgcctcccaggatcaagtgattctcctgcctcagcctcccgagtagctggatttacagatgcatgccaccacgcccagctaattttttgtatttttagtagaaacgaggtttcaccacgttggccaggctggtctcaaactcctgacctcaaatgatccacctgcctcgtcctcccaagtgctggaattacaggtgtgagccgcaccagcctgttttttaattttatttagagacagggtctcactctgttgcccagactggagtgcagtggtgtaatcttggctcactgcagcctcaacttccagcgctaaagcaatcctcccacctctgcctcccgagtaactgggactacacacgcatgccactacacccaggtaatttttaaaaattttttttagagacagagcttctccatgttgcccaggctagcctcaaactcctgggctccagtgaccctcccgccttagtgtctcaaagtgctgggattacaggtatgagccaccacgcccggtcagaagctgtgtttttaagtggacataccatcttgtcctgctgaagtatctccatgtaatcacaatatctatgtcacccaaatctcctccttcctcctccctcccccaaaacacccccacaggcatgcataccctcccatgcgctggaggcagaatctcccaaggggagctggccaggagaggtgtccctgagttcagatggaggtggaagccagagtggggctgggaccacccagtgacatgaggatggggcttgggataaagccctggggacactgacatttaaagtgtggacagaaggagctactgaaggcaatggatttagaaaagcaattgagtatgatttccttcttcaagaaaggctgtccaactagctctcacttcctctcgtgtgttcagtgtcacccggaagcagagtttaatgtgactaaagtcaacattggctcacactgtcagggagtgtgggaagatgagtaaggactcatcgcagggcgatacccacagcttaaaataggcaccttcccctcccaggtctggttagggcagttgttacatatgaggggcgtggagttttgtcttgtattttggccttgttggtaaagcattccaaagcttcgacacaccctcctttcagcccattaggaaaggctgttgattgtaatattcacacagctccctgggctatggttaagagccttgcagaaggactgggagaagccctgtgtgtttgaagtattgtagcatcagaaaaaaacaccggaagaaggcaggtggggacaaggtgcctatgtctgctccttggaattcctttccttactgtccgaggcaactacagggaaagcaaagcgtgagcccccaaatccacacctgggaggaacgttcccctttgcaaggcatgggactggctggccctgtgtctcacgggggctctgagttttgaggtcacactagcctcctgaggcctggctgagagggctgggttgggggtcaggaggccccctgtagccacgaagctcctctggggcattgttaaaggttcaccctcttttttgtgggtatcctggaagatctcaagaaactgagcttggaagaagagaggctgagagggtctcccgccgcctgcgttctctgcagctatggccccacagcctccagtgaccatggaggggaaggtgccacccgccttggctgctgaaagggtgatgctcttatgcctgagtcttggctcctgtggtcctgcagagaccctgtgggggccgcccggtcgtcacctgcactcatcttgggttttccttccttttccaccctaagctgaaggtatttttttcctgttttcttcactctaacttggggaagaaggaagatcctttatggaaaagaaaaaaaaaaaagcacctttgaacgtcctgcaacttgagtttcaagctttcagaaggattcggtgctgctggcctgctcagacctccgcctgggctgtggagttcctcctgttggcccctcctctctgtaccacaaaagctctaggcggcccagccacccctgtgaaagcggcgcccgtagccagacgccaaggctgccgtcccgagccgagggtggcaccttgcccagcgcacgtgcattctcctgtgggaactcggagggcatgtggtgagcagtctcctgtcagttgaggtggaggctcccggcccatctttgctctcctcaggctgcccagctcctggcggcacatggtggcctggcaaagctgacttggcctcctcagttccccacccatccgcggatcatcgccttccctagccacctctctctatagccaccgacatctgcggagcgtcacagactggttctgagctgtggtttacaaattcaacccaacacagagtgaattcaaatttgcttttggaacagcctttatctccaattaagtgcaagtatatttacactatgtgatattaaaggacttctccaatgactgggaggtactgaaccaagatgtttgtaaagaaacggtggggtgaggtggttaggtagaatataccgtcctggccatttctcttccttcaggcgagtaagcgctccttcagcagaaaggctgcggattgctggctgtgctctgtggactgggccagtaggtgtggcccaggtccaggtcctggcacctctgctgagtgcccagcctgagatgacacatgccatcctggagagaagcagagagggtgctgtctccaggcgttctccagacagcctgggcctggcttgctgagccagctgcaggaggggatctcctgactggggcttgggaccagatctgctgcagagaggcaataactctgtctaaaaagaaaacttgtcccgtgtgattacaaaaacaggaaaaggctccaagctaggaaatgagatttgaggtatggagaacattctcacctgatggaagcatcctgttcctgtacaggaggaggagctggtgcaagccctaggccacatatgtcacagttgttttggaccctccgtagcttttatactcataaaatattaaagttgcccctttcatatttgggtcattgaaagagcccaccgtactctaggttcctgctcactatgcacaacatctcagaagatggcgtacaaaactatttttctaactatagcacaggtaatgtgggggtggggaggcttgggatatacctaaatgtggcaaatgatttatcttccaccttgagggatgaaaaggaaactatgcacttgaattttaattaaaattttaatttaattcattggatagcttgtgccagaaagaacagtcaatattcaagaagcaaaactgacgattagctcagtttcgggcctccctgtcgggggagttttcttgtctggaacacaaacacctacaagtagagtgtgagctggttcttgacaatcagatctcatcaaccctttgaaatgttctgggcagcacagctccttggtctgcatggttggtgtaagtataatcaagtagtgaaattgtatggtatatacctatatgccaacagtgtacacccgtatgtgcagaatttgctaatataaccatttcaataaaaacctattgaaaaagctgatttgaccacatggagtattgttggtggtgacgtgtatcactgaggactctcttggttacaaatgacagaaaacccagccaaaactggctaacacaaaaggggaatgtcatggctcccaaaagccaaaatgcccaggggtgcctatgtcaggcttggtgtgatttcaccctcaaatgctgacaccaagacacatgccaactttg

SEQ ID NO: 8513 - DNA, 5061 bp, Homo sapiens
cgagattactgaattttacaagcttgacattttctattggctttataagctcttctcatgtttttattaccctcacatccaatccgttcgagctacacgctaaatcaaattggtattttatatttttatttttttagaggcaggatctcgctctgtcacccaggcaggagtgcagtggcacagtcatggctcgctgcagccttgacctcgcctcagcctccccagtagctgggaccacaggctcatgccacgcacgcccggctgaagctagttttaactgaagaaaactcaaagtgttctctcgccgttaacctttattattgaggcattggctctgctataggaaaacgaggtgacgttaatgtcggtggttgacattaaccactggcaagtgacagtgtggctccttgacaagtggttgctgctcataaatgtcatgaaacaaaaacactgattttagagaagtgggattctacagttaatatcgccagcaaacttttattaagctctcactctgtgcccaaacatgcttgaagttggggtgaatctgtgaccattaagatgttggctgttcatgggcacgttatcaagcaactggggtgtgagagcgaatgataagagggtgaatctggatgaggagggacttccagggcacaggtggaggagaggcattgcagccatagagaggcccaagggaacagtcaagacaaggcggggacagtggccaggaggcgagggcagcacttcctgggcagggaaggcttgccagggagaccagactcctgtctctgtttggaaagaaaaggaaccgcactgggggtcagggaggctaggcacggcaccagcctgggatgccagtcccgcctgaggggccaaggcaaaggggaagcattcacagaccccacaccaggctctgacgccaagtggaagaagagggagatagaagcagaagcctgggcttccaggcctggttcctgggcgggtgttgatgggacccagggagagtcctgtggggatactttgggtctgggctggcaggggctctggaaggagaggcatggaggtgcgaacctggtgcccaggtggaggtgcagtgggggtaaggtggccaggctgcagacccctgcatcagaatgcctgcgaagctgtgggtttattgtttgtttgtttgttttatttcgagacagggtgtcactctgtcgcccagactggagtgcagtagcgccgtctcggctcactgcaagctccgcctcccaggatcaagtgattctcctgcctcagcctcccgagtagctggatttacagatgcatgccaccacgcccagctaattttttgtatttttagtagaaacgaggtttcaccacgttggccaggctggtctcaaactcctgacctcaaatgatccacctgcctcgtcctcccaagtgctggaattacaggtgtgagccgcaccagcctgttttttaattttatttagagacagggtctcactctgttgcccagactggagtgcagtggtgtaatcttggctcactgcagcctcaacttccagcgctaaagcaatcctcccacctctgcctcccgagtaactgggactacacacgcatgccactacacccaggtaatttttaaaaattttttttagagacagagcttctccatgttgcccaggctagcctcaaactcctgggctccagtgaccctcccgccttagtgtctcaaagtgctgggattacaggtatgagccaccacgcccggtcagaagctgtgtttttaagtggacataccatcttgtcctgctgaagtatctccatgtaatcacaatatctatgtcacccaaatctcctccttcctcctccctcccccaaaacacccccacaggcatgcataccctcccatgcgctggaggcagaatctcccaaggggagctggccaggagaggtgtccctgagttcagatggaggtggaagccagagtggggctgggaccacccagtgacatgaggatggggcttgggataaagccctggggacactgacatttaaagtgtggacagaaggagctactgaaggcaatggatttagaaaagcaattgagtatgatttccttcttcaagaaaggctgtccaactagctctcacttcctctcgtgtgttcagtgtcacccggaagcagagtttaatgtgactaaagtcaacattggctcacactgtcagggagtgtgggaagatgagtaaggactcatcgcagggcgatacccacagcttaaaataggcaccttcccctcccaggtctggttagggcagttgttacatatgaggggcgtggagttttgtcttgtattttggccttgttggtaaagcattccaaagcttcgacacaccctcctttcagcccattaggaaaggctgttgattgtaatattcacacagctccctgggctatggttaagagccttgcagaaggactgggagaagccctgtgtgtttgaagtattgtagcatcagaaaaaaacaccggaagaaggcaggtggggacaaggtgcctatgtctgctccttggaattcctttccttactgtccgaggcaactacagggaaagcaaagcgtgagcccccaaatccacacctgggaggaacgttcccctttgcaaggcatgggactggctggccctgtgtctcacgggggctctgagttttgaggtcacactagcctcctgaggcctggctgagagggctgggttgggggtcaggaggccccctgtagccacgaagctcctctggggcattgttaaaggttcaccctcttttttgtgggtatcctggaagatctcaagaaactgagcttggaagaagagaggctgagagggtctcccgccgcctgcgttctctgcagctatggccccacagcctccagtgaccatggaggggaaggtgccacccgccttggctgctgaaagggtgatgctcttatgcctgagtcttggctcctgtggtcctgcagagaccctgtgggggccgcccggtcgtcacctgcactcatcttgggttttccttccttttccaccctaagctgaaggtatttttttcctgttttcttcactctaacttggggaagaaggaagatcctttatggaaaagaaaaaaaaaaaagcacctttgaacgtcctgcaacttgagtttcaagctttcagaaggattcggtgctgctggcctgctcagacctccgcctgggctgtggagttcctcctgttggcccctcctctctgtaccacaaaagctctaggcggcccagccacccctgtgaaagcggcgcccgtagccagacgccaaggctgccgtcccgagccgagggtggcaccttgcccagcgcacgtgcattctcctgtgggaactcggagggcatgtggtgagcagtctcctgtcagttgaggtggaggctcccggcccatctttgctctcctcaggctgcccagctcctggcggcacatggtggcctggcaaagctgacttggcctcctcagttccccacccatccgcggatcatcgccttccctagccacctctctctatagccaccgacatctgcggagcgtcacagactggttctgagctgtggtttacaaattcaacccaacacagagtgaattcaaatttgcttttggaacagcctttatctccaattaagtgcaagtatatttacactatgtgatattaaaggacttctccaatgactgggaggtactgaaccaagatgtttgtaaagaaacggtggggtgaggtggttaggtagaatataccgtcctggccatttctcttccttcaggcgagtaagcgctccttcagcagaaaggctgcggattgctggctgtgctctgtggactgggccagtaggtgtggcccaggtccaggtcctggcacctctgctgagtgcccagcctgagatgacacatgccatcctggagagaagcagagagggtgctgtctccaggcgttctccagacagcctgggcctggcttgctgagccagctgcaggaggggatctcctgactggggcttgggaccagatctgctgcagagaggcaataactctgtctaaaaagaaaacttgtcccgtgtgattacaaaaacaggaaaaggctccaagctaggaaatgagatttgaggtatggagaacattctcacctgatggaagcatcctgttcctgtacaggaggaggagctggtgcaagccctaggccacatatgtcacagttgttttggaccctccgtagcttttatactcataaaatattaaagttgcccctttcatatttgggtcattgaaagagcccaccgtactctaggttcctgctcactatgcacaacatctcagaagatggcgtacaaaactatttttctaactatagcacaggtaatgtgggggtggggaggcttgggatatacctaaatgtggcaaatgatttatcttccaccttgagggatgaaaaggaaactatgcacttgaattttaattaaaattttaatttaattcattggatagcttgtgccagaaagaacagtcaatattcaagaagcaaaactgacgattagctcagtttcgggcctccctgtcgggggagttttcttgtctggaacacaaacacctacaagtagagtgtgagctggttcttgacaatcagatctcatcaaccctttgaaatgttctgggcagcacagctccttggtctgcatggttggtgtaagtataatcaagtagtgaaattgtatggtatatacctatatgccaacagtgtacacccgtatgtgcagaatttgctaatataaccatttcaataaaaacctattgaaaaagctgatttgaccacatggagtattgttggtggtgacgtgtatcactgaggactctcttggttacaaatgacagaaaacccagccaaaactggctaacacaaaaggggaatgtcatggctcccaaaagccaaaatgcccaggggtgcctatgtcaggcttggtgtgatttcaccctcaaatgctgacaccaagacacatgccaactttg

SEQ ID NO: 8514 - DNA, 5063 bp, Homo sapiens
cgagattactgaattttacaagcttgacattttctattggctttataagctcttctcatgtttttattaccctcacatccaatccgttcgagctacacgctaaatcaaattggtattttatatttttatttttttagaggcaggatctcgctctgtcacccaggcaggagtgcagtggcacagtcatggctcgctgcagccttgacctcgcctcagcctccccagtagctgggaccacaggctcatgccacgcacgcccggctgaagctagttttaactgaagaaaactcaaagtgttctctcgccgttaacctttattattgaggcattggctctgctataggaaaacgaggtgacgttaatgtcggtggttgacattaaccactggcaagtgacagtgtggctccttgacaagtggttgctgctcataaatgtcatgaaacaaaaacactgattttagagaagtgggattctacagttaatatcgccagcaaacttttattaagctctcactctgtgccaaacacatgcttgaagttggggtgaatccgtgaccattaagatgttggctgttcatgggcacgttatcaagcaactggggtgtgagagcgaatgataagagggtgaatctggatgaggagggacttccagggcacaggtggaggagaggcattgcagccatagagaggcccaagggaacagtcaagacaaggcggggacagtggccaggaggcgagggcagcacttcctgggcagggaaggcttgccagggagaccagactcctgtctctgtttggaaagaaaaggaaccgcactgggggtcagggaggttaggcacggcaccagcctgggatgccagtcccgcctgaggggccaaggcaaaggggaagcattcacagaccccacaccaggctctgacgccaagtggaagaagagggagatagaagcagaagcctgggcttccaggcctggttcctgggcgggtgttgatgggacccagggagagtcctgtggggatactttgggtctgggctggcaggggctctggaaggagaggcatggaggtgcgaacctggtgcccaggtggaggtgcagtgggggtaaggtggccaggctgcagacccctgcatcagaatgcctgcgaagctgtgggttttttgtttgtttgtttgttttatttcgagacagggtgtcactctgtcgcccagactggagtgcaggagcgccgtctcggctcactgcaagctccgcctcccaggatcaagtgattctcctgcctcagcctcccgagtagctggatttacagatgcatgccaccacgcccagctaattttttgtatttttagtagaaacgaggtttcaccacgttggccaggctggtctcaaactcctgacctcaaatgatccacctgcctcgtcctcccaaagtgctggaattacaggtgtgagccgcaccagcctgttttttaattttatttagagacagggtctcactctgttgcccagactggagtgcagtggtgtaatcttggctcactgcagcctcaacttccagcgctaaagcaatcctcccacctctgcctcccgagtaactgggactacacacgcatgccactacacccaggtaatttttaaaaattttttttagagacagagcttctccatgttgcccaggctagcctcaaactcctgggctccagtgaccctcccgccttagtgtctcaaagtgctgggattacaggtatgagccaccacgcccggtcagaagctgtgtttttaagtggacataccatcttgtcctgctgaagtatctccatgtaatcacaatatctatgtcacccaaatctcctccttcctcctccctcccccaaaacacccccacaggcatgcataccctcccatgcgctggaggcagaatctcccaaggggagctggccaggagaggtgtccctgagttcagatggaggtggaagccagagtggggctgggaccacccagtgacatgaggatggggcttgggataaagccctggggacactgacatttaaagtgtggacagaaggagctactgaaggcaatggatttagaaaagcaattgagtatgatttccttcttcaagaaaggctgtccaactagctctcacttcctctcgtgtgttcagtgtcacccggaagcagagtttaatgtgactaaagtcaacattggctcacactgtcagggagtgtgggaagatgagtaaggactcatcgcagggcgatacccacagcttaaaataggcaccttcccctcccaggtctggttagggcagttgttacatatgaggggcgtggagttttgtcttgtattttggccttgttggtaaagcattccaaagcttcgacacaccctcctttcagcccattaggaaaggctgttgattgtaatattcacacagctccctgggctatggttaagagccttgcagaaggactgggagaagccctgtgtgtttgaagtattgtagcatcagaaaaaaacaccggaagaaggcaggtggggacaaggtgcctatgtctgctccttggaattcctttccttactgtccgaggcaactacagggaaagcaaagcgtgagcccccaaatccacacctgggaggaacgttcccctttgcaaggcatgggactggctggccctgtgtctcacgggggctctgagttttgaggtcacactagcctcctgaggcctggctgagagggctgggttgggggtcaggaggccccctgtagccacgaagctcctctggggcattgttaaaggttcaccctcttttttgtgggtatcctggaagatctcaagaaactgagcttggaagaagagaggctgagagggtctcccgccgcctgcgttctctgcagctatggccccacagcctccagtgaccatggaggggaaggtgccacccgccttggctgctgaaagggtgatgctcttatgcctgagtcttggctcctgtggtcctgcagagaccctgtgggggccgcccggtcgtcacctgcactcatcttgggttttccttccttttccaccctaagctgaaggtatttttttcctgttttcttcactctaacttggggaagaaggaagatcctttatggaaaagaaaaaaaaaaaagcacctttgaacgtcctgcaacttgagtttcaagctttcagaaggattcggtgctgctggcctgctcagacctccgcctgggctgtggagttcctcctgttggcccctcctctctgtaccacaaaagctctaggcggcccagccacccctgtgaaagcggcgcccgtagccagacgccaaggctgccgtcccgagccgagggtggcaccttgcccagcgcgcgtgcattctcctgtgggaactcggagggcatgtggtgagcagtctcctgtcagttgaggtggaggctcccggcccatctttgctctcctcaggctgcccagctcctggcggcacatggtggcctggcaaagctgacttggcctcctcagttccccacccatccgcggatcatcgccttccctagccacctctctctatagccaccgacatctgcggagcgtcacagactggttctgagctgtggtttacaaattcaacccaacacagagtgaattcaaatttgcttttggaacagcctttatctccaattaagtgcaagtatatttacactatgtgatattaaaggacttctccaatgactgggaggtactgaaccaagatgtttgtaaagaaacggtggggtgaggtggttaggtagaatataccgtcctggccatttctcttccttcaggcgagtaagcgctccttcagcagaaaggctgcggattgctggctgtgctctgtggactgggccagtaggtgtggcccaggtccaggtcctggcacctctgctgagtgcccagcctgagatgacacatgccatcctggagagaagcagagagggtgctgtctccaggcgttctccagacagcctgggcctggcttgctgagccagctgcaggaggggatctcctgactggggcttgggaccagatctgctgcagagaggcaataactctgtctaaaaagaaaacttgtcccgtgtgattacaaaaacaggaaaaggctccaagctaggaaatgagatttgaggtatggagaacattctcacctgatggaagcatcctgttcctgtacaggaggaggagctggtgcaagccctaggccacatatgtcacagttgttttggaccctccgtagcttttatactcataaaatattaaagttgcccctttcatatttgggtcattgaaagagcccaccgtactctaggttcctgctcactatgcacaacatctcagaagatggcgtacaaaactatttttctaactatagcacgggtaatgtgggggtggggaggcttgggatatacctaaatgtggcaaatgatttatcttccaccttgagggatgaaaaggaaactatgcacttgaattttaattaaaattttaatttaattcattggatagcttgtgccagaaagaacagtcaatattcaagaagcaaaactgacgattagctcagtttcgggcctccctgtcgggggagttttcttgtctggaacacaaacacctacaagtagagtgtgagctggttcttgacaatcagatctcatcaaccctttgaaatgttctgggcagcacagctccttggtctgcatggttggtgtaagtataatcaagtagtgaaattgtatggtatatacctatatgccaacagtgtacacccgtatgtgcagaatttgctaatataaccatttcaataaaaacctattgaaaaagctgatttgaccacatggagtattgttggtggtgacgtgtatcactgaggactctcttggttacaaatgacagaaaacccagccaaaactggctaacacaaaaggggaatgtcatggctcccaaaagccaaaatgcccaggggtgcctatgtcaggcttggtgtgatttcaccctcaaatgctgacaccaagacacatgccaactttg

SEQ ID NO: 8515 - DNA, 133 bp, Homo sapiens
ttttttttttttgagacggagtctcactctgctgcccaggctgaagttgcagtggcgtgatctcggctcactgcaacctccacctcccgggttcaagcaattctcctgcctcagcctcccgagtagctgggac

SEQ ID NO: 8516 - DNA, 282 bp, Homo sapiens
cgctttggtgattttttttttttttgagacggagtcttgctctgtcacccaggctggagtgcagtggcgcgatcttggctcactgcaacttccgcctcccgggttcacaccatcctcctgcctcagcctcccgagcagctgggactacaggcacctgccacgacgcccagctaattttttgtatttttagtagagatggggttttactgtgttagccaggctggtctcgatctcctgacctcgtgatccgcctgccttggcctcccaaagtgctgggattac

SEQ ID NO: 8517 - DNA, 133 bp, Homo sapiens; identical to SEQ ID NO: 8515

SEQ ID NO: 8518 - DNA, 246 bp, Homo sapiens
ttttttttttttttgagacggagtcttgctctgtcacccaggctggagtgcagtggcgcgatcttggctcactgcaacttccgcctcccgggttcacaccatcctcctgcctcagcctcccgagcagctgggactacaggcacctgccacgacgcccagctaattttttgtatttttagtagagatggggttttactgtgttagccaggctggtctcgatctcctgacctcgtgatccgcctgcct

SEQ ID NO: 8519 - DNA, 115 bp, Homo sapiens
tttttgtatttttagtagagacggggtttcaccgtgttagccaggatggtcttgatctcctaaccttgtgatctgcccacctcggcctcccaaagtgctggggttacaggcgtga

SEQ ID NO: 8520 - DNA, 7948 bp, Homo sapiens
aagtcacatgagccaccaaaatggtggtgttcgggtatgaggctgggactaagccaagggattcaggtgtggtgccggtgggaactgaggaagcgcccaaggtaggcggaaatccgaagtggtatggggggtgatttctgcaccttcaaagtgttggcagactcttctaagatgatacctttaaaggagatttgaaaagttaaaacagctcccaagtccatgcaaggagcagtcgattaagtctccagttgctgtggaaagaggcggagagaacgtagatgacctaaattctagtcctcattatctgcagtttgttttctcttgtctccaggcctttgcacaggctttttcttcaacttggagtatttccctgcttctatccgtcccaactcccctgccaaactgttctctttcggttattgatttaaatgtcacttcttccgggaagccttcccacgcttcctctggctagattgtttgctttttcttaggttgttgggtttttcgtttatgtcactctctcattctgtgtttaaattgccagcttttttgttctgaactcccactgcgttgtggattcctgaggatgggatgactgtatcttgattacccggaggtctggcatataccacgtgctccctaaattatgagcgaatgttgaataaaattctaaaggtgaaatttattattaggtgaaaaatttattattaggtaaaataatacacatgaaagcactacaaaaccgttagatgatttgcaaactataaacctacataaatgcactcttactggtataagcgtggtgactagttgagtggccttaagggggaaggggtgtaatgaaagcactggagtctttgacagtgccttgcaaagcttaagcactcaaatatttcctgtgttctttccagtatttcagtatttgctgtcctgtaatcataatcctgggtgtctgttttccctatagagactttagggtgtagactaggtaggagattagtagaagatattgcctggaagtttgttttgttttttgtttttggtggaaggtggaggatttcaatgaattggatgagagcaaaacaaaaatttatctatggtttatggttactcatgttattgacgtctgccaagacagcagatgtcttagtacaatagatgggttaggtatagaatctcccttagatgttactatcccttatactttccatttgggtgtcagggagagggaaaagatgtaagtctagtcactgaaaaattgtaatttgtaaaatattttacctttttttccccctgccctctccagaaatgttacagaaaaagattgagtacatttctgccatgatgcagagaaagaaactggtccattattactcattgtgtaacaccataagaaggttcaaaggagctcataccttctgtatgttgatgccaggaactgtgtataatgaactggccttctatagttaggattggtacataccgctcattcagcaaatgagtattacagtgatattcaacatgtgtccattgactacagcatcagaagcactaagtgctattaaaatgcagattctaggcctcatcctactcctgctgaatccaggtatctcaggagggaattcatgagactgcatttcaaataaataccccatgtgattcttgtgcatgctgaaggttgagaaccactgatttattaagtatcttgtgtgttcattatgctttatcccctctaatcctcttgtctaggactccttaaatttgagatttagtatttccctttaatataaacattaaaattgagattagtgtaaatttgtaaagagactatttagctaatctggaggaaaaagagtaaaaagcactgaatttagcagcaatagaccttccacttggctgctgtagtaggtaaacatttgcaaccacgtgtttggatttaacaaatgttattaagacttttcacagagactctagagtcttgcccagagcaaaacattcagaaacgatcctctctgagagtgcagggtttgtttttttgttgttgttgttttgttttgttttttaacctgtctagtttctgttaagatgctactggccaggtcttcatggtcccttgacattggcagctgtctgttcatcacacttgggacacaagaaccttccgaccaaggagcccagtgccatgggtctctggggccgggcacggtggctcacgcctttaatcccagcactttgggaggctgaggcaggtggatcacctgaggtcaggagttcgagaccagcctggctatcatagtgcaatcctgcctctactaaaaatacaaaaattagccgggtgtggtggcaggtatgggtctctgctataccacatgaccatttctagcaaaggctctgcttccaccacaggtggtaatagggaactggatatataatttatgtactccaaagtagtagccacaatccactgcctgttcccttcctggagcagtgtccctctttctgatttttctctctcactattctccaaggcaatccctgctctctcctacctctctaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagtatgttagccttctacactaaatctcaagcaagccaacctttcagaccttcagtttgctcatatgtatagaaataatcattatactaccaatttctcaagttagtgtgtaaatcagaaagccaatgtctgtattgtaggatgtttagcaagaaaataaaaaataataacaaaaagccaatgtctaacagataataagagctcagtaaatgttgattgaattactaacaaagtatgtgaaagcagacgacacagtacctggcacactactaaactgtaaatgttttcaaatctgaatctgtagaattctgtaaggttttatgtaatatgaatatcattagctattatggctctggaatttttttttccaggttttcaagatggcagcatctatgcatggtcagcccagtccttctctagaagatgcaaaactcagaagaccaatggtcatagaaatcatagaaaaaaattttgactatcttagaaaagaaatgtaagagaaatgcccaggctgaaaatcagtcattttatttgcaagtcttttgtattgccattgtttctaagatcctattctttcttaccttttctgttatctaagatcctattctttgagttggctatgaagaacacatctttaaaaaaaagaatgggggaaacaagaacagatgaaaatggtggtttgttggaatatttcggattgtggataatttcttttgtttcttaaaaagtatccaaaagtattgctaaaacttttgtgcagtaaatgtattttaattaaaagtaattaggagaaaaccattgaggggggtacttatatttaattggtgagtaattataatcagtttaggattgattatctcagccacagtacttagtacagcaaaagggaatacagatttcatggtataaatatagtctcacattaacatattgacttttttttttgagataagagtctcactctgtcacccaggctggagtgcagtggcacaatctcggctcactgcaatctccagctcccaggttcaagtgattctcctgcctcagcctcccaagtagctgggattacaggcgtgtaccaccacaaccagctaatttttgtatttttagtagagatggtttaaccatgttggccagactggccattttgacttttaaatgaacaaagttcaagaaaaaaatcaaaggacagttgatgttatttcctggatttacatatgggtcttaataagaaaactaaatcagatttttttggatgaagttttataaatcttggacaaattattttattttattttattttatttcattttctgttttatggctttattgaagtataatttatatatcttgacattcatccatttaaagtgtacagttatatgagttttagcaaatttatacagttatgtaaccatcaccacaattaaaatttggaatacttccaacatccccaaaaagttccctcattcccttttatttttttttattttattattattatactttaagttttagggtacatgtgcacaatgtgcaggttagttacatatgtatacatgtgccatgctggtgtgctgcacccattaactcatcatttagcattaggtagatctcctaaagctatccctcccctctcctcccaccccacaacagtccccagagtgtgatgttccccttcctgtgtccatgtgttctcattgttcatttcccacctatgagtgagaatatgcggtgtttggttttttgttcttgcaatagtttactgagaatgatgatttccaacttcatccatgtccctacaaaggacatgaactcatcattttttatggctgcatagtattccatggtgtatatgtgccacattttcttaatccagtctatcattgctggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgtgacactgacttccacaatggttgaactagtttacagtcccaccaacagtgtaaaagtgttcctatttctccacatcctctccagcacctgttgtttcctgactttttaatgattgccattctaattcatgtgagatggtatctcattgtggttttgatttgcatttctctgatggccagtgatggtgagcattttttcatgtgttttttggctgcataaatgtcttcttttgagaagtgtctgttcaggacaaattattttaaatgtatctgggactaatgaagaaatagaaggcctaaccaaatgtaaacagcttttttttagatgaacttaagcaaagtaaatcttttagttgcaggaaaggtattcttggatttgggtagctcataaaatttggctgcattggaacatatttatatttatttgtggccaaaattatttaaaagagctctattttagaattactgtaaatattcttagaaagagaatcatgtcctctcattagaatacaagttctatgaggggtgggaaatttctttttttcttttgctttgtttactgtcctatcttaagcacttagaaaatacttttcacatatagtaagtgctcaagaaatatttgatattgatatgcaataacaacttttcaggagaggctgtatccattaagttcaatggtatagtgaactgaatttttctttttttctattaggacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcaggtgaatttaaattcactaatgtataacgtagttatgtctaagtaaagttacttattaacatatactgttgctactgctaataataattctttacatttatatattgctatacagtttacaaagtccatataccttgtcatatttaatccctgcaacaatcctcctaatcaggtaaactgtatttttttatttctgtagataagcaacccaaactgaggcatgttcaagtacgctaataagcaacatactgggaaaagaattggctgtggcatacaacgcacatcatttcagtatgctacctcctgccacttaagttttgtgacattcagtaaggcatttcatctctgagcctccgttgtcttatctataagttaggactaatagtacttacctcacaggattgttgtgagaattaaaagatactgtaggttaaatgactaccacaatatctgtcatattatgggcttttaatgttatttcctgcccctcaccttaccttgagtttcacaactagtaattgatagagcatctatcccttgttcattcttcaggttcctgcttaagtatcttttccccagggagacctctgattgcctcattgtacactaggtgtctggatacattctctatatagtttatcttcaaagtattgtgtacactgataattatctatttaaatatttatctcgtgtctttcatctctgtaaactggccagaaggtcagagatcaggtctcttttatgtaccaccgtattcctagctcctagcacgttcctgatatatagtagataataaaaatgtattaacctagaatccaggtctggtttgctagtttagtattgtcattgtaaaattgtttctggctgggcacggtggctcatgcctataatcccaacactttgggaggccaagacaggcagatcacttgaggtcaggagttcgagaccagcctggccaacacagtctctactaaaaatagaaaaacagttgagcatggtggtgcaagcttataatcccagctacttgggaggctgaggcatgagaattgcttgaaccctggaggcagaggttgcagtgagccgagatcgtgccactgtactctagcctgggcaacagagtgagactccgtctccaaaaaataaaataaaattgcttctacaacaaccacatacgttagaggtaattctctatgtgataaagtataataaaaactttttaaaatgtgctgcatttggcctgttatatgccacagagtttgaatttctaatattctttctatggtttagttgtggttgaggatagtgcagataactactctgtgaggtacaacactgtcttaatagctcttgagttttaaaggaaaaccaaatttacttttgttttccagataatataagcaaggaaaactgtgttttcagaagctcactgattggcatagtttgtggtgttttctatcccagttctttggcttttactaaaaatggacgcctggcaaccaagtaagttcttccttttccttcttttttcttttcttttcttttcttttttttttttttttttaggttaataaactctctttcttctttagctgtctatgatatatttgaatcaaaatgtggtagtttggtatttcagatagctaacttttaacttttttgctctctacattatagatctagaaaggcaattatcaatttaggagaagtcaacaaacttctaatagcattcatatccaggagaggtgattaactcttttttctttttaggtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtttcatctttcctctttgtatgtggaa

SEQ ID NO: 8521 - DNA, 3464 bp, Homo sapiens
caccaaaatggtggtgttcgggtatgaggctgggactaagccaagggattcaggtgtggtgccggtggaactgaggaagcgcccaagtaggcggaatccgaagtgctatgcggggtaatttctgcaccttcaaagtgttagctgactcttctaagatgatacctttaaaggagatttgaaaagttaaaacagctcccaagtccatgcaaggagcagtcgattaagtctccagttgctgtggaaagaggcggagagaacgtagatgacctaaattctagtcctcattatctgcagtttgttttctcttgtctccaggcctttgcacaggctttttcttcaacttggagtatttccctgcttctatccgtcccaactcccctgccaaactgttctctttcggttattgatttaaatgtcacttcttccgggaagccttcccacgcttcctctggctagattgtttgctttttcttaggttgttgggtttttcgtttatgtcactctctcattctgtgtttaaattgccagcttttttgttctgaactcccactgcgttgtggattcctgaggatgggatgactgtatcttgattacccggaggtctggcatataccacgtgctccctaaattatgagcgaatgttgaataaaattctaaaggtgaaatttattattaggtgaaaaatttattattaggtaaaataatacacatgaaagcactacaaaaccgttagatgatttgcaaactataaacctacataaatgcactcttactggtataagcgtggtgactagttgagtggccttaagggggaaggggtgtaatgaaagcactggagtctttgacagtgccttgcaaagcttaagcactcaaatatttcctgtgttctttccagtatttcagtatttgctgtcctgtaatcataatcctgggtgtctgttttccctatagagactttagggtgtagactaggtaggagattagtagaagatattgcctggaagtttgttttgttttttgtttttggtggaaggtggaggatttcaatgaattggatgatagcaaaacaaaaatttatctatggtttatggttactcatgttattgacgtctgccaagacagcagatgtcttagtacaatagatgggttaggtatagaatctcccttagatgttactatcccttatactttccatttgggtgtcagggagagggaaaagatgtaagtctagtcactgaaaaattgtaatttgtaaaatattttacctttttttccccctgccctctccagaaatgttacagaaaaagattgagtacatttctgccatgatgcagagaaagaaactggtccattattactcattgtgtaacaccataagaaggttcaaaggagctcataccttctgtatgttgatgccaggaactgtgtataatgaactggccttctatagttaggattggtacataccgctcattcagcaaatgagtattacagtgatattcaacatgtgtccattgactacagcatcagaagcactaagtgctattaaaatgcagattctaggcctcatcctactcctgctgaatccaggtatctcaggagggaattcatgagactgcatttcaaataaataccccatgtgattcttgtgcatgctgaaggttgagaaccactgatttattaagtatcttgtgtgttcattatgctttatcccctctaatcctcttgtctaggactccttaaatttgagatttagtatttccctttaatataaacattaaaattgagattagtgtaaatttgtaaagagactatttagctaatctggaggaaaaagagtaaaaagcactgaatttagcagcaatagaccttccacttggctgctgtagtaggtaaacatttgcaaccacgtgtttggatttaacaaatgttattaagacttttcacagagactctagagtcttgcccagagcaaaacattcagaaacgatcctctctgagagtgcagggtttgtttttttgttgttgttgtttagttttgtattttaacctgtctagtttctgttaagatgctactggccaggtcttcatggtcccttgacattggcagctgtctgttcatcacacttgggacacaagaaccttccgaccaaggagcccagtgccatgggtctctggggccgggcacggtggctcacgcctttaatcccagcactttgggaggctgaggcaggtggatcacctgaggtcaggagttcgagaccagcctggctatcatagtgcaatcctgcctctactaaaaatacaaaaattagccgggtgtggtggcaggtatgggtctctgctataccacatgaccatttctagcaaaggctctgcttccaccacaggtggtaatagggaactggatatataatttatgtactccaaagtagtagccacaatccactgcctgttcccttcctggagcagtgtccctctttctgatttttctctctcactattctccaaggcaatccctgctctctcctacctctctaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagtatgttagccttctacactaaatctcaagcaagccaacctttcagaccttcagtttgctcatatgtatagaaataatcattatactaccaatttctcaagttagtgtgtaaatcagaaagccaatgtctgtattgtaggatgtttagcaagaaaataaaaaataataacaaaaagccaatgtctaacagataataagagctcagtaaatgttgattgaattactaacaaagtatgtgaaagcagacgacacagtacctggcacactactaaactgtaaatgttttcaaatctgaatctgtagaattctgtaaggttttatgtaatatgaatatcattagctattatggctctggaatttttttttccaggttttcaagatggcagcatctatgcatggtcagcccagtccttctctagaagatgcaaaactcagaagaccaatggtcatagaaatcatagaaaaaaattttgactatcttagaaaagaaatgtaagagaaatgcccaggctgaaaatcagtcattttatttgcaagtcttttgtattgccattgtttctaagatcctattctttcttaccttttctgttatctaagatcctattctttgagttggctatgaagaacacatctttaaaaaaaagaatgggggaaacaagaacagatgaaaatggtggtttgttggaatatttcggattgtggataatttcttttgtttcttaaaaagtatccaaaagtattgctaaaactt

SEQ ID NO: 8522 - DNA, 7948 bp, Homo sapiens
aagtcacatgagccaccaaaatggtggtgttcgggtatgaggctgggactaagccaagggattcaggtgtggtgccggtgggaactgaggaagcgcccaaggtaggcggaaatccgaagtggtatggggggtgatttctgcaccttcaaagtgttggcagactcttctaagatgatacctttaaaggagatttgaaaagttaaaacagctcccaagtccatgcaaggagcagtcgattaagtctccagttgctgtggaaagaggcggagagaacgtagatgacctaaattctagtcctcattatctgcagtttgttttctcttgtctccaggcctttgcacaggctttttcttcaacttggagtatttccctgcttctatccgtcccaactcccctgccaaactgttctctttcggttattgatttaaatgtcacttcttccgggaagccttcccacgcttcctctggctagattgtttgctttttcttaggttgttgggtttttcgtttatgtcactctctcattctgtgtttaaattgccagcttttttgttctgaactcccactgcgttgtggattcctgaggatgggatgactgtatcttgattacccggaggtctggcatataccacgtgctccctaaattatgagcgaatgttgaataaaattctaaaggtgaaatttattattaggtgaaaaatttattattaggtaaaataatacacatgaaagcactacaaaaccgttagatgatttgcaaactataaacctacataaatgcactcttactggtataagcgtggtgactagttgagtggccttaagggggaaggggtgtaatgaaagcactggagtctttgacagtgccttgcaaagcttaagcactcaaatatttcctgtgttctttccagtatttcagtatttgctgtcctgtaatcataatcctgggtgtctgttttccctatagagactttagggtgtagactaggtaggagattagtagaagatattgcctggaagtttgttttgttttttgtttttggtggaaggtggaggatttcaatgaattggatgagagcaaaacaaaaatttatctatggtttatggttactcatgttattgacgtctgccaagacagcagatgtcttagtacaatagatgggttaggtatagaatctcccttagatgttactatcccttatactttccatttgggtgtcagggagagggaaaagatgtaagtctagtcactgaaaaattgtaatttgtaaaatattttacctttttttccccctgccctctccagaaatgttacagaaaaagattgagtacatttctgccatgatgcagagaaagaaactggtccattattactcattgtgtaacaccataagaaggttcaaaggagctcataccttctgtatgttgatgccaggaactgtgtataatgaactggccttctatagttaggattggtacataccgctcattcagcaaatgagtattacagtgatattcaacatgtgtccattgactacagcatcagaagcactaagtgctattaaaatgcagattctaggcctcatcctactcctgctgaatccaggtatctcaggagggaattcatgagactgcatttcaaataaataccccatgtgattcttgtgcatgctgaaggttgagaaccactgatttattaagtatcttgtgtgttcattatgctttatcccctctaatcctcttgtctaggactccttaaatttgagatttagtatttccctttaatataaacattaaaattgagattagtgtaaatttgtaaagagactatttagctaatctggaggaaaaagagtaaaaagcactgaatttagcagcaatagaccttccacttggctgctgtagtaggtaaacatttgcaaccacgtgtttggatttaacaaatgttattaagacttttcacagagactctagagtcttgcccagagcaaaacattcagaaacgatcctctctgagagtgcagggtttgtttttttgttgttgttgttttgttttgttttttaacctgtctagtttctgttaagatgctactggccaggtcttcatggtcccttgacattggcagctgtctgttcatcacacttgggacacaagaaccttccgaccaaggagcccagtgccatgggtctctggggccgggcacggtggctcacgcctttaatcccagcactttgggaggctgaggcaggtggatcacctgaggtcaggagttcgagaccagcctggctatcatagtgcaatcctgcctctactaaaaatacaaaaattagccgggtgtggtggcaggtatgggtctctgctataccacatgaccatttctagcaaaggctctgcttccaccacaggtggtaatagggaactggatatataatttatgtactccaaagtagtagccacaatccactgcctgttcccttcctggagcagtgtccctctttctgatttttctctctcactattctccaaggcaatccctgctctctcctacctctctaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagtatgttagccttctacactaaatctcaagcaagccaacctttcagaccttcagtttgctcatatgtatagaaataatcattatactaccaatttctcaagttagtgtgtaaatcagaaagccaatgtctgtattgtaggatgtttagcaagaaaataaaaaataataacaaaaagccaatgtctaacagataataagagctcagtaaatgttgattgaattactaacaaagtatgtgaaagcagacgacacagtacctggcacactactaaactgtaaatgttttcaaatctgaatctgtagaattctgtaaggttttatgtaatatgaatatcattagctattatggctctggaatttttttttccaggttttcaagatggcagcatctatgcatggtcagcccagtccttctctagaagatgcaaaactcagaagaccaatggtcatagaaatcatagaaaaaaattttgactatcttagaaaagaaatgtaagagaaatgcccaggctgaaaatcagtcattttatttgcaagtcttttgtattgccattgtttctaagatcctattctttcttaccttttctgttatctaagatcctattctttgagttggctatgaagaacacatctttaaaaaaaagaatgggggaaacaagaacagatgaaaatggtggtttgttggaatatttcggattgtggataatttcttttgtttcttaaaaagtatccaaaagtattgctaaaacttttgtgcagtaaatgtattttaattaaaagtaattaggagaaaaccattgaggggggtacttatatttaattggtgagtaattataatcagtttacgattgattatctcagccacagtacttattacagcaaaagggaatacagatttcatggtataaatatagtctcacattaacatattgacttttttttttgagataagagtctcactctgtcacccatgctggagtgcagtggcacaatctcggctcactgcaatctccagctcccaagttcaagtgattctcctgcctcatcctcccaagtagctgggattacaggcgtgtaccaccacaaccagctaatttttgtatttttagtagagatggtttaaccatgttggccagactggccattttgacttttaaatgaacaaagttcaagaaaaaaatcaaaggacagttgatgttatttcctggatttacatatgggtcttaataagaaaactaaatcagatttttttggatgaagttttataaatcttggacaaattattttattttattttattttatttcattttctgttttatggctttattgaagtataatttatatatcttgacattcatccatttaaagtgtacagttatatgagttttagcaaatttatacagttatgtaaccatcaccacaattaaaatttggaatacttccaacatccccaaaaagttccctcattcccttttatttttttttattttattattattatactttaagttttagggtacatgtgcacaatgtgcaggttagttacatatgtatacatgtgccatgctggtgtgctgcacccattaactcatcatttagcattaggtagatctcctaaagctatccctcccctctcctcccaccccacaacagtccccagagtgtgatgttccccttcctgtgtccatgtgttctcattgttcatttcccacctatgagtgagaatatgcggtgtttggttttttgttcttgcaatagtttactgagaatgatgatttccaacttcatccatgtccctacaaaggacatgaactcatcattttttatggctgcatagtattccatggtgtatatgtgccacattttcttaatccagtctatcattgctggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgtgacactgacttccacaatggttgaactagtttacagtcccaccaacagtgtaaaagtgttcctatttctccacatcctctccagcacctgttgtttcctgactttttaatgattgccattctaattcatgtgagatggtatctcattgtggttttgatttgcatttctctgatggccagtgatggtgagcattttttcatgtgttttttggctgcataaatgtcttcttttgagaagtgtctgttcaggacaaattattttaaatgtatctgggactaatgaagaaatagaaggcctaaccaaatgtaaacagcttttttttagatgaacttaagcaaagtaaatcttttagttgcaggaaaggtattcttggatttgggtagctcataaaatttggctgcattggaacatatttatatttatttgtggccaaaattatttaaaagagctctattttagaattactgtaaatattcttagaaagagaatcatgtcctctcattagaatacaagttctatgaggggtgggaaatttctttttttcttttgctttgtttactgtcctatcttaagcacttagaaaatacttttcacatatagtaagtgctcaagaaatatttgatattgatatgcaataacaacttttcaggagaggctgtatccattaagttcaatggtatagtgaactgaatttttctttttttctattaggacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcaggtgaatttaaattcactaatgtataacgtagttatgtctaagtaaagttacttattaacatatactgttgctactgctaataataattctttacatttatatattgctatacagtttacaaagtccatataccttgtcatatttaatccctgcaacaatcctcctaatcaggtaaactgtatttttttatttctgtagataagcaacccaaactgaggcatgttcaagtacgctaataagcaacatactgggaaaagaattggctgtggcatacaacgcacatcatttcagtatgctacctcctgccacttaagttttgtgacattcagtaaggcatttcatctctgagcctccgttgtcttatctataagttaggactaatagtacttacctcacaggattgttgtgagaattaaaagatactgtaggttaaatgactaccacaatatctgtcatattatgggcttttaatgttatttcctgcccctcaccttaccttgagtttcacaactagtaattgatagagcatctatcccttgttcattcttcaggttcctgcttaagtatcttttccccagggagacctctgattgcctcattgtacactaggtgtctggatacattctctatatagtttatcttcaaagtattgtgtacactgataattatctatttaaatatttatctcgtgtctttcatctctgtaaactggccagaaggtcagagatcaggtctcttttatgtaccaccgtattcctagctcctagcacgttcctgatatatagtagataataaaaatgtattaacctagaatccaggtctggtttgctagtttagtattgtcattgtaaaattgtttctggctgggcacggtggctcatgcctataatcccaacactttgggaggccaagacaggcagatcacttgaggtcaggagttcgagaccagcctggccaacacagtctctactaaaaatagaaaaacagttgagcatggtggtgcaagcttataatcccagctacttgggaggctgaggcatgagaattgcttgaaccctggaggcagaggttgcagtgagccgagatcgtgccactgtactctagcctgggcaacagagtgagactccgtctccaaaaaataaaataaaattgcttctacaacaaccacatacgttagaggtaattctctatgtgataaagtataataaaaactttttaaaatgtgctgcatttggcctgttatatgccacagagtttgaatttctaatattctttctatggtttagttgtggttgaggatagtgcagataactactctgtgaggtacaacactgtcttaatagctcttgagttttaaaggaaaaccaaatttacttttgttttccagataatataagcaaggaaaactgtgttttcagaagctcactgattggcatagtttgtggtgttttctatcccagttctttggcttttactaaaaatggacgcctggcaaccaagtaagttcttccttttccttcttttttcttttcttttcttttcttttttttttttttttttaggttaataaactctctttcttctttagctgtctatgatatatttgaatcaaaatgtggtagtttggtatttcagatagctaacttttaacttttttgctctctacattatagatctagaaaggcaattatcaatttaggagaagtcaacaaacttctaatagcattcatatccaggagaggtgattaactcttttttctttttaggtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtttcatctttcctctttgtatgtggaa

SEQ ID NO: 8523 - DNA, 1022 bp, Homo sapiens
tcttttcaggtctcagtttgatccagctggattgaggccaagagccaggtaactgttgcaaaccacttcagtgttcagttttgaaatccaggctgagtcttctatgtcagacaaagaaaataatgatgtattttttccacaactaaactttttacaccgcccacagagtttacagcaacgtaattttttagtttttcaagtttttcaattttcagaaaatatttagactgtttttacaaactgggaaaattattgtaaacatgaagaacgttactgaaattcctcttcaggcagcaacatttttggaagttcaatgactaactcaattaaggcacaaaccaaatttagacaggtctcattactttatacatggtcaaattcaaagatgatgataaagatactcaaatctgtagagaaaaatgtaaccccacctccccaaaaatacttttaaaaatctctttgactccagtctctaaaaagataggtgagtttgaacagttttctgtggcagaacacacattgaaaggcccccttatatttactgatcagaagttccggatctcaccccctcagtaactcagaatccagcttgctgtccctttcatttttttcttctgtgctctccaagcccccaggcttgatccttaatgcccctctgattctgatcctcccatgtattaaccgagaggattgaaaaaaaaggaaagcaatcccttggcatggagacattaaagtgacagtgctactcaatgggcacttgatgcaggatgagttggcgaagcagatttcttcacactggagtcattcacatcatgccatctcttcgcattcaagcagctccctatccggcgaggaaaaacactgagacttcgagagaagccaaaccttcccccaaaggtgttttcagagacgccgtagtagtattagacatgtaagcataagctatgtaaacggtccgcgatttcctaaatgagaaagtgcagctgcttggctttcacatccaccttttctctcaatctctc

SEQ ID NO: 8524 - DNA, 2635 bp, Homo sapiens
ctctttctctgtctctcctccttcccattctctcttcctttcactcttttcctctctgtctctctctctctcacacacacacgtaatgtgtttaattccattattagttcaaaataaggtaatccaaaagaaactctctagagaaatggtagaaagaataaaaacacacatcaacttaaatatgtcaaagagccatatcatttattggctacattcccaaaaccattcttgttctagataaaccaattgtgtctggtctggacaagtgtggctccaaaatctcaggcagtttacttctgtcagtggtattattagaaacagcagggggaggaaacaatcccaatcttaaatcccagtgtgcaaatatcacagttctaggtgttccaaaagttttatatatcattgtccatctctacaaatatcagcttggataaggcatctcagtgattataagtttcctcaacatccctaacaaatccacaggtagaagaattaaacaccatgcagagataagttccactttaacctgcaattcacccagagctttagtttcagattgtagcaactcacataactggacaacatttggatctatattagtccagtatagcagagttcaaggctgttcatataagttttgattcaaaactcttgagaaactctttacagttgatctcaccttccatataatgtcaaaacaaaacaaaacaaaaacagtcccaaactaggatcctttggaacaaagttaacctggggtgcatctaagctaaactgaatccccaagttcagaatataatcaactatgcttcaggaattcactagatcttgatcaattccaataataaaagttgttgaggagggaggaaaaaaacaggtgtttgccccatttggggaacttgacaatcatgttattggataatgcatatatctggaaaagcacaatagtcacgaaagttgtgctttatcacaaaagtgaagatttacactagaataaatccaaataataagtctattttttaaccaaaagataaattataaagctgtaattttgttcagtgcaaatgaaattactttgctacctttcacaattctgtaattagtttgataaatattaaacccatgaggaagagctccactgcacaagtttcttttttaaagactgcttaaaagtaaccttcaacaagctaagaaaacaagctaaaggagactccaaatctgcggtactgaatctattcttattaccaacggtgatataaacaacctgatttatgaaatcataaatatctatcaataaatactatagtcttgcttccttttactttagtaaaataatattactgaattatgtaccactgaaactatattacaataaatatttcccccaaactgaagcaaaactttactctcaaatggaatataatttaaattacaagtaccagaaccaacaaaagggagaaatattatatagcaaccttatggcccacctgtcttcttgactggcattcttgggtctttccactgccacaggagtcaatatctcttttcaggtctcagtttgatccagctggattgaggccaagagccaggtaactgttgcaaaccacttcagtgttcagttttgaaatccaggctgagtcttctatgtcagacaaagaaaataatgatgtattttttccacaactaaactttttacaccgcccacagagtttacagcaacgtaattttttagtttttcaagtttttcaattttcagaaaatatttagactgtttttacaaactgggaaaattattgtaaacatgaagaacgttactgaaattcctcttcaggcagcaacatttttggaagttcaatgactaactcaattaaggcacaaaccaaatttagacaggtctcattactttatacatggtcaaattcaaagatgatgataaagatactcaaatctgtagagaaaaatgtaaccccacctccccaaaaatacttttaaaaatctctttgactccagtctctaaaaagataggtgagtttgaacagttttctgtggcagaacacacattgaaaggcccccttatatttactgatcagaagttccggatctcaccccctcagtaactcagaatccagcttgctgtccctttcatttttttcttctgtgctctccaagcccccaggcttgatccttaatgcccctctgattctgatcctcccatgtattaaccgagaggattgaaaaaaaaggaaagcaatcccttggcatggagacattaaagtgacagtgctactcaatgggcacttgatgcaggatgagttggcgaagcagatttcttcacactggagtcattcacatcatgccatctcttcgcattcaagcagctccctatccggcgaggaaaaacactgagacttcgagagaagccaaaccttcccccaaaggtgttttcagagacgccgtagtagtattagacatgtaagcataagctatgtaaacggtccgcgatttcctaaatgagaaagtgcagctgcttggctttcacatccaccttttctctcaatctctcttcaaactacccaccttccttttgcagaaaagacaagacatttctttgccaccgctggccacccctgcccaagcc

SEQ ID NO: 8525 - DNA, 1576 bp, Homo sapiens
ttagcttttaaaatgtatttttgtttttacttaagagttttaaaaagtagtcatattttaaatttacatattgttgggaaaattctgccaatggtaggataaaacaatagatttcaattgaaatattgaaagcaacttgtgttggtaaaagatgagaagtgaaggtggaagactgattaaaactaccaaaaatatcatagtgataacacttttatttttctttttttgtgggggtggggatagtaccattataaaaatacaaacataagctgcttttgtacatcaccaaataattcattgaaatttaaggaaatcaaccagttatgtgtgtacacacacacacacacacacacacacgatctcatagagtgaagggttaattggaatactgactgagtgcaatgtacaagaaaatgtacacactgaatacaaacaagggaaaaaaatcaactttgcctaggagaataataaatataattataggaaggaggggggacagggtaggtgttaaaaaggagtttcctgggaaaataaggaagtgaagaaaggcattccaggcataaaatatgcttgctatgtgcaaaacaacagtgggaaatagcatagactcttccatgtacatactgcaagtgggtatgtgatggtggagctacagttggaaaggtaggtaggggtcgtatcatctagcccgatttactagagtttaactttatttactcatgaataggtagatcttgacagattttaatgaggggagggacatcaggtgccaagtacctacaaacatttaaacaagggaagggttttatggttgcagtgattaggacacgtttgaggaatatttagacaattaagttagtggaacttatatttttataggatgtaaatgaaggggcacagggaagccaccgaaggtgatttctgagattctgttttgcataacttggtacatgatatgccacagacataaaggggaaatgctttcaaagagatctgtgtttttctcaaattttacccaatatatttgcataaagctcaatgtagattggaactatggcaatttgattcagttccacagcttaagtaagtgttattttgttcagttaattgaaaatgaaactatacctgacaggaagctgattacttatatgctaatgtgacagtattatagatcataggacttataacacctattaatttggtaaatgggaaaaacaaaactgtatactgtgaaataagaatttacgttatgtatataagaaatagttgatttaggctgggtgtggtggctcacacctgtaatcccagcactttgggcagccaaggcagctggatcacctgaagtcaggagtttgagaccaacccggccaacatggcagaaccccgtctctactaaaactacaaaaattagccagatgtggtggtgtgtacctgtcgtcccagctacttgggaaactgaggcaggagaatcacttgaacccaggaggcagaggttgcagtaagcccaaatcgcaccactacattccagcactatactccagcctaggccacagagtgagactgtctagaaaaaaaa

SEQ ID NO: 8526 - DNA, 3120 bp, Homo sapiens
  misc_feature (887)..(887): n equals a,t,g, or c
aaaagcacatgtagaccccgcccctgcagagatagcccagggtgggggtggggggtcgcaccagtccttctgtcctatttttttagagatatctactctgaagcctttgtaggggcctgggtacctttgggagcctgagctggaactgaagctgagcctgcagcctgggccttggtttgttctttgggcttggccttggcctttggccggcacagcctgagccccttggcaatacgggcaagagcacgcttcccaagcttggggtgggcaacgtaggcatgtcgatcgagcttgcagctgactccctttgggatcttgggcttaacctccttgggctttacgagggccttgatagcctcggcacgtgcactcatggccttggcattgttggcctgcatcttctttaggccctttttgttgtgcttcttggcaaagcgcatgttcctcaggaacttggggtccacccccttaagagattcgtatctttgtgatcggggtttcttgataccatttctgtgccattttcgggactggttgtgtgtggtgtggttcttggacttggccatgtctgcaccataagccgcggctcccgaagtgcctagaaccggaagagctgattttaggtatttcttgccttctgctagcttttgaatgtgtttgctcttgcttttctagttcttttaattgtgatgttagggtgtcaattttggatctttcctgctttctcttgtgggcatatagtgctataaatttccctctacacactgctttgaatgtgtcccagagattctggtctgttgtgtctttgttctcattggtttcaaagaacatctttatttctgccttcatttccttatgtatccagtagtcattcaggagcaggttgntcagtttccatgtagttgagtggttttgagtgagtttctgaatcctgagttctagttggattgcactgtggtctgagagatagtttgttataatttctgatcttttacatttgctgaggacagctttacttccaagtatgtggtcaattttggaataggtgtggtgtggtgctgaaaaaaatgtatattctgttgatttggggtggagagttctttagatgtctattaggtccacttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagaataggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttgtgtgtgaatttgatcctgtcattatgatgttagctggttattttgctcgttagttgatgcagtttcttcctagccttgatggtctttacaatttggtatgattttgcagtggctggtaccggttgttcctttccatgtttagtacttccttcaggagctgttttagggcaggcctggtggtgacaaaatctctcagcatttgcttgtctgtaaaggattttctttctccttcagttatgaagcttagcttggctggatatgaaattctgggttgaaaattcttttctttaagaatgttgaatattggcccccactctcttccggcttgtagagtttctgctgagagatccactgttagtctgatgggcttccctttgtgggtaacctgacatttctctctggctgcccttaacattttttccttcatttcaactttggtgaatctgacagttatgtgtcttggagttgctcttctcgaggagtatctttgtggcgttctctgtatttcctgaatctgaatgttggcctgccttgctagatgggggaagttctcctggataatatcctgcagagtgttttccaacttggttccattctcccagtcactttcaggtacaccaatcagacgtagatttgatcttttcacatagtcccatatttcttggaggctttgtttgtttctttttattcttttttctctaaacttcccttcttgcttcatttcattcatttcatcttccatcactgataccctttcttccagttgatcgcatcagctgctgaggcttctgcattcttcacgtagttctcgagccttggctttcagctccatcagctcctttaagcacttctctgtattggttattctagttatacattcatctaaatttttttcaaagtttttaacttctttgcctttggtttgaatttcctcctgtagctcggagtagtttgatcgtctgaagccttcttctctcaactcgtcaaagtcattctccgtccagctttgtttcgttgctggtgaggaactgtgttcctttggaggaggagaggcactctgctttttagagtttccagtttttctgctctgttttttccccatctttgtggttttatctactttgatgatggtgatgtacagatgggtttttggtgtggatgtcctttctgtttgttagttttccttctaacacacaggaccctcagctgcaggtctgttggagtttgctagaggtccactccagacccctgtgtgcctgggtatcagcagctgtggctgcagaacagcagattttcatgaaccgcgaatgctgctgtctgattgttcctctggaagttttgtctcagaggagaggccggccgtgtgtaggtgtcagtctgcccctactggggggtgcctcccagttaggctgctcagggatcaggggtcagggacccacttgaggaggcagtctgcccgttctcagatctccagctgcatgctgggagaagcactgct

SEQ ID NO: 8527 - DNA, 1865 bp, Homo sapiens
  misc_feature (1168)..(1168): n equals a,t,g, or c
tccccaggatcatagacagaggctaacaaatcctgcctcaggtttatttgtacaaatagcacaggaggaccccagccccatgcagatggtagcccaggggcgggggtggggggtcgcaccagtccttctgtcctcatgttggcagagatatctactctgaagcctttgtaggggcctgggtacgtttgggagcctgagctggaactgaagctggggctgcagcctgggccttggtttgatccttggccttggccttggcctttggccggcacagcctgagccccttggcaatacgggcacgagcacgcttcccaagcttggggtgggcaatgtaggcaagtcgatcgagcttgcggctgacaccctttgggatcttgggcttaacctccttgggctttacgagggccttgatagcctcggcacgtgcactcatggccttggcattgttggcctgcatcttctttaggccctttttgttgtgcttcttggcaaagcgcatgttcctcaggaacttggggtccacctgaaaagcaggaaaggtacaggtggcagcatgtgggtccccaagtctctccctgctgcccctctccataggggtacccagcattctaaagacagcatcaagtcaacctcaaatgtggaaatacccaacctcttgaaactatttccagagaaagtgtaccaccaccccagggagccaatacgccacctgggtaatgctgtgcagacctccttcaagaacaaaattacaagctgctttgctgccctgtctgccaaggttgtggggcttcaacttcctacagcaggggttcgaccaagttttttcctgacatcccctcagggacaccccctcccctctttagaaggtgtcaattaaataccaagtctggtccaaaagacttatagccaaggtgggatatggggaaactgaggctcagagtttgtgattcactccacggaacagagagcaaaagtaaagggaaggaacagactggggacatgctcagctctcccctagaccctccagccttctcagctaatccttagaaccccctgacacaggaagagaagctgaccccaactccagcactgggtcagatggaggtcataaggctggtcagtgtgggaatgtgccctgcacgcactcagacaaggccactccttaccntaagtgccactgccaagcaagggagatagccaaactgccctcaggaggcaggttacaccctgaccagagggttacacttcaggctgtggagaccaaggaaagctttattatgggtctggtagggtagaaaaaggaattgcaggctttgggtgggccagttaggctgtgctcaggcagaagccaaagctagagaaaaactacatgagaggccttgactgtgcacctggaaccaagaaaagacacttccatgtgattcagtgcactcacccccttaagagattcgtatctttgtgatcggggtttcttgataccatttctgtgccattttcgggctgtgggagaaaaaaagggaattaagccaacaaagaactttcctctaataagaccacccaacatcacagctggcaagtctgggagaaccaacacttcctacagcagctacacttgagatatgggaaacccttactactaaatgcaaaacactctgtatctcaagtagatctctaaacctataaaccctaaagttattactgggtgaaatcaatcagcctcaggcccacaatggaaacgtgccccttcatctctgtcccagtttgcctgaaccagtccttgccagggtctgggatgtaggcagggcccaaaaaacttacactggttgtgtgtggtgtggttcttggacttggccatgtctgcacct

SEQ ID NO: 8528 - DNA, 286 bp, Homo sapiens
tcacgcctgtaatcccagcactttgggaggccgaggcaggcagatcacaaggtcaggagatcaagaccatcctggctaacacagtgaaaccccatctctactaaaaatacaaaaacaaaattagccgggtgtagtggcaggcacctgtagtcccagctacttgggaggctgaggcaggagaatggtgtgaacccgggaggcggagcttgcagtgagccgagatggcaccactgcactccagcctgggtgacagagcacgattctgtctcaaaaaaaaaaaaaaaaa

SEQ ID NO: 8529 - DNA, 7422 bp, Homo sapiens
tgaattgacagtcccaactgtagttgtactgaatacttcaaaccagcaatatttcttgctagatagacagattaagaatgttgaagacatggtccagtttattaataacattttggatggcacagtagaagtaagttgttcacttctgtttcaaagagatgatggacagggggtagaggagaaactagttcatttctttacttgtgattctgaaaagaatcgttggccatcacccggagtagagggctggacctccatacattgcttctgtccaattataggcagagtagaggtacattctcccagatacagaaggttcttctgtggcagaggttgctaaagatggaagtgtccttttatgggttatttggagggtatttttggttgtcatggtgatggggaggggctgttggctaaggttgaggcttagggatgctaggaagtctgcactgtgtggggtaatcttaatagtgaacttgcctgtctcttagtatgtttctaggtccaaaagtacaattggattaagtcgttaggattggttttctaagaaaatctgcaaataagatgacaatttctcaagaaatgaggaaatttattgagagtaaaagcccccgtggagagttctagacttaatcctataaaatatttctcagaaataagtgaatagtcttaattttctatttttttcctataaattttaactgcagtgtttttcaaactgtgaattgcaacctatattagaaagtcatgaaaccaccgcaagtcacaatcaggttgtgaccagcatgcatcttaattcaatagactaggataaaatttaaaagaaagcgccttcattgcttttgtgaaatgtaattactagtttttgagagttgtttcagttttacacaaactttatttaaaatttgcttacagagtaacaaacataactactttcggtcaaggtgaagaagtttgaaaaacagtcaaatagttaagaatatttttgaaaataatttgttgaaatgaaactctcacctatataaataatcagccttctatttttaagttagtggaatgcaactcagactatttaacaacagattttattgtctcatagagcttggaaatttaaaaaatgagccagattgcaggtatggccgaatataggatttgagtgattttcatcaggaatttttcactctcttcccttcagcactttcatcctcagggaagctctccctgcacagtagcaaaggtatcctgcagcagctctggttttgcggtcccagctaaactcaaaagctggttaggctgtactcagaggtgggtcagcttcagccaagctgtgtgggttatgaatagaggaggaggaattgtttagagtagaatcagggtgaattaacacaagcaggcaggaggaatgctggacatgacacagacaaaaaacaacacagtaaatgtttaccacatggccttttcaggtgattatgtaatattttggagtcaaccatttggcctgcaattgtaaggttatgtaacaccaagtaaatgaagtaatggtgcttaaataatttatttttcttttccttttttgaaggcccaaggaggtgatagcattttgcagagattgaaaagaatagtatttgatgccaaatctactattgtggtaagttgtgacagtttatgtcattgataatgaagaagatataggttctttatgtctagctgtgttaaaaatctgaatttgaaaagattaggtcaaaatatgtctttttaatttgcaggatatgactagtcagtatttaagaaaatatattcattaggtggaaattgtttctaattgtttatatgattgatgagttaaaactaaaattcagaatcaattaacttgatagtataatttaaaagattttatttctgcaacctgccatgtaaagtttttacttagtaatttctatgatttgttgaaagtgcagataatatgaaatttttagttccattacgtgctgtcttctgtaaattggtcatttttgttaaagaaaatgatgtgtgctgggaagtcactttttattttgcaggagtcaaaataaaattttagatcttacaattttaaacatccctgttaattctgtacttttccctagttggtaaataattaagatcatttacagatgtttttccttcttccctttttctctccttccttttttttttcttttattctttttatagaacactttaaatgtggaattaaaatgtgatggatcacatcctttctaacagtgtttactttcatttgtttgtcccagtgtttattcacagttgttatatgtaagtagaatatcaacagtggtagacgaattgacatgtctgcccctaattacccgtctctcttgtttttataattatactttctaaatatatttccttgactttcttcactgtcacctctcacctgattatttctgctattctaatttcctcttcctttcactctatcaaactaatgctcactctgtcaaactaattagatctgttgtatttcccctggatttctttgaagcatcctttccttgacattctcctttccgtgctgctgtgagtatcactactcccctgctcctgccccatctcttcagtgtttttcagcatccctttcctccctttcccctttgcagtccctgggtctgaaccttctcgcttgacactcttacgaaattgttctccctctcccagctttaactgtcaatcaacttgacagcagaggaattcttaaatttgtttgagccctaaacttagttcctgttgtccttctcgagctcttacatgggcattttcattcactgtggcccaaagcaatcataaaaatatagctaacattttttggttagaagtaaattctgggactctttgtttttttccttgcatagtattcttcagtttgctttactttcctgttgccacgagcatggattaggccctaatcacattctgtctagctgctggtctctttcacctggtttccatacttccacttgcccagtctccaatctatattatattccactacacagttaatattactaaaataatcgattttgatcactttccttcccttttccagggacatcagaatactctgtccatctaaagtattttcctcattggtttttgaatattagcttttgctagtgcaaattgcctggtgctcacttgtcccatatcctgcctccttctcactcatccttaaattcctacctaaaacacacctttattctgtgaaactttcttttattatctcaatccaaagtgatctttttcttctctgaacttctctatgttctcaagagttatcgttgcaattcatgcagtatattctagttgaaaaccctattcattaaaattacttttactttcctgggagctatgaagacagtatgtaaattgagggaaattagtaagtcaatgaagttttactactaaccagataagtaaaaaatattaaaaatgtcatgtgaaaagagtatgtgtgtaccttctttgtggtaaataacccagccttctccataagcagattcctgtagttcaggaagcaactctaaagctgctgggcgcacatagtaagcaccttaaagagacctttgtggttaatgtagaaaaatcagtgtctttaggaaaggctgtagaatatttgatgcctttttctgttgctaatagctggttctgcacacacatgcttatgtatgtgcatatagaaattatatctcttaacagtgtctttcacatggtagttactgctgaaatgattgattcattggaactaaaaacaagctgaatagcaacaagagaaatctatagtggtttcaagttcatttcatgctatatatatcagaattacatgtgaagggaactgagttttaattctctttccacagtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattgaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattgtcataaaattttcatatatgcctagataatggggaaaaaaagtcttctgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactcttttttttaaagtaacagtttggtatgtttattgtagataaattattttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccatactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcagcctagtaaggaagtgaaaacttagcagtcagtgacatggggaaatagttatagaaaatgtcactgaattttttcatatttataattagtcatttacatatttttgtcttgttgatcattacctgtaaatgaaagaccttaataggaaaaaaagagtaaagctcagtgtgaatgcaaacatccacaaaatatgatcttcgtttatattctgtgatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaa

SEQ ID NO: 8530 - DNA, 7423 bp, Homo sapiens
tgaattgacagtcccaactgtagttgtactgaatacttcaaaccagcaatatttcttgctagatagacagattaagaatgttgaagacatggtccagtttattaataacattttggatggcacagtagaagtaagttgttcacttctgtttcaaagagatgatggacagggggtagaggagaaactagttcatttctttacttgtgattctgaaaagaatcgttggccatcacccggagtagagggctggacctccatacattgcttctgtccaattataggcagagtagaggtacattctcccagatacagaaggttcttctgtggcagaggttgctaaagatggaagtgtccttttatgggttatttggagggtatttttggttgtcatggtgatggggaggggctgttggctaaggttgaggcttagggatgctaggaagtctgcactgtgtggggtaatcttaatagtgaacttgcctgtctcttagtatgtttctaggtccaaaagtacaattggattaagtcgttaggattggttttctaagaaaatctgcaaataagatgacaatttctcaagaaatgaggaaatttattgagagtaaaagcccccgtggagagttctagacttaatcctataaaatatttctcagaaataagtgaatagtcttaattttctatttttttcctataaattttaactgcagtgtttttcaaactgtgaattgcaacctatattagaaagtcatgaaaccaccgcaagtcacaatcaggttgtgaccagcatgcatcttaattcaatagactaggataaaatttaaaagaaagcgccttcattgcttttgtgaaatgtaattactagtttttgagagttgtttcagttttacacaaactttatttaaaatttgcttacagagtaacaaacataactactttcggtcaaggtgaagaagtttgaaaaacagtcaaatagttaagaatatttttgaaaataatttgttgaaatgaaactctcacctatataaataatcagccttctatttttaagttagtggaatgcaactcagactatttaacaacagattttattgtctcatagagcttggaaatttaaaaaatgagccagattgcaggtatggccgaatataggatttgagtgattttcatcaggaatttttcactctcttcccttcagcactttcatcctcagggaagctctccctgcacagtagcaaaggtatcctgcagcagctctggttttgcggtcccagctaaactcaaaagctggttaggctgtactcagaggtgggtcagcttcagccaagctgtgtgggttatgaatagaggaggaggaattgtttagagtagaatcagggtgaattaacacaagcaggcaggaggaatgctggacatgacacagacaaaaaacaacacagtaaatgtttaccacatggccttttcaggtgattatgtaatattttggagtcaaccatttggcctgcaattgtaaggttatgtaacaccaagtaaatgaagtaatggtgcttaaataatttatttttcttttccttttttgaaggcccaaggaggtgatagcattttgcagagattgaaaagaatagtatttgatgccaaatctactattgtggtaagttgtgacagtttatgtcattgataatgaagaagatataggttctttatgtctagctgtgttaaaaatctgaatttgaaaagattaggtcaaaatatgtctttttaatttgcaggatatgactagtcagtatttaagaaaatatattcattaggtggaaattgtttctaattgtttatatgattgatgagttaaaactaaaattcagaatcaattaacttgatagtataatttaaaagattttatttctgcaacctgccatgtaaagtttttacttagtaatttctatgatttgttgaaagtgcagataatatgaaatttttagttccattacgtgctgtcttctgtaaattggtcatttttgttaaagaaaatgatgtgtgctgggaagtcactttttattttgcaggagtcaaaataaaattttagatcttacaattttaaacatccctgttaattctgtacttttccctagttggtaaataattaagatcatttacagatgtttttccttcttccctttttctctccttccttttttttttcttttattctttttatagaacactttaaatgtggaattaaaatgtgatggatcacatcctttctaacagtgtttactttcatttgtttgtcccagtgtttattcacagttgttatatgtaagtagaatatcaacagtggtagacgaattgacatgtctgcccctaattacccgtctctcttgtttttataattatactttctaaatatatttccttgactttcttcactgtcacctctcacctgattatttctgctattctaatttcctcttcctttcactctatcaaactaatgctcactctgtcaaactaattagatctgttgtatttcccctggatttctttgaagcatcctttccttgacattctcctttccgtgctgctgtgagtatcactactcccctgctcctgccccatctcttcagtgtttttcagcatccctttcctccctttcccctttgcagtccctgggtctgaaccttctcgcttgacactcttacgaaattgttctccctctcccagctttaactgtcaatcaacttgacagcagaggaattcttaaatttgtttgagccctaaacttagttcctgttgtccttctcgagctcttacatgggcattttcattcactgtggcccaaagcaatcataaaaatatagctaacattttttggttagaagtaaattctgggactctttgtttttttccttgcatagtattcttcagtttgctttactttcctgttgccacgagcatggattaggccctaatcacattctgtctagctgctggtctctttcacctggtttccatacttccacttgcccagtctccaatctatattatattccactacacagttaatattactaaaataatcgattttgatcactttccttcccttttccagggacatcagaatactctgtccatctaaagtattttcctcattggtttttgaatattagcttttgctagtgcaaattgcctggtgctcacttgtcccatatcctgcctccttctcactcatccttaaattcctacctaaaacacacctttattctgtgaaactttcttttattatctcaatccaaagtgatctttttcttctctgaacttctctatgttctcaagagttatcgttgcaattcatgcagtatattctagttgaaaaccctattcattaaaattacttttactttcctgggagctatgaagacagtatgtaaattgagggaaattagtaagtcaatgaagttttactactaaccagataagtaaaaaatattaaaaatgtcatgtgaaaagagtatgtgtgtaccttctttgtggtaaataacccagccttctccataagcagattcctgtagttcaggaagcaactctaaagctgctgggcgcacatagtaagcaccttaaagagacctttgtggttaatgtagaaaaatcagtgtctttaggaaaggctgtagaatatttgatgcctttttctgttgctaatagctggttctgcacacacatgcttatgtatgtgcatatagaaattatatctcttaacagtgtctttcacatggtagttactgctgaaatgattgattcattggaactaaaaacaagctgaatagcaacaagagaaatctatagtggtttcaagttcatttcatgctatatatatcagaattacatgtgaagggaactgagttttaattctctttccacagtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattgaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattgtcataaaattttcatatatgcctagataatggggaaaaaaagtcttctgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactcttttttttaaagtaacagtttggtatgtttattgtagataaattatttttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccatactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcagcctagtaaggaagtgaaaacttagcagtcagtgacatggggaaatagttatagaaaatgtcactgaattttttcatatttataattagtcatttacatatttttgtcttgttgatcattacctgtaaatgaaagaccttaataggaaaaaaagagtaaagctcagtgtgaatgcaaacatccacaaaatatgatcttcgtttatattctgtgatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaa

SEQ ID NO: 8531 - DNA, 7424 bp, Homo sapiens
tgaattgacagtcccaactgtagttgtactgaatacttcaaaccagcaatatttcttgctagatagacagattaagaatgttgaagacatggtccagtttattaataacattttggatggcacagtagaagtaagttgttcacttctgtttcaaagagatgatggacagggggtagaggagaaactagttcatttctttacttgtgattctgaaaagaatcgttggccatcacccggagtagagggctggacctccatacattgcttctgtccaattataggcagagtagaggtacattctcccagatacagaaggttcttctgtggcagaggttgctaaagatggaagtgtccttttatgggttatttggagggtatttttggttgtcatggtgatggggaggggctgttggctaaggttgaggcttagggatgctaggaagtctgcactgtgtggggtaatcttaatagtgaacttgcctgtctcttagtatgtttctaggtccaaaagtacaattggattaagtcgttaggattggttttctaagaaaatctgcaaataagatgacaatttctcaagaaatgaggaaatttattgagagtaaaagcccccgtggagagttctagacttaatcctataaaatatttctcagaaataagtgaatagtcttaattttctatttttttcctataaattttaactgcagtgtttttcaaactgtgaattgcaacctatattagaaagtcatgaaaccaccgcaagtcacaatcaggttgtgaccagcatgcatcttaattcaatagactaggataaaatttaaaagaaagcgccttcattgcttttgtgaaatgtaattactagtttttgagagttgtttcagttttacacaaactttatttaaaatttgcttacagagtaacaaacataactactttcggtcaaggtgaagaagtttgaaaaacagtcaaatagttaagaatatttttgaaaataatttgttgaaatgaaactctcacctatataaataatcagccttctatttttaagttagtggaatgcaactcagactatttaacaacagattttattgtctcatagagcttggaaatttaaaaaatgagccagattgcaggtatggccgaatataggatttgagtgattttcatcaggaatttttcactctcttcccttcagcactttcatcctcagggaagctctccctgcacagtagcaaaggtatcctgcagcagctctggttttgcggtcccagctaaactcaaaagctggttaggctgtactcagaggtgggtcagcttcagccaagctgtgtgggttatgaatagaggaggaggaattgtttagagtagaatcagggtgaattaacacaagcaggcaggaggaatgctggacatgacacagacaaaaaacaacacagtaaatgtttaccacatggccttttcaggtgattatgtaatattttggagtcaaccatttggcctgcaattgtaaggttatgtaacaccaagtaaatgaagtaatggtgcttaaataatttatttttcttttccttttttgaaggcccaaggaggtgatagcattttgcagagattgaaaagaatagtatttgatgccaaatctactattgtggtaagttgtgacagtttatgtcattgataatgaagaagatataggttctttatgtctagctgtgttaaaaatctgaatttgaaaagattaggtcaaaatatgtctttttaatttgcaggatatgactagtcagtatttaagaaaatatattcattaggtggaaattgtttctaattgtttatatgattgatgagttaaaactaaaattcagaatcaattaacttgatagtataatttaaaagattttatttctgcaacctgccatgtaaagtttttacttagtaatttctatgatttgttgaaagtgcagataatatgaaatttttagttccattacgtgctgtcttctgtaaattggtcatttttgttaaagaaaatgatgtgtgctgggaagtcactttttattttgcaggagtcaaaataaaattttagatcttacaattttaaacatccctgttaattctgtacttttccctagttggtaaataattaagatcatttacagatgtttttccttcttccctttttctctccttccttttttttttcttttattctttttatagaacactttaaatgtggaattaaaatgtgatggatcacatcctttctaacagtgtttactttcatttgtttgtcccagtgtttattcacagttgttatatgtaagtagaatatcaacagtggtagacgaattgacatgtctgcccctaattacccgtctctcttgtttttataattatactttctaaatatatttccttgactttcttcactgtcacctctcacctgattatttctgctattctaatttcctcttcctttcactctatcaaactaatgctcactctgtcaaactaattagatctgttgtatttcccctggatttctttgaagcatcctttccttgacattctcctttccgtgctgctgtgagtatcactactcccctgctcctgccccatctcttcagtgtttttcagcatccctttcctccctttcccctttgcagtccctgggtctgaaccttctcgcttgacactcttacgaaattgttctccctctcccagctttaactgtcaatcaacttgacagcagaggaattcttaaatttgtttgagccctaaacttagttcctgttgtccttctcgagctcttacatgggcattttcattcactgtggcccaaagcaatcataaaaatatagctaacattttttggttagaagtaaattctgggactctttgtttttttccttgcatagtattcttcagtttgctttactttcctgttgccacgagcatggattaggccctaatcacattctgtctagctgctggtctctttcacctggtttccatacttccacttgcccagtctccaatctatattatattccactacacagttaatattactaaaataatcgattttgatcactttccttcccttttccagggacatcagaatactctgtccatctaaagtattttcctcattggtttttgaatattagcttttgctagtgcaaattgcctggtgctcacttgtcccatatcctgcctcgcttctcactcatccttaaattcctacctaaaacacacctttattctgtgaaactttcttttattatctcaatccaaagtgatctttttcttctctgaacttctctatgttctcaagagttatcgttgcaattcatgcagtatattctagttgaaaaccctattcattaaaattacttttactttcctgggagctatgaagacagtatgtaaattgagggaaattagtaagtcaatgaagttttactactaaccagataagtaaaaaatattaaaaatgtcatgtgaaaagagtatgtgtgtaccttctttgtggtaaataacccagccttctccataagcagattcctgtagttcaggaagcaactctaaagctgctgggcgcacatagtaagcaccttaaagagacctttgtggttaatgtagaaaaatcagtgtctttaggaaaggctgtagaatatttgatgcctttttctgttgctaatagctggttctgcacacacatgcttatgtatgtgcatatagaaattatatctcttaacagtgtctttcacatggtagttactgctgaaatgattgattcattggaactaaaaacaagctgaatagcaacaagagaaatctatagtggtttcaagttcatttcatgctatatatatcagaattacatgtgaagggaactgagttttaattctctttccacagtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattgaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattgtcataaaattttcatatatgcctagataatggggaaaaaaagtcttctgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactcttttttttaaagtaacagtttggtatgtttattgtagataaattatttttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccatactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcagcctagtaaggaagtgaaaacttagcagtcagtgacatggggaaatagttatagaaaatgtcactgaattttttcatatttataattagtcatttacatatttttgtcttgttgatcattacctgtaaatgaaagaccttaataggaaaaaaagagtaaagctcagtgtgaatgcaaacatccacaaaatatgatcttcgtttatattctgtgatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaa

SEQ ID NO: 8532 - DNA, 7424 bp, Homo sapiens
tgaattgacagtcccaactgtagttgtactgaatacttcaaaccagcaatatttcttgctagatagacagattaagaatgttgaagacatggtccagtttattaataacattttggatggcacagtagaagtaagttgttcacttctgtttcaaagagatgatggacagggggtagaggagaaactagttcatttctttacttgtgattctgaaaagaatagttggccatcacccggagtagagggctggacctccatacattgcttctgtccaattataggcagagtagaggtacattctcccagatacagaaggttcttctgtggcagaggttgctaaagatggaagtgtccttttatgggttatttggagggtatttttggttgtcatggggatggggaggggctgttggctaaggttgaggcttagggatgctaggaagtctgcactgtgtggggtaatcttaatagtgaacttgcctgtctcttagtatgtttctagggccaaaagtacaattggattaagtcgttaggattggttttctaagaaaatctgcaaataagatgacaatttctcaagaaatgaggaaatttattgagagtaaaagcccccgtggagagttctagacttaatcctataaaatatttctcagaaataagtgaatagtcttaattttctatttttttcctataaattttaactgcagtgtttttcaaactgtgaattgcaacctatattagaaagtcatgaaaccaccgcaagtcacaatcaggttgtgaccagcatgcatcttaattcaatagactaggataaaatttaaaagaaagcgccttcattgcttttgtgaaatgtaattactagtttttgagagttgtttcagttttacacaaactttatttaaaatttgcttacagagtaacaaacataactactttcggtcaaggtgaagaagtttgaaaaacagtcaaatagttaagaatatttttgaaaataatttgttgaaatgaaactctcacctatataaataatcagccttctatttttaagttagtggaatgcaactcagactatttaacaacagattttattgtctcatagagcttggaaatttaaaaaatgagccagattgcaggtatggccgaatataggatttgagtgattttcatcaggaatttttcactctcttcccttcagcactttcatcctcagggaagctctccctgcacagtagcaaaggtatcctgcagcagctctggttttgcggtcccagctaaactcaaaagctggttaggctgtcctcagaggtgggtcagcttcagccaagctgtgtgggttatgaatagaggaggaggaattgtttagagtagaatcagggtgaattaacacaagcaggcaggaggaatgctggacatgacacagacaaaaaacaacacagtaaatgtttaccacatggccttttcagggtgattatgtaatattttggagtcaaccatttggcctgcaattgtaaggttatgtaacaccaagtaaatgaagtaatggtgcttaaataatttatttttcttttccttttttgaaggcccaaggaggtgatagcattttgcagagattgaaaagaatagtatttgatgccaaatctactattgtggtaagttgtgacagtttatgtcattgataatgaagaagatataggttctttatgtctagctgtgttaaaaatctgaatttgaaaagattaggtcaaaatatgtctttttaatttgcaggatatgactagtcagtatttaagaaaatatattcattaggtggaaattgtttctaattgtttatatgattgatgagttaaaactaaaattcagaatcaattaacttgatagtataatttaaaagattttatttctgcaacctgccatgtaaagtttttacttagtaatttctatgatttgttgaaagtgcagataatatgaaatttttagttccattacgtgctgtcttctgtaaattggtcatttttgttaaagaaaatgatgtgtgctgggaagtcactttttattttgcaggagtcaaaataaaattttagatcttacaattttaaacatccctgttaattctgtacttttccctagttggtaaataattaagatcatttacagatgtttttccttcttccctttttctctccttccttttttttttcttttattctttttatagaacactttaaatgtggaattaaaatgtgatggatcaaatcctttctaacagtgtttactttcatttgtttgtcccagtgtttattcacagttgttatatgtaagtagaatatcaacagtggtagacgaattgacatgtctgcccctaattacccgtctctcttgtttttataattatactttctaaatatatttccttgactttcttcactgtcacctctcacctgattatttctgctattctaatttcctcttcctttcactctatcaaactaatgctcactctgtcaaactaattagatctgttgtatttcccctggatttctttgaagcatcctttccttgacattctcctttccgtgctgctgtgagtatcactactcccctgctcctgccccatctcttcagtgtttttcagcatccctttcctccctttcccctttgcagtccctgggtctgaaccttctcgcttgacactcttacgaaattgttctccctctcccagctttaactgtcaatcaacttgacagcagaggaattcttaaatttgtttgagccctaaacttagttcctgttgtccttctcgagctcttacatgggcattttcattcactgtggcccaaagcaatcataaaaatatagctaacattttttggttagaagtaaattctgggactctttgtttttttccttgcatagtattcttcagtttgctttactttcctgttgccacgagcatggattaggccctaatcacattctgtctagctgctggtctctttcacctggtttccatacttccacttgcccagtctccaatctatattatattccactacacagttaatattactaaaataatcgattttgatcactttccttcccttttccagggacatcagaatactctgtccatctaaagtattttcctcgttggtttttgaatattagcttttgctagtgcaaattgcctggtgctcacttgtcccatatactgcctccttctcactcatccttaaattcctacctaaaacacacctttattctgtgaaactttcttttattatctcaatccaaagtgatctttttcttctctgaacttctctatgttctcaagagttatcgttgcaattcatgcagtatattctagttgaaaaccctattcattaaaattacttttactttcctgggagctatgaagacagtatgtaaattgagggaaattagtaagtcaatgaagttttactactaaccagataagtaaaaaatattaaaaatgtcatgtgaaaagagtatgtgtgtaccttctttgtggtaaataacccagccttctccataagcagattcctgtggttcaggaagcaactctaaagctgctgggcgcacatagtaagcaccttaaagagacctttgtggttaatgtagaaaaatcagtgtctttaggaaaggctgtagaatatttgatgcctttttctgttgctaatagctggttctgcacacacatgcttatgtatgtgcatatagaaattatatctcttaacagtgtctttcacatggtagttactgctgaaatgattgattcattggaactaaaaacaagctgaatagcaacaagagaaatctatagtggtttcaagttcatttcatgctatatatatcagaattacatgtgaagggaactgagttttaattctctttccacagtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattaaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattatcataaaattttcatatatgcctagataatggggaaaaaaagtcttgtgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactcttttttttaaagtaacagtttggtatgtttattgtagataaattatttttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccgtactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcagcctagtaaggaagtgaaaacttagcagtcagtgacatggggaaatagttatagaaaatgtcactgaattttttcatatttataattagtcatttacatatttttgtcttgttgatcattacctgtaaatgaaagaccttaataggaaaaaaagagtaaagctcagtgtgaatgcaaacatccacaaaatatgatcttcgtttatattctgtgatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaa

SEQ ID NO: 8533 - DNA, 2485 bp, Homo sapiens
aaactgcctcactgttacttcatcaatcacagcttcaaatgtctcaatcagcagaagattgtaaattcgatctttcagggaaattaatctattctgaaaggcaataacatgaagcaaggcaaaggaggcactgatggtttagtatactacataagggatttttttgttctattattaagaaaatctagacctgaaatgttttctcaactcttattgtactgtgtatatttatattgttgtcgtggcggctgtttttaaagggaaagtgttggttctattaatttgttaagtgtccatccaggtgggcctacctgattccacatatataagtacatatctgcttataaagcgctgtaaatggcagcaaggctgtttttggagaagagtttgggttttcctaccatccctttgaatgctacacatccgtctattttaacccaagtagttcgtatttcagatatattttctcctttcatctcctctcactactgcagagtccagtaatacctagcataggattctgtcctgtgtcaaatggctaaaataaatttttgccccaatagacatgctgcctcattcaaaagagctgccgctgtcatcttgaggttccaggtagtgagagaagaaactcgacctgccagggtcaacagccatgaagaggtggggggagtcatgattcataaacactgaaagaagtcaaggcttttggcagagagtgttgatttagatttttagtcttgattgatgggcagtatgcatcggtgtctagctgaagttgtctttaaatgcccttactcgtcacagtttaaacacttaggatgtggcaatcttaagtatcaatggcattttatgtccagctaacatcctaaagcattagaaattaaaaacgaaagacttttaaaaacatacatcaaacatgcttgcaccagagaagctttttaaaataatacactctcatagccaggtgctaatttaattttacttatgaaattaagagaggtgatgggttctagcaacagatattttcacggacatattctaaaaccactagagaattcgctacctctcagagccatcgatgctttgagctacctttataaacagggcacaaatgtttactgctgtggtttacaagaaaagggctactcacttattttgaaaccaacgaaccaacttttaactagggtgaacaaagcactcaaagtgctttgtgaaattggagcatacagagattttgagcttcaagtatttgctagttttaaaaagaatacaccttttctttaccttgtagcagcaattaaaagtcacacaaagcttgcatcgagtagggccaactgccacttgggtagcctatggtcacattcaatactgagaatgacttggaactcacagattaatatgaaagaagcagcgttcatcccaagacccatgctcacaattacagctccgtgccctgaggtagagttgagatttggattaagaaatagatttctaatacgactcaagatcatcctacaatattttctttggaaactaatttagcccatgatattttaaagagagacaagagaaggcctatttatcttgtctaagtgaacggcatttgtatattcataagctatttttggtaagaattttaaatcttttagctcaaggcctacagggcatcatgatctttgccttccttgaaaatacaatttaaattgtacaaacactttataaaaagctaattattggtgttagaacatgaccccacacaatgctgcttgacccctgaaactgacattcatgagcataacctttgttacattgttctttttgatgtaatttgtagaaatgttttttagttcgtaatggaaaatgtatgtaccctgaaaaattacttattttgtttaactttggtataaaggtgttgggcattttcttggggagggggggattacaaaagaagtttgtctcccacatcaaaaaacgttcaaagaaattaagtatttattatattttttgcagatgtttccatacaattcacataacctttttgtaaagagagatgaagaaatggattaaagatttttaatatttgaaatggtaaatagaactaatttattgtaatatatttctgttatttatagatgtttccttaatgttttactgtgcattaccactttcatttaagccttatccttgtgaatttaccatttcttttttaaaacatgtctagatgcatattttaaataactggaatgtaaatcactagcatatctgaattcccaaatgtaatttttaaaaattattttggtttggaaaaaaaagattcatttgaaagccttcagatggaggggtgggaacatttttatggctttatgaattggaatttcataggcttatttacctagattgtgtgtgaacaaaaaaatattgtaaatagatgaatgtttcccataatgtaaaaagaagaaattaataaaataattaatgcactgct

SEQ ID NO: 8534 - DNA, 2486 bp, Homo sapiens
aaactgcctcactgttacttcatcaatcacagcttcaaatgtctcaatcagcagaagattgtaaattcgatcttttcagggaaattaatctattctgaaaggcaataacatgaagcaaggcaaaggaggcactgatggtttagtatactacataagggatttttttgttctattattaagaaaatctagacctgaaatgttttctcaactcttattgtactgtgtatatttatattgttgtcgtggcggctgtttttaaagggaaagtgttggttctattaatttgttaagtgtccatccaggtgggcctacctgattccacatatataagtacatatctgcttataaagcgctgtaaatggcagcaaggctgtttttggagaagagtttgggttttcctaccatccctttgaatgctacacatccgtctattttaacccaagtagttcgtatttcagatatattttctcctttcatctcctctcactactgcagagtccagtaatacctagcataggattctgtcctgtgtcaaatggctaaaataaatttttgccccaatagacatgctgcctcattcaaaagagctgccgctgtcatcttgaggttccaggtagtgagagaagaaactcgacctgccagggtcaacagccatgaagaggtggggggagtcatgattcataaacactgaaagaagtcaaggcttttggcagagagtgttgatttagatttttagtcttgattgatgggcagtatgcatcggtgtctagctgaagttgtctttaaatgcccttactcgtcacagtttaaacacttaggatgtggcaatcttaagtatcaatggcattttatgtccagctaacatcctaaagcattagaaattaaaaacgaaagacttttaaaaacatacatcaaacatgcttgcaccagagaagctttttaaaataatacactctcatagccaggtgctaatttaattttacttatgaaattaagagaggtgatgggttctagcaacagatattttcacggacatattctaaaaccactagagaattcgctacctctcagagccatcgatgctttgagctacctttataaacagggcacaaatgtttactgctgtggtttacaagaaaagggctactcacttattttgaaaccaacgaaccaacttttaactagggtgaacaaagcactcaaagtgctttgtgaaattggagcatacagagattttgagcttcaagtatttgctagttttaaaaagaatacaccttttctttaccttgtagcagcaattaaaagtcacacaaagcttgcatcgagtagggccaactgccacttgggtagcctatggtcacattcaatactgagaatgacttggaactcacagattaatatgaaagaagcagcgttcatcccaagacccatgctcacaattacagctccgtgccctgaggtagagttgagatttggattaagaaatagatttctaatacgactcaagatcatcctacaatattttctttggaaactaatttagcccatgatattttaaagagagacaagagaaggcctatttatcttgtctaagtgaacggcatttgtatattcataagctatttttggtaagaattttaaatcttttagctcaaggcctacagggcatcatgatctttgccttccttgaaaatacaatttaaattgtacaaacactttataaaaagctaattattggtgttagaacatgaccccacacaatgctgcttgacccctgaaactgacattcatgagcataacctttgttacattgttctttttgatgtaatttgtagaaatgttttttagttcgtaatggaaaatgtatgtaccctgaaaaattacttattttgtttaactttggtataaaggtgttgggcattttcttggggagggggggattacaaaagaagtttgtctcccacatcaaaaaacgttcaaagaaattaagtatttattatattttttgcagatgtttccatacaattcacataacctttttgtaaagagagatgaagaaatggattaaagatttttaatatttgaaatggtaaatagaactaatttattgtaatatatttctgttatttatagatgtttccttaatgttttactgtgcattaccactttcatttaagccttatccttgtgaatttaccatttcttttttaaaacatgtctagatgcatattttaaataactggaatgtaaatcactagcatatctgaattcccaaatgtaatttttaaaaattattttggtttggaaaaaaaagattcatttgaaagccttcagatggaggggtgggaacatttttatggctttatgaattggaatttcataggcttatttacctagattgtgtgtgaacaaaaaaatattgtaaatagatgaatgtttcccataatgtaaaaagaagaaattaataaaataattaatgcactgct

SEQ ID NO: 8535 - DNA, 2485 bp, Homo sapiens
aaactgcctcactgttacttcatcaatcacagcttcaaatgtctcaatcagcagaagattgtaaattcgatctttcagggaaattaatctattctgaaaggcaataacatgaagcaaggcaaaggaggcactgatggtttagtatactacataagggatttttttgttctattattaagaaaatctagacctgaaatgttttctcaactcttattgtactgtgtatatttatattgttgtcgtggcggctgtttttaaagggaaagtgttggttctattaatttgttaagtgtccatccaggtgggcctacctgattccacatatataagtacatatctgcttataaagcgctgtaaatggcagcaaggctgtttttggagaagagtttgggttttcctaccatccctttgaatgctacacatccgtctattttaacccaagtagttcatatttcagatatattttctcctttcatctcctctcactactgcagagtccagtaatacctagcataggattctgtcctgtgtcaaatggctaaaataaatttttgccccaatagacatgctgcctcattcaaaagagctgccgctgtcatcttgaggttccaggtagtgagagaagaaactcgacctgccagggtcaacagccatgaagaggtcgggggagtcatgattcataaacactgaaagaagtcaaggcttttggcagagagtgttgatttagatttttagtcttgattgatgggcagtatgcatcggtgtctagctgaagttgtctttaaatgcccttactcgtcacagtttaaacacttaggatgtggcaatcttaagtatcaatggcattttatgtccagctaacatcctaaagcattagaaattaaaaacgaaagacttttaaaaacatacatcaaacatgcttgcaccagagaagctttttaaaataatacactctcatagccaggtgctaatttaattttacttatgaaattaagagaggtgatgggttctagcaacagatattttcacggacatattctaaaaccactagagaattcgctacctctcagagccatcgatgctttgagctacctttataaacagggcacaaatgtttactgctgtggtttacaagaaaagggctactcacttattttgaaaccaacgaaccaacttttaactagggtgaacaaagcactcaaagtgctttgtgaaattggagcatacagagattttgagcttcaagtatttgctagttttaaaaagaatacaccttttctttaccttgtagcagcaattaaaagtcacacaaagcttgcatcgagtagggccaactgccacttgggtagcctatggtcacattcaatactgagaatgacttggaactcacagattaatatgaaagaagcagcgttcatcccaagacccatgctcacaattacagctccgtgccctgaggtagagttgagatttggattaagaaatagatttctaatacgactcaagatcatcctacaatattttctttggaaactaatttagcccatgatattttaaagagagacaagagaaggcctatttatcttgtctaagtgaacggcatttgtatattcataagctatttttggtaagaattttaaatcttttagctcaaggcctacagggcatcatgatctttgccttccttgaaaatacaatttaaattgtacaaacactttataaaaagctaattattggtgttagaacatgaccccacacaatgctgcttgacccctgaaactgacattcatgagcataacctttgttacattgttctttttgatgtaatttgtagaaatgttttttagttcgtaatggaaaatgtatgtaccctgaaaaattacttattttgtttaactttggtataaaggtgttgggcattttcttggggagggggggattacaaaagaagtttgtctcccacatcaaaaaacgttcaaagaaattaagtatttattatattttttgcagatgtttccatacaattcacataacctttttgtaaagagagatgaagaaatggattaaagatttttaatatttgaaatggtaaatagaactaatttattgtaatatatttctgttatttatagatgtttccttaatgttttactgtgcattaccactttcatttaagccttatccttgtgaatttaccatttcttttttaaaacatgtctagatgcatattttaaataactggaatgtaaatcactagcatatctgaattcccaaatgtaatttttaaaaattattttggtttggaaaaaaaagattcatttgaaagccttcagatggaggggtgggaacatttttatggctttatgaattggaatttcataggcttatttacctagattgtgtgtgaacaaaaaaatattgtaaatagatgaatgtttcccataatgtaaaaagaagaaattaataaaataattaatgcactgct

SEQ ID NO: 8536 - DNA, 541 bp, Homo sapiens
ggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccctttattttctgggcaaagccaaacccacctgtgtagaagtgatgcctttaggtcacccgccgtcctcagttctctcgagctagtctgttcagcaatataaaaccatagggtatttcagaaatccagtatcacagggtgatcctttgggacttaccgtcttccacgtgaaagaaacta

SEQ ID NO: 8537 - DNA, 361 bp, Homo sapiens
aattgacccccaaaaagggtaaattagaattttttatgatgtggacttgcacttatttgttgcctgaaaatgccacaactctaaaatttgtttccacagtgctttgtcctaatccccaccaacttttcaccgacatgcaacaaccttggaaattagtaagcacaggagccactttttctgatttttgtacataagcaagacctatgccagtcaccagaataacacactgtacttttgaaactgctttgaaagaggaatgatcaggtgactgaatctctgtgaggttacaaaggcctcatcgctttggttcgtgcactgactattcatgtagtctgaaccgtgattacactttttgcctttt

SEQ ID NO: 8538 - DNA, 361 bp, Homo sapiens; identical to SEQ ID NO: 8537

SEQ ID NO: 8539 - DNA, 541 bp, Homo sapiens; identical to SEQ ID NO: 8536

SEQ ID NO: 8540 - DNA, 361 bp, Homo sapiens
aattgacccccaaaaagggtaaattagaattttttatgatgtggacttgcacttacttgttgcctgaaaatgccacaactctaaaatttgtttccacagtgctttgtcctaatccccaccaacttttcaccgacatgcaacaaccttggaaattagtaagcacaggagccactttttctgatttttgtacagaagcaagacctatgccagtcaccagaataacacactgtacttttgaaactgctttgaaagaggaatgatcaggtgactgaatctctgtgaggttacaaaggcctcatcgctttggttcgtgcactgactattcatgtagtctgaaccgtgattacactttttgcctttt

SEQ ID NO: 8541 - DNA, 5456 bp, Homo sapiens
cctgtgaagaccctggcgactggaccgcggccattggaggtacgaggttcctccttgtgggcttctcacaagccctggcggggtggtggagtctctgcccacctcgggccacacaggggctccaggagtccaggtggggccggcagggtctttgtggagaaaggcctggttccagcagcattgtcgtgggcgctctgaggctgacctgctagattttggcactgtggatgtgtctgggcagtgcaagcccagcacagtgccaggcgctgccggctctggcatggtgtcctcgtggctatggtgatgtccttgtggctgtggtggctgccccgtgtagcagcactttccctgcccactgaacccactccttccctcacagatgacacatttaccttctggcgggggctgaaggacgccggcctgctggacgaggtcatccaggagttccaccaggagctggtggagaccatgagaggcctgcagcagcgggtccaggaccctcccctgcagcttcgaggtgagaagctgcatcttccctcttgctggctactcagcccaggagtctctgcaggaggtgaggccactggccctcctgcccctaggcccttctgtgctgctgggttggaggctgaatctaggcttgggactcctgctgtgctgaggctgaacttggtgggaggatcgccttgatgtatctcagtcttctccctctgaactgagctcctggctggctgggttcctgaggagcagcctcagtggtggtgttctcactctctaggaagagcccaggctctcaccgagcgtccacgtgactctctaggaaggtcccgggctctcaccgagcgtccgcgtggctctctaggaagggcttgggctctcactgagtgtccgcgttaccctttaagatgctgtacttctcaacaacatcgtgcagaacttcggcatgctggacctggtgaagaaggtgctggccagccacaagtgccagatggaccgctcgcgggagcagtacgcccgggacctggcaggtatgctgagaccacccccgtcccgtcccctgggcggtaggctgaggacctggagcccacgggctcaccccacggctgtgcatccacctgcacttcctggagtcaccgccaccacggcgagcttctccgcactgctgttgtgcgaggaaaacaacctgaagcttaagtgaggtagtcagacctctccattgcactaagcttacatttaccggcatttctgtgatgaaccaagtagttatttaagagaaaatgacagaggccaggcgcggtggctcacgcctgttatcccagcgctttgggaggccgaggcgggcggatcacttcaggctaggagtttgagaccagcctggccaacgtggtgaaaccccatctctgctgaaaaaaacaaaacaaaactgggcatggtggtgtgtgcctgtaatcccagctactcgggaggctggcaggcaattgcttgagcccaggaggtggaagttgcagggagctgagatcacaccactgcactccagtctgggtgacagagcgagaccctgtctcaaaaaaaaacaatgacagagaatgggaagggctggtcctgaccccgctcagagctcaagcccctgatattggtgcgtttcctccatgctcctcttggggtctgtgcttactgtgtgttcactgtgtgtgtgttcagtgtgtgtgtgttcactgcgtgttcactgtgtgttcaatgtgtgtgtattcagtgtgtgtgttcactgtgttcagtgtgtgtgtattcagtgtgtgtgcactgtgtgttcactcttcactttgtgtgttcactgtttgtgttcattgtgtgtgtgcactctgcatgtgtgtgtgcatgtttatgtttaaacacatgtgccacatgtgctgcttttcctcctctctctcttaatatgtcacaagagcaactttccacgctgggtgtgtgaaagctcatgcggggatctgagacggcatttccacgcttgcacgcaggccctgggtcagtgcaggagggtctgagacgggattgccacgcttgcacacaggccccgggtcagtgcagaccctgggtcagcacaggctggtgtctaccccgagggccatcttgggccccgtctcccacagacctcacctttggcggccatgtggtcatctgggtttgtggcatcaggtgagcagacctgggttgccactgacccaggggccacccagatggtgtggcgtgtctgcccccatcccctgcatgccgccatccatgcccccgtcccctgtgtgatgccatctgtacctccctgcagccctggagcagcagtgtgatgagcatcgtcgccgagccaaggagctgaagcacaagtcccagcacctcagcaacgtgctcatgacgctgacgccggtctccctgccaccgcctgtgaagcggccccggcttgcacgtgccacatcaggaccggccgccatggcctcgcaggtgctcacccagtctgcccagctggcgcttggcccgggcgtgcccgtcccccagctgaccagcgtgccccttggtaaagtggtgtccaccctgccgtccaccgtcctgggcaagggttcccttcaggcgccccccgccagctccccggcctccccgctgctcgggggatacacagtcttggcctcttccggctccacctaccccagcacagtggagatccacccggacgcgtccagcctcacggtcctgagcacggccgccgtgcaggacggtagcacggtgttcaaggtggtcagcccgctacagctgctcacgttgcctggcctgggccccaccctgcagaacgtggcccaggcctcgcctggctccagcacaattgtgacagtgcccgcaggggctgcccccgggcctgaggagcacacggccaccattgaggtggctgccatggcagaggaccacgagcggaagtagccgacaggagggcgaggcccctgggacggacagggctggctgtctctcagccgcggcagcagggagcgggcagaggccgcagggctggctcgggcaggtgggtcacgtggtctgcagaaccaaagagaggaatcgccaaaacaaatcacgagaagagagaaggggacagaacagcgagagcaacctggaaaatcggtcttcaggtcccacgtttcctcccccttttttcttgggaaatatatttttccatctgttgcttattaatactgtttacacattgggccttgatcaggagccaggtgggcgggggctagggggagcctgggtgcagcagagacagaggaagcagagccaggtgccgagcgcgaccctgcaggtgctggacgcggtgcagcaggtcacgaggcccccatgtctgcacccagccaggtccctggggacgttactaactcatgacttgggagctaagcccaagtgtgaaacctctggatcctatggatttggtttcttcccacagttttctgtaggtttagtgtggctggcgccccgttctcctccagttgggaacatgcacccggagcttggggtgcagatcctgatgggtgcctgcctcccccgcccccagccggtgctcaggtggcccaggggccgcacagacgaggcgtggtccaggcattgttgcacatgtactgagggtgtttttaagtgaattgcttagtaggcttctaggaagagtcagatttatagcattttcaaccaaaataatggtgagtgcctaggcttcccgagttagctctttgggtggcccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgatcttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcatagtttgagtgtc

SEQ ID NO: 8542 - DNA, 5457 bp, Homo sapiens
cctgtgaagaccctggcgactggaccgcggccattggaggtacgaggttcctccttgtgggcttctcacaagccctggcggggtggtggagtctctgcccacctcgggccacacaggggctccaggagtccaggtggggccggcagggtctttgtggagaaaggcctggttccagcagcattgtcgtgggcgctctgaggctgacctgctagattttggcactgtggatgtgtctgggcagtgcaagcccagcacagtgccaggcgctgccggctctggcatggtgtcctcgtggctatggtgatgtccttgtggctgtagtgggtgccccgtgtagcagcactttccctgcccactgaacccactccttccctcacagatgacacatttaccttctggcgggggctgaaggacgccggcctgctggacgaggtcatccaggagttccaccaggagctggtggagaccatgagaggcctgcagcagcgggtccaggaccctcccctgcagcttcgaggtgagaagctgcatcttccctcttgctggctactcagcccaggagtctctgcaggaggtgaggccactggccctcctgcccctaggcccttctgtgctgctgggttggaggctgaatctaggcttgggactcctgctgtgctgaggctgaacttggtgggaggatcgccttgatgtatctcagtcttctccctctgaactgagctcctggctggctgggttcctgaggagcagcctcagtggtggtgttctcactctctaggaagagcccaggctctcaccgagcgtccacgtgactctctaggaaggtcccgggctctcaccgagcgtccgcgtggctctctaggaagggcttgggctctcactgagtgtccgcgttaccctttaagatgctgtacttctcaacaacatcgtgcagaacttcggcatgctggacctggtgaagaaggtgctggccagccacaagtgccagatggaccgctcgcgggagcagtacgcccgggacctggcaggtacgctgagaccacccccgtcccgtcccctgggcggtaggctgaggacctggagcccacgggctcaccccacggctgtgcatccacctgcacttcctggagtcgccgccaccacggcgagcttctccgcactgctattgtgcgaggaaaacaacctgaagcttaagtgaggtagtcagacctctccattgcactaagcttacatttaccggcatttctgtgatgaaccaagtagttatttaagagaaaatgacagaggccaggcgcagtggctcacgcctgttatcccagcgctttgggaggccgaggcgggcggatcacttcaggctaggagtttgagaccagcctggccaacgtggtgaaaccccatctctgctgaaaaaaacaaaacaaaactgggcatggtggtgtgtgcctgtaatcccagctactcgggaggctggcaggcaattgcttgagcccaggaggtggaagttgcagggagctgagatcacaccactgcactccagtctgggtgacagagcgagaccctgtctcaaaaaaaaaacaatgacagagaatgggaagggctggtcctgaccccgctcagagctcaagcccctgatattggtgcgtttcctccatgctcctcttggggtctgtgcttactgtgtgttcactgtgtgtgtgttcagtgtgtgtgtgttcactgcgtgttcactgtgtgttcaatgtgtgtgtattcagtgtgtgtgttcactgtgttcagtgtgtgtgtattcagtgtgtgtgcactgtgtgttcactcttcactttgtgtgttcactgtttgtgttcattgtgtgtgtgcactctgcatgtgtgtgtgcatgtttatgtttaaacacatgtgccacatgtgctgcttttcctcctctctctcttaatatgtcacaagagcaactttccacgctgggtgtgtgaaagctcatgcggggatctgagacggcatttccacgcttgcatgcaggccctgggtcagtgcaggagggtctgagacgggattgccacgcttgcacacaggccccgggtcagtgcagaccctgggtcagcacaggctggtgtctaccccgagggccatcttgggccccgtctcccacagacctcacctttggcggccatgtggtcatctgggtttgtggcatccggtgagcagacctgggttgccactgacccaggggccacccagatggtgtggcgtgtctgcccccatcccctgcatgccgccatccatgcccccgtcccctgtgtgatgccatctgtacctccctgcagccctggagcagcagtgtgatgagcatcgtcgccgagccaaggagctgaagcacaagtcccagcacctcagcaacgtgctcatgacgctgacgccggtctccctgccaccgcctgtgaagcggccccggcttgcacgtgccacatcaggaccggccgccatggcctcgcaggtgctcacccagtctgcccagctggcgcttggcccgggcgtgcccgtcccccagctgaccagcgtgccccttggtaaagtggtgtccaccctgccgtccaccgtcctgggcaagggttcccttcaggcgccccccgccagctccccggcctccccgctgctcgggggatacacagtcttggcctcttccggctccacctaccccagcacagtggagatccacccggacgcgtccagcctcacggtcctgagcacggccgccgtgcaggacggtagcacggtgttcaaggtggtcagcccgctgcagctgctcacgttgcctggcctgggccccaccctgcagaacgtggcccaggcctcgcctggctccagcacaattgtgacagtgcccgcaggggctgcccccgggcctgaggagcacacggccaccattgaggtggctgccatggcagaggaccacgagcggaagtagccgacaggagggcgaggcccctgggacggacagggctggctgtctctcagccgcggcagcagggagcgggcagaggccgcagggctggctcgggcaggtgggtcacgtggtctgcagaaccaaagagaggaatcgccaaaacaaatcacgagaagagagaaggggacagaacagcgagagcaacctggaaaaccggtcttcaggtcccacgtttcctcccccttttttcttgggaaatatatttttccatctgttgcttattaatactgtttacacattgggccttgatcaggagccaggtgggcgggggctagggggagcctgggtgcagcagagacagaggaagcagagccaggtgccgagcgcgaccctgcaggtgctggacgcggtgcagcaggtcacgaggcccccatgtctgcacccagccaggtccctggggacgttactaactcatgacttgggagctaagcccaagtgtgaaacctctggatcctatggatttggtttcttcccacagttttctgtaggtttagtgtggctggcgccccgttctcctccagttgggaacatgcacccggagcttggggtgcagatcctgatgggtgcctgcctcccccgcccccagccggtgctcaggtggcccaggggccgcacagacgaggcgtggtccaggcattgttgcacatgtactgagggtgtttttaagtgaattgcttagtaggcttctaggaagagtcagatttatagcattttcaaccaaaataatggtgagtgcctaggcttcccgagttagctctttgggtggcccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgaccttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcatagtttgagtgtc

SEQ ID NO: 8543 - DNA, 5457 bp, Homo sapiens
cctgtgaagaccctggcgactggaccgcggccattggaggtacgaggttcctccttgtgggcttctcacaagccctggcggggtggtggagtctctgcccacctcgggccacacaggggctccaggagtccaggtggggccggcagggtctttgtggagaaaggcctggttccagcagcattgtcgtgggcgctctgaggctgacctgctagattttggcactgtggatgtgtctgggcagtgcaagcccagcacagtgccaggcgctgccggctctggcatggtgtcctcgtggctatggtgatgtccttgtggctgtggtggctgccccgtgtagcagcactttccctgcccactgaacccactccttccctcacagatgacacatttaccttctggcgggggctgaaggacgccggcctgctggacgaggtcatccaggagttccaccaggagctggtggagaccatgagaggcctgcagcagcgggtccaggaccctcccctgcagcttcgaggtgagaagctgcatcttccctcttgctggctactcagcccaggagtctctgcaggaggtgaggccactggccctcctgcccctaggcccttctgtgctgctgggttggaggctgaatctaggcttgggactcctgctgtgctgaggctgaacttggtgggaggatcgccttgatgtatctcagtcttctccctctgaactgagctcctggctggctgggttcctgaggagcagcctcagtggtggtgttctcactctctaggaagagcccaggctctcaccgagcgtccacgtgactctctaggaaggtcccgggctctcaccgagcgtccgcgtggctctctaggaagggcttgggctctcactgagtgtccgcgttaccctttaagatgctgtacttctcaacaacatcgtgcagaacttcggcatgctggacctggtgaagaaggtgctggccagccacaagtgccagatggaccgctcgcgggagcagtacgcccgggacctggcaggtatgctgagaccacccccgtcccgtcccctgggcggtaggctgaggacctggagcccacgggctcaccccacggctgtgcatccacctgcacttcctggagtcgccgccaccacggcgagcttctccgcactgctattgtgcgaggaaaacaacctgaagcttaagtgaggtagtcagacctctccattgcactaagcttacatttaccggcatttctgtgatgaaccaagtagttatttaagagaaaatgacagaggccaggcgcggtggctcacgcctgttatcccagcgctttgggaggccgaggcgggcggatcacttcaggctaggagtttgagaccagcctggccaacgtggtgaaaccccatctctgctgaaaaaaacaaaacaaaactgggcatggtggtgtgtgcctgtaatcccagctactcgggaggctggcaggcaattgcttgagcccaggaggtggaagttgcagggagctgagatcacaccactgcactccagtctgggtgacagagcgagaccctgtctcaaaaaaaaaacaatgacagagaatgggaagggctggtcctgaccccgctcagagctcaagcccctgatattggtgcgtttcctccatgctcctcttggggtctgtgcttactgtgtgttcactgtgtgtgtgttcagtgtgtgtgtgttcactgcgtgttcactgtgtgttcaatgtgtgtgtattcagtgtgtgtgttcactgtgttcagtgtgtgtgtattcagtgtgtgtgcactgtgtgttcactcttcactttgtgtgttcactgtttgtgttcattgtgtgtgtgcactctgcatgtgtgtgtgcatgtttatgtttaaacacatgtgccacatgtgctgcttttcctcctctctctcttaatatgtcacaagagcaactttccacgctgggtgtgtgaaagctcatgcggggatctgagacggcatttccacgcttgcatgcaggccctgggtcagtgcaggagggtctgagacgggattgccacgcttgcacacaggccccgggtcagtgcagaccctgggtcagcacaggctggtgtctaccccgagggccatcttgggccccgtctcccacagacctcacctttggcggccatgtggtcatctgggtttgtggcatccggtgagcagacctgggttgccactgacccaggggccacccagatggtgtggcgtgtctgcccccatcccctgcatgccgccatccatgcccccgtcccctgtgtgatgccatctgtacctccctgcagccctggagcagcagtgtgatgagcatcgtcgccgagccaaggagctgaagcacaagtcccagcacctcagcaacgtgctcatgacgctgacgccggtctccctgccaccgcctgtgaagcggccccggcttgcacgtgccacatcaggaccggccgccatggcctcgcaggtgctcacccagtctgcccagctggcgcttggcccgggcgtgcccgtcccccagctgaccagcgtgccccttggtaaagtggtgtccaccctgccgtccaccgtcctgggcaagggttcccttcaggcgccccccgccagctccccggcctccccgctgctcgggggatacacagtcttggcctcttccggctccacctaccccagcacagtggagatccacccggacgcgtccagcctcacggtcctgagcacggccgccgtgcaggacggtagcacggtgttcaaggtggtcagcccgctgcagctgctcacgttgcctggcctgggccccaccctgcagaacgtggcccaggcctcgcctggctccagcacaattgtgacagtgcccgcaggggctgcccccgggcctgaggagcacacggccaccattgaggtggctgccatggcagaggaccacgagcggaagtagccgacaggagggcgaggcccctgggacggacagggctggctgtctctcagccgcggcagcagggagcgggcagaggccgcagggctggctcgggcaggtgggtcacgtggtctgcagaaccaaagagaggaatcgccaaaacaaatcacgagaagagagaaggggacagaacagcgagagcaacctggaaaatcggtcttcaggtcccacgtttcctcccccttttttcttgggaaatatatttttccatctgttgcttattaatactgtttacacattgggccttgatcaggagccaggtgggcgggggctagggggagcctgggtgcagcagagacagaggaagcagagccaggtgccgagcgcgaccctgcaggtgctggacgcggtgcagcaggtcacgaggcccccatgtctgcacccagccaggtccctggggacgttactaactcatgacttgggagctaagcccaagtgtgaaacctctggatcctatggatttggtttcttcccacagttttctgtaggtttagtgtggctggcgccccgttctcctccagttgggaacatgcacccggagcttggggtgcagatcctgatgggtgcctgcctcccccgcccccagccggtgctcaggtggcccaggggccgcacagacgaggcgtggtccaggcattgttgcacatgtactgagggtgtttttaagtgaattgcttagtaggcttctaggaagagtcagatttatagcattttcaaccaaaataatggtgagtgcctaggcttcccgagttagctctttgggtggcccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgaccttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcatagtttgagtgtc

SEQ ID NO: 8544 - DNA, 2156 bp, Homo sapiens
cctggtgggaggatcatggccgttttagtcgttagtgctactgtaacaaaataccgcaggctggggggcttgcaagcaacagaggttcatttatgcagttctgcacgctggcaagtcggagatcaagagcatcagccgatttggtgcctggtgagggttttgaatcagccgattcggtaactcgtgagggttttgaaggtgtcctgcaaatcgctggaggacaatagtaagaacagcctgggccccaccttgacccgaggctggcgtcggaggcaccgccgctcacaggtaaggagacctctcagtggcacaggggcctgcgcccgccagtcaggagctcaacagactcacgcccaggggggccccttcctcccctctcccaggttcagtcccagagccttctcgtcaccaacgctgttcccctccctgctgccatggtccacccaaggccataggagcctgcacaccagccacaggccagcctcccagactcacggcccagcaagaggcagacatagaagtccacgctgtgtggtcactgggtgtggtggctcccgcctgtcatcctagcactttgggaggctgaggcgggtggatcacctgaggtcaggagcttgagaccagcctggccaacatggtgaaaccccatctctactaaaaatacaaaattagctgggcgtggtggcaggtgcctgtaatcccagctactcgggagactgaggcaggagaatcgcttgaacctgggaggcagaggttgcagtgagccgagattgcaccactgcacttcagcctgggcgaccagagtgaaattctgtctcaaaaaaaaaaaaagtccatgccgcgtggttccacttaggaaagttggacacgtccctcaaggcagaatggcatcgaaagccgggtcactgggtgccctccgggacggtggctggaggggcacagggcgctggttccaagagtccactctgaaacctgcccttctgccatggctgctcttccacgcttgtgccctgctgcagcccagagctgataaacgcacaggcatgtccttccagcacacattggcacgggaccaccctccccacaggtcatctgtcagctcctcagattccatgtgtacaagacagagctcctgcttcatattccctcccatgctctgtccccatcgtgccccgtcggggaggggagcaccaacacctgcccacaggctcagcccaccttcctgcaacctcacatccacgatgcatccccttcttgtgaggccaggccccctccatctctctcaggtcgatgtaactacccggttcccacctctggcccttcctaccctcctgctacccttccggctgtgacccttcccatttgctgacacgtcctgagcacccccatcattccctctgcccctggagggggctgcacccctcagtatcccaccatgatatctcctcctcctgatacttcatggggtttcagaggccacaagatacaaacctacaaggggtcatgtcttgtacccactgagtgtccccaggagccggtgcagcactggccactcctcagctgaggacacaggagtggggagtgggctgtggcctgtccagcccagggcactccagaaggcagagtccccacagagggtggagtgctttgtgacatgccactgtttggatgggccacagtataccattcagcgactgagggacatcttggtttcttccaaggtttggcaattatgagtaaagctgctgttaaaaaccctcgtgcaagtttttgtgtggacctaagctttcaactcatctgggtaaataccaaggggtgaaactgctagattgtgtggtaagaatgtatttcattttgtaagaaactactgaagtgtcttccgccagtggcagcaccatctcgcattcccacccgcaatgactgagattcctgttgctccacgtcctcacctgcaatgactgagattcctgttgctccacgtcctcacctgcaatgactgaggttcctgttcctctacgtcctcacctgcaatgactgaggttcctgttcctctacgtcctcacctgcaatgactgaggttcctgctccacgtcctcacctgcaatgactgaggttcctgctccacgtcctcacctgcaatgactgaggttcctgct

SEQ ID NO: 8545 - DNA, 289 bp, Homo sapiens
tgagggcgagccccacgggcgacagacgcagccgcagagctctcggtgggaaaacaagtcaagcagaaggatcaccttgtctcgctcctgacggtccagtcgaaagtgcttgttgagtacaatcgtaaatggacaagaggaggaaagtgttgaggatttgctgaaattgggtgacgggttcaagggatttgtttctgcgttgtttctcctttgtatgtttgacaacgtctgtgattaaaaatagccataaaatataaggcaggtacactttggctgtactagtgcgtat

SEQ ID NO: 8546 - DNA, 2157 bp, Homo sapiens
cctggtgggaggatcatggccgttttagtcgttagtgctactgtaacaaaataccgcaggctggggggcttgcaagcaacagaggttcatttatgcagttctgcacgctggcaagtcggagatcaagagcatcagccgatttggtgcctggtgagggttttgaatcagccgattcggtaacccgtgagggttttgaaggtgtcctgcaaatcgctggaggacaatagtaagaacagcctgggccccaccttgacccgaggctggcgtcggaggcaccgccgctcacaggtaaggagacctctcagtggcacaggggcctgcgcccgccagtcaggagctcaacagactcacgcccaggggggccccttcctcccctctcccaggttcagtcccagagccttctcgtcaccaacgctgttcccctccctgctgccatggtccacccaaggccataggagcctgcacaccagccacaggccagcctcccagactcacggcccagcaagaggcagacatagaagtccacgctgtgtggtcactgggtgtggtggctcccgcctgtcatcctagtactttgggaggctgaggcgggtggatcacctgaggtcaggagcttgagaccagcctggccaacatggtgaaaccccatctctactaaaaatacaaaaattagctgggcgtggtggcgtgtgcctgtaatcccagctacttgggagactgaggcaggagaatcgcttgaaccaggaagtcagaggttgcagtgagccgagatcacaccactgcactccagcctgggcgacaagagtgaaattctgtctcaaaaaaaaaaaaagtccatgccgcgtggttccacttaggaaagttggacacgtccctcaaggcagaatggcatcgaaagccgggtcactgggtgccctccgggacggtggctggaggggcacagggcgctggttccaagagtccactctgaaacctgcccttctgccatggctgctcttccacgcttgtgccctgctgcagcccagagctgataaacgcacaggcatgtccttccagcacacattggcacgggaccaccctccccacaggtcatctgccagctcctcagattccatgtgtacgagacagagctcctgcttcatattccctcccatgctctgtccccatcgtgccccgtcggggaggggagcaccaacacctgcccacaggctcagcccaccttcctgcaacctcacatccacgatgcatccccttcttgtgaggccaggccccctccatctctctcaggtcgatgtaactacccggttcccacctctggcccttcctaccctcctgctacccttccggctgtgacccttcccatttgctgacacgtcctgagcacccccatcattccctctgcccctggagggggctgcacccctcagtatcccaccatgatatctcctcctcctgatacttcatggggtttcagaggccacaagatacaaacctacaaggggtcatgtcttgtacccactgagtgtccccaggagccggtgcagcactggccactcctcagctgaggacacaggagtggggagtgggctgtggcctgtccagcccagggcactccagaaggcagagtccccacagagggtggagtgctttgtgacatgccactgtttggatgggccacagtataccattcagcgactgagggacatcttggtttcttccaaggtttggcaattatgagtaaagctgctgttaaaaaccctcgtgcaagtttttgtgtggacctaagctttcaactcatctgggtaaataccaaggggtgaaactgctagattgtgtggtaagaatgtatttcattttgtaagaaactactgaagtgtcttccgccagtggcagcaccatctcacattcccacccgcaatgactgagattcctgttgctccacgtcctcacctgcaatgactgagattcctgttgctccacgtcctcacctgcaatgactgaggttcctgttcctctacgtcctcacctgcaatgactgaggttcctgttcctctacgtcctcacctgcaatgactgaggttcctgctccacgtcctcacctgcaatgactgaggttcctgctccacgtcctcacctgcaatgactgaggttcctgct

SEQ ID NO: 8547 - DNA, 289 bp, Homo sapiens
tgagggcgagccccacgggcgacagacgcagccgcagagctctcggtgggaaaacaaatcaagcagaaggatcaccttgtctcgctcctgacggtccagtcgaaagtgcttgttgagtacaatcgtaaatggacaagaggaggaaagtgttgaggatttgctgaaattgggtgacgggttcaagggatttgtttctgcgttgtttctcctttgtatgtttgacaacgtctgtgattaaaaatagccataaaatataaggcaggtacactttggctgtactagtgcgtat

SEQ ID NO: 8548 - DNA, 2156 bp, Homo sapiens
cctggtgggaggatcatggccgttttagtcgttagtgctactgtaacaaaataccgcaggctggggggcttgcaagcaacagaggttcatttatgcagttctgcacgctggcaagtcggagatcaagagcatcagccgatttggtgcctggtgagggttttgaatcagccgattcggtaactcgtgagggttttgaaggtgtcctgcaaatcgctggaggacaatagtaagaacagcctgggccccaccttgacccgaggctggcgtcggaggcaccgccgctcacaggtaaggagacctctcagtggcacaggggcctgcgcccgccagtcaggagctcaacagactcacgcccaggggggccccttcctcccctctcccaggttcagtcccagagccttctcgtcaccaacgctgttcccctccctgctgccatggtccacccaaggccataggagcctgcacaccagccacaggccagcctcccagactcacggcccagcaagaggcagacatagaagtccacgctgtgtggtcactgggtgtggtggctcccgcctgtcatcctagcactttgggaggctgaggcgggtggatcacctgaggtcaggagcttgagaccagcctggccaacatggtgaaaccccatctctactaaaaatacaaaattagctgggcgtggtggcaggtgcctgtaatcccagctactcgggagactgaggcaggagaatcgcttgaacctgggaggcagaggttgcagtgagccgagattgcaccactgcacttcagcctgggcgaccagagtgaaattctgtctcaaaaaaaaaaaaagtccatgccgcgtggttccacttaggaaagttggacacgtccctcaaggcagaatggcatcgaaagccgggtcactgggtgccctccgggacggtggctggaggggcacagggcgctggttccaagagtccactctgaaacctgcccttctgccatggctgctcttccacgcttgtgccctgctgcagcccagagctgataaacgcacaggcatgtccttccagcacacattggcacgggaccaccctccccacaggtcatctgtcagctcctcagattccatgtgtacaagacagagctcctgcttcatattccctcccatgctctgtccccatcgtgccccgtcggggaggggagcaccaacacctgcccacaggctcagcccaccttcctgcaacctcacatccacgatgcatccccttcttgtgaggccaggccccctccatctctctcaggtcgatgtaactacccggttcccacctctggcccttcctaccctcctgctacccttccggctgtgacccttcccatttgctgacacgtcctgagcacccccatcattccctctgcccctggagggggctgcacccctcagtatcccaccatgatatctcctcctcctgatacttcatggggtttcagaggccacaagatacaaacctacaaggggtcatgtcttgtacccactgagtgtccccaggagccggtgcagcactggccactcctcagctgaggacacaggagtggggagtgggctgtggcctgtccagcccagggcactccagaaggcagagtccccacagagggtggagtgctttgtgacatgccactgtttggatgggccacagtataccattcagcgactgagggacatcttggtttcttccaaggtttggcaattatgagtaaagctgctgttaaaaaccctcgtgcaagtttttgtgtggacctaagctttcaactcatctgggtaaataccaaggggtgaaactgctagattgtgtggtaagaatgtatttcattttgtaagaaactactgaagtgtcttccgccagtggcagcaccatctcacattcccacccgcaatgactgagattcctgttgctccacgtcctcacctgcaatgactgagattcctgttgctccacgtcctcacctgcaatgactgaggttcctgttcctctacgtcctcacctgcaatgactgaggttcctgttcctctacgtcctcacctgcaatgactgaggttcctgctccacgtcctcacctgcaatgactgaggttcctgctccacgtcctcacctgcaatgactgaggttcctgct

SEQ ID NO: 8549 - DNA, 289 bp, Homo sapiens; identical to SEQ ID NO: 8547

SEQ ID NO: 8550 - DNA, 1773 bp, Homo sapiens
gttttggtttgttttaatcctaagttttgcattgagcaagatactctttttcctcttttctaagtctaacatctgtgggtttgcttttcagccatagtattgattacatgttaagtcttagctctctaagtcgttgtaagctttatgtgtactggctttgttctttgattttatttcatgggaaatacaaacaattcagtgcataaataaatactggaagaagttgagttgaattgcagacactaatagtcgcagcagtgtcattagtgctgcatccgaagacacctcaccagggccctccagcgtcctggcttgtttcgctggtcgccatggttgttagtgcagacataagctttgtgaggctgactgatggcagatggagggacccggctgctccccactctaacctctagcataaggaagctggctggaggataaatgggttaagcatgctttaatgtacatttaatgtacatttctattctcaaaacatgttgattatttttttgccttgatgaaaacaataatcctataaaatattaattgcctgctttagaaggaaaacttctgaactggaagcaactttcgttagctatagacctttaatgaaggcagaatttcttatataaaaaaggagctaggaaagtagaagtgtaaatagaaatatagtttatcaacattactatccacttctgatgtggacattaaagggatattaatcttttaagtccagagactctcctaggtaagtcttatgacccctcagcttaaatctcttgcccagccctctcccctgaactcccaagttgtgtttctgtctgctgacttggcgtcactgatggatagctcagacctgtcatggcacaaaactgaattcctgaccattcccaaactgttctccccacggtcttcccaggttcattagtggcaaatccttccttccatttggccgcctgagatcttaaaagtaatccctgattccatacccaacatcccttgagtcaacaagttgttttgtttctgacttcagactagaacaagaaccttccacctctgagctcctcttctgcttccactgtagcgcaagacctctgaggtagaagttcagccccacagggcaagcacttctctctgtttcgttcatcactgattctcctgtgccaggatcagtgcctggcacatagtagggatacaataaatatttgcccaatgaatgaattcagaaactgactttaagtatataatgttaaactataaattgcacttgaatgattaaaaatacaattttatttctaagcaggactagaattttaagtaattttggaactctagtttgtcatcttgctaataacattatctaccatttataacctgctttccatatgccaggtactgtttaaggtgctataatacttaattctcaagacaaacctagcagataagaagaattttatagacaagaaaactggccgggcgtggtggctcacacctgtaatcccaacactttgggaggctgaggcaggcggatcgcctgaggtcaggaattcaagagcagcctggccaacatggtgaaaccttgcctctactaaaaatacaaaaattagccaggcgtagtggcacatgccattagccccagcttctcgggaggctgaggcaagagaatcgcttgaacccagcagacggaagttgcattgagccaagatcgtgtcatagcactccagcctgggtgacagagcgagactccatctcaaaaaaaaaaaaaaagaaaagaaa

SEQ ID NO: 8551 - DNA, 576 bp, Homo sapiens
tttttttttaattttttaattttttttcttttttcttttttttttttttaattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttagcaagcatgctgccttcaagcatctgtttaacaaagcacatcttgcaccgcccttaatccacttaaccctgagtggacacagcacatgtttcagagagcaccgggttgggggtaaggtcacagatcatgttttcatttatctttaagcagaaattactttagcttcccttagtgtgtggtgttgcttagtgatgttaatctggatgttcaggtaggcttttattgtctttctgaaagaatcagtaatttaactgagtattttggaaataacaataccacaccttttcatagagcttaacagtttataaagcattgcactccatcttctcatcactggatc

SEQ ID NO: 8552 - DNA, 4131 bp, Homo sapiens
agtcttgctggaatgagtacctgacaactcggatcgagcagaaccttgttttgaattgcacctgccccattgccgactgccccgcccagcccaccggagccttcattcgtgccatcgtctcctcgccagaggtcatctccaaggtatcccctctcgtctgagagaggctccagtgcagagccaaaggagtgtgccccagggagtgggctgagctatggggtgctgggggcctggaggtgtggcatcctggagagccataccctcacctcgtggcacctgcgtctccacagtatgagaaggcgctcctgcgtggctatgtggagagctgctccaacctgacctggtgcaccaacccccagggctgcgaccgcatcctgtgccgccagggcctgggctgtgggaccacctgctccaagtgtggctgggcctcttgcttcaactgtagcttccctgaggtgggagccccacactggccctgaccctgagcaaggattcacactccttccctgcttaatatccccaccccgccacacacacagactgtgacttgtccttcctcagcctctgccacccagttgagctctgttcctcttcctggagccctccaaatgtgatctgtgcctgctcccctctctcctgtgcacaccagccatgctgccctcacggctcagctgtgtccccaccatgccctcttgccttaggcacactaccctgctagctgtggccatatgtctcagtgggtcgacgacggtggctactatgacggcatgagcgtggaggcgcagagcaagcacctggccaagctcatctccaagcgctgtcccagctgtcaggctcccatcgagaagaacgaggggtgcctgcagtaagaaggggggtactgtggggagccagagggcaaggaggggggaggaggcctggcagaaggaggggggaacgggcttagtgtaaagctcagcaaaagagggtggttcctcagccgcccctcacgtggcagcctccacggtgacttcctggatcttaatgttccttctcccactcgtaagtccacactgactgggggagttcaaaagcagaggtgcattcagcagggctgggtatgactaaggagactatcagggcaggagcagaggccacagcatcaacagcggtacatctgggcccttggcattcctggcacacccctgcccagaggcaggagtccctgaccagccagcttcctccatagcatgacctgtgccaaatgtaaccatggattctgctggcgctgcctcaagtcctggaagccaaatcacaaagactattacaactgctctgccatggtaaggcgctgggcactaggggagggcagaggcccagagccgtcggggaggggtgctgctaccaggtcctgggcagacagggctccttgtgcagtgcagcattctagctgttgggatagaggctcactgtggggaagacagagccacctgggcctgcagatgctggaaagtctgttcacagggaccttcagctccagaacaggacttctcataccgaggtggctacagaaaggctggggagggctgggcactctcagaaggcagcagggcagagcaggaaagagcagggaccctgcatttagagcctggctctgctgcttagcatgtggctttgagcaagttcatttacttctccaagcctcaacagcctctgcaaaaggggtgaataatatgacctactccacacagtcatgaggactgaatgaagataatcgggggaggtgtagaaaggcctccgtgaatgttggcttttccacttattaactccctcctgtccaaacaaaacacccaatagccctcccaacgtatccttgctaggtaagcaaggcagctcgccaggagaagcggtttcaggactataatgagaggtgcactttccatcaccaggcgcgggtgagtcgggaggaaacagcgggtagatgcctgcagaagcaggttggggtggtggggtggaggggggtgggctgaaggtctgaccgggcaggtggtgctgcgccacctgtgctggtactgatacaccttcctccacacaggagtttgctgtgaacttgcggaaccgggtgtctgccatccatgaagtgcccccgcccagatccttcaccttcctcaatgatgcctgccagggactggagcaggctcggaaggtggtagcgggtgggggaagagagcaggggaggggtgtgccaaatgggtctggggggcttggctgctttcatcggacttgcctgggtgaagggaatgaggagagggcaggcgggagagctgatgggagcccctgcaggtgctggcctacgcctgcgtgtacagcttctacagccaggacgcagagtacatggatgtggtggagcagcagacagagaacctggagctgcacaccaatgccctgcagatcctcctgggtgagccacccctgccagccaggccctcctcctgcctcctcccctctgttgcacagcccggcccctcccagacaggtcaagcggcacccttaccttccctctctcctcttcctcttcattcttcatggccttctcactgcctggctgttaaagctcaggtcgaaagcctacattgtaaggtgcccaagggcgcagatgttcgtggatgtttcttggtttctggtctttaccctgctcccctagggagcttcatgagaatgtctagagctgcacctggtgcttggtagacgttccataggtgtttgttggaggaaggaatggatgagaatgagaagggagggagcctctgtgcctgccccctctgcagaggaaaccctgctgcggtgcagagacctggcctcctccctgcgcctcctgcgggccgactgcctcagcacgggcatggagctgctccggcggatccaggagaggctgcttgccatcctgcagcattctgcccaggtactgcccggcccagaccccttctgctcctgcattctgcgggagttgaggtcctcctgtcccagcacagcccctgccctggggcgagtccagaaggaaaggcagcaaagcgggtgaatggatgttagacctgggcgcacatcccggcttttgggccaacctgcctgatgctgctggaccctatcacttcacctcctggggattcctacaaaataaaggggttggctagcccacatcaagggtatttggtcaggtgcctatcagaatcacttggggaacttttccagactgtacttcccagatagggatttgaaatcctaagagtgggcatcaggggattggggtcactggagcaagggctctcccaggctctctccagctctaatgcactgatgctgagtctaaactgtgagtcctgtcctcaggttgcttactgactggtaagtcacatgggcagaaaagacatagattctgtaagctctttaagcacagggtcgtgtgcctcacctggtaccccgtatccctggagaccatctgtgggtgaactcacaaaggcagtgtttcatgaagtgctgtgctgggaggggagcagtcctagcaggagcttggccctcccagagcatcagtggaaggaatgctgggtccaaaggccccatgccctctacctccttctcaaatccttctgtctgctcaccaggatttccgggttggtcttcagagtccatcagtagaggcctgggaggcaaaaggacccaacatgcctggcagtcagtaagtggggtgggcagagccatggaggaggcagtgggacatggcagcctcctctgggctgagtgtggtggctctccctaggccccaggcctcctcagggccagaggcagaagaggaggaggaagacgatgaggatgatgtgcccgagtggcagcaggatgagtttgatgaggagctggacaatgacagcttctcctacgatgagtctgagaacctggaccaagagactttcttctttggtgatgaggaagaggatgaagatgaggcctatgactgagggggcagatgcaggaaacacctagagcagccccagagtcacggggctgagggggcgggagctgcccctgtcatagggagggggattcccagcgtctgtagtgcttcctgtttgctgaataaaggtctctttctcacacaca

SEQ ID NO: 8553 - DNA, 4131 bp, Homo sapiens; identical to SEQ ID NO: 8552

SEQ ID NO: 8554 - DNA, 107 bp, Homo sapiens
caagtcagttttgtagagaagaggctgggtctgttggaggcataagtcagagacaggagcatccggacggtcattggagataagccactggagctgggaggagagac

SEQ ID NO: 8555 - DNA, 300 bp, Homo sapiens
cccaactctttttttttttttttttttctgagagggagtctcgctctgttgcccaggctggagtgcagtggcgtgatctgggctcactgcaagctccacctcccgggttcacgctattctcttgcctcagcctcctgagtagctgggactacaggcgctcaccacctcgcccggctaattttttgcatttttagtagagacggggtttcaccgttttagccaggattgtctcgatctcctgacctcgtgatccgcccatctcggcctcccaaagtgctgggattacaggtgtgagccacc

SEQ ID NO: 8556 - DNA, 107 bp, Homo sapiens; identical to SEQ ID NO: 8554

SEQ ID NO: 8557 - DNA, 272 bp, Homo sapiens
tttttttttttttttttctgagagggagtctcgctctgttgcccaggctggagtgcagtggcgtgatctgggctcactgcaagctccacctcccgggttcacgctattctcttgcctcagcctcctgagtagctgggactacaggcgctcaccacctcgcccggctaattttttgcatttttagtagagacggggtttcaccgttttagccaggattgtctcgatctcctgacctcgtgatccgcccatctcggcctcccaaagtgctggga

SEQ ID NO: 8558 - DNA, 90 bp, Homo sapiens; identical to SEQ ID NO: 7549

SEQ ID NO: 8559 - DNA, 118 bp, Homo sapiens
acctgagaggcagaggttgcagtgagccgagattgcaccactgcactccagcctgggtgacagagcaagactccgtcgcaaaaaaaaagaaaaaaaaaaagaaaaagaaaaacagaaa

SEQ ID NO: 8560 - DNA, 162 bp, Homo sapiens; identical to SEQ ID NO: 6214

SEQ ID NO: 8561 - DNA, 129 bp, Homo sapiens; identical to SEQ ID NO: 7645

SEQ ID NO: 8562 - DNA, 909 bp, Homo sapiens
ttttttaatccaatgcaaatataattttacagatgagaaatgattttgcctgcagttatctgcttccaaattagaatgtatttttaatttctgatgagtcacttttcgtgtgtaatactcattttgactggtattaggtggcatgggttggtttttagtcaattccagaatatcttcttacattgttttaatgtaaagaaaatgaaaatttgatgcttctgatctttcctaatacctctatttagagcaagatggagtatctgtctccttggatcctttatatgtctagctacattgtggatgtttgatagaaataataccatgcagtatagtctccgccccgacactgaaaaaaaaaaggagggaaagtatgtagaataaaaagacaaacagtgtaacgagctttattttataacactggaacattgaacttatctgttgaggtggtactaagtaacataacaacttcaaaaacctggacccggcaggcagctaatttagctacttgaaaatcactggggaaaaggaaatagatgctaagattactgaaaccagcttaacacctgccaagttacatcgcttttaaaaaatgctaggaaggcccaggcacggtggctcacacctgtaatcccagcgctttgggaggccaaggtgggcagatcacaaggtcaggagattgagaccatcctggccaacatggtgaaacactgtctatactaaaaataaaaaaaattagccaggcacggtggcatgcgcctgtagtcccagctactcaggaggctgaggcaggagaatcgcttgaacccgggaggcggaggttgcagtgagccgagattgcaccactgcactccagcctgggtgacagagcaagactccgtctcaaaaaaaaaaaaaaaaaaaaatcccagg

SEQ ID NO: 8563 - DNA, 193 bp, Homo sapiens; identical to SEQ ID NO: 7690

SEQ ID NO: 8564 - DNA, 136 bp, Homo sapiens; identical to SEQ ID NO: 6219

SEQ ID NO: 8565 - DNA, 138 bp, Homo sapiens; identical to SEQ ID NO: 7715

SEQ ID NO: 8566 - DNA, 3098 bp, Homo sapiens; identical to SEQ ID NO: 7763

SEQ ID NO: 8567 - DNA, 368 bp, Homo sapiens; identical to SEQ ID NO: 6222

SEQ ID NO: 8568 - DNA, 338 bp, Homo sapiens
aagacatccaacaaaactggccattactttatacttctaggtctcagtagatacaggagaggtaatttggccatgggagaaagaaacaaagtaatagaatatggaagaaaatgaggattgtgaaagagtaattcgcatttagtagacccctaataaatactggttgaatgaatgaacaaaatgaaagagaaacatactagaaaatagattgggctgcagcggagacttacatctggaaatatcctgttgtggtattgggtcaagtattaaatactggtgtgcttattttagccaggacataatttcgccactgatatagtagggaccgccaaaggggg

SEQ ID NO: 8569 - DNA, 2894 bp, Homo sapiens
tgctctgagatttgacatgaacacaaagttgctagatgctcttgttgacttccagcagatgggatgggggatatacagcagttcttggtaaagtcctttgtaataattgattttttttatttcgagagaatctttcattttcctgtgtatgcttttttccttttttgtccagtttccttatcacttgctgtagatggcttattttgcattcatgcagactatgttgcaagtctgtttcatctagtaaactgaaaattattgcttaatcaaactgtcatttgtcttttatatttaaggcctttcccccctttcttatgagttctaacttagtaatttcaaatgtgaccttttatatctaagaccagtatagtaaacttagcccacagtggcaaatgatgagtaatatcattgtaatatgttccagttgcacctcagtatgttaaacaggtaatgtaagaagttctctgaaatgtcagcaaataagttctgaaacatacatcatgcacgagcaggaataaaacccaagttccccataacgtagctaacttaacactgcataaaaatatgaaagtgtaacccatgaaggacacactttttttttccactgcaaagtagtcactttgctgtttttcctcttttttaaactttaaaaaaacactcttcccagaaattggagcaataatggggtacaccacacatagattaaatatttgtagatattttaagtgacttttgggcaaaactagaatgtatacttttaccttgttacaaacgcctaagaccagtaatttaaaaattactaacaggtttactttgttcattaataaagcatgtaaccattcaaattatatgcaccttttacctagttgaaaaaaatacacattcctgttttcacattatagcaactgattaagctgaagctataagtcattttttatagatgtgtgatccacacctccatcaattagaacactgaaaaatatgttttataaaaaaggtatttaattttgtttgtaggattaactcatgcaaataataaaaaagataccctgttggttcaatagtacactgtctcctttaaggaaggaagcatgatgaatgaatgatgtgtagacttgagggatggactattaaagtggatggaggatgaggacaaagaacctacagattacaatgaatgtaaacttaatttttcttcatgtgtaagcagtgtgctcgctgatgatatctagatcctaacaagattacttggttagctggctaggaccagtaactggattgcaaccactatgataatattttgaaccaaatgttaatgcttgatgcagaattgtaaagcagcatctggctcctatatagccttaaggaataattttagtgatcctcaaggaattaaatagggaatttaagaaatgtagactgcaaaggcagtatacaggaaaaggtggagtgggttttgtttatgagtgtgtctgaaaactaaaattaagcgggacatcttggtatagttggacagtattggtccttcacgctttggccatattgtataatggagcttttaccaaagacgtatgagaagtgtaagactataaaaaaaatgaactatttaaagtaaaactcttgacaaacattttacttaaagcagatgcaaaaggttattctcatgtaggctcctgttggtgcagagggatttttgatttcaagatgcaactaaagtacgaagttctcagtttcactttagtagaaatagttctagaaataaggctaataaacacatctaagaacactggttgctttctaaaattcccaaagttccaccataaatgtaatccttagtgttttaaatgattgcattttaaggtatataaatatgggttatccaacatcaatgctatagtaacatcctgaaacaaaacaagcacaaaggtataaatgcctaaaccggaggaaacttgaaaccctcatgttaaatcttttttttttttttttttttttttgagatggagtctcgctctgttgcccaggctggagtgcagtggcgcgatctccactcactgcaagctctgcctcccgggttcacgccattctcctgcctcagcctcccaagtagttgggactacaggggcccgccaccacgcccggctaattttttgtatttttagcagacacggggtttcaccatgttatccaggatggtctcgatctcctgacctcgtgatccgcccgcctcagcctcccaaagtgctgggattacaggcatgagccaccgcgcccagcccatgttatatcttcaatgtagtatttctaacttgtgaagacagattggtaggcagccacttttttgtgtcttaaaataactgggagcatagttaaaattttatacatcaagtgattgctattattgaatgttgcaggtgagatgtggttatttttagtttatttgaaatgtctgactggaaatgggggagggggaaggaaatatttgaaatttggaaaactctaaaccttttggtaagaaattgtaattttcacttaaaattttctttaaggatataagaggtttataattgatgtagttaaattgaacaataatcattggtgactggagcaggtaattatagcctgcagaaaaaaattataatctaagaattgaaaaaataagatcctgaagttgtttaattgcatcagtttctgtatttatgtgaatttataaactgcagtatgttttgaatgaggttaatcttgtttaatataagtaaatgagtctgtagactatgatcgccccaaactaaaaagtacagtacctgaaactgtgttctttatggttgtagtgttagtaaagcactaatatgcagaaaataaaggaattacacagtgaaaaaaaaaaaaaccaa

SEQ ID NO: 8570 - DNA, 2673 bp, Homo sapiens
agttactgttctacagtttggcggggacggggcttgggggttttctcttttgtttgtttccctttctttttccttttttttttttttttttttgttggctttgcgttaggatgctctgatctgacatttgacatgaacacaaagttgctagatgctcttgttgacttccagcagatgggatgggggaaacacagcagttcttggtaaagtcctttgtaataatagtttgatttttttatttcgagagaatctttcattttcctatgtatgcttttttccttttttgcccagtttccttatcacttgctgtagatggcttattttgcattcatgcagactatgttgcaagtctgtttcatctagtaaactgaaaattattgcttaatcaaactgccgtttgtcttttatatttaaggccttccccccccttccttatgagttctaacttagtaatttcaaatgtgaccttttatatctaagaccagtatagtaaacttagcccacagtggcaaataatgagtaatattgtaatatgttccagttgcacctcagtatgttaaacaggtaatgtaagaagttctctgaaatgtcagcaagtaagttctgaaacacatcatgcatgagtaggaataaaacccaagttccccataacgtagataacttaatgctgcataaaaatatgaaagtgtaacccatgaaggacactttttctttccactgcaaagttagccactttgctgtttttcctcttttttaaactttgaaaatagactctttccagaaattggagcaataatggtgttaccacacacagattaaataatttgtagatattttaagtgacttttgggcaaaactggaatgtatacttttaccttgtttcaaacacctaagaccagtaatttaaaaattactaaaaggtttactttgttcattaataaaacatttaacaattcaaattatatgcaccttttacctagttgaaaaaaatacacattcctgttttcacattatagcaactgattaagctgaagctgtaagtcattttttatagatgagtgatccgcatctccatcaattagaacactggaaaagatgttttataaaagaggtatttaattttgtttgtaggattaactcatgcaaataataaaaaagatatcctgttggttcaatagtacactgtctcctttaaggaaggaagcgtgatgaatgaatgatgtgtagacttgagggatgactattaaaggggacgtaggatgaagagaaagaacctacagatgacaatgaatgtaaacttatttttcttcatgtgtaagcagtgtgctcgctggtgatatccagatcctaacaagattacttggttagctggttaggaccagtaactggattgcgaccactatgataatattttgaaccaaatgttaatgcttgatgcagaattgtaaagcagcatctggttcctatatagccttaaggattaattttagtgatcctcaaggaattaaatagggaatttcagaaatgtagactgcaaaggcagtatacaggaaaaggtggagtgggttttgtttatgagggtgtctgaaaactaaaattgagcgggatatcatggtatagttggacagtattggtccttcacactttggccatattgtataatggagcttttaccaaagatgtatgagaagtgtaagactataaaaaaatgaactattcaaagtaaaactcttaacaaacattttacttaaagcagatgcaaaagggtattctcatgtaggctcctgttggtgcagagggatttttttgatttcaggatacaactaaagtacgaagttctcagtttcactttagtagaaagagctctagaaatgaggctgataaacacatctaagaacactggttgctttctaaaatttccaaagctccaccataaatgtaatttttagtgtttcaaatgattgcattttaaagtatataaatatgggttatccaatatcaatgctatagtaacatcctgaaacaaaacaagcacaaaggtataaatgcctaaactggaggaaacttgaaaccctcatgttaaatcttaaatgtagtatttctaacttgtgaagacagattggtaggcagccatttttttgtgtcttaaaataactgggggcatagttaaaattttatacatcaagtgattgctattattgaatgttgcaggtgagatgtggttatttttagtttatttgaaatgtttgactggaaaggggggagggggaagcaaatatttgaaatttggaaaaccctaaaccttttggtaagaaattgtaattttcacttaaaattttctttaaggatataagaggtttataattgatgtagttaaattgaacaataaccattggtgactggagcaggtaattatagcctgcagaaaaaattatctaagaattttaaaaataagatcctgaagttgtttaattgcatccatttctgtatttatgtgaatttataaactgcagtaagttttgaatgaggttaatcttgtttaatataagtaaatgagtctgtagactgtgatctccccaaactaaaaagtacagtacttggaattgtgttctttatggttgtagtgttggtaaagcactaatatgcagaaaataaaggaattacacagtgcag

SEQ ID NO: 8571 - DNA, 754 bp, Homo sapiens
cggcggcgttgttggctgaggggacccaggacacctgaatgcccctggccccagcttctctgacgcgatggggaaagtgctatgcaaaatcttcgggaacaaggaaatgtggatcctcatgttgcgcctggatgcggccggcaagacaacaatcctgtaaatgttgaagctgggccagtcggtgaccacaattcccactgtgggtttcaacgtggagacagtgacttacaaaaatgtcaagttcaacatatgggatgtgggtggccaggacaagatccgcgctctcgcggcataactacactgggacccaaggtctgatcttcgtagtggactgtgccgactgccaccgcaccgatgaggcttgccaggagctgcaccacattatcaatgaccgggagatgagggatgccataatcctcatcttcaccaacaagcaggacctgcccgatgccatgaaaccccacaagatccaggagaaactgggcctgacctggattcaggacaggaactggtatgggcagccctcctgtgccacctcaggggacggactctgtgaggggctcacatggttaacctctaactacaaatcttaatgagcattctccacccatcccctggaaggagagaaatcaaaaacccattcacaggattatcgccaccatctcctctttcaattgccacttttcttttgaatttgaactctggagttactgttctacagtttggggggagagggcttgggggtcttctgttt

SEQ ID NO: 8572 - DNA, 101 bp, Homo sapiens
tgagacggagtctcactctgtcccccaggctgcagtgcagtggtgcgatctcggctcactgcaagctccgcctcccgggttcacaccattctcctgcctca

SEQ ID NO: 8573 - DNA, 424 bp, Homo sapiens
gttgctttgccaaacaaaagttgccagactagactagtgagctgaacaggcaaggaacacagaggtgagatcaaggaaggcagaacaagaatggagcgggatttaggaattaaagcaaatctgcaattaaatataactgaagtaatggtaaatttcaagagaactagactgtaagaactaacctcacattgtgggaaaataaaaattttaaccttttccccctttatttgaaatgttctatgactacttgaaagaatttaaaaatgaaagtatttgtcagttttgtccttgaatatctttcatttgtcatagaatacatattttgtccatagtattttgttttataagtgtgagggtagatttttttattgagagcctactaatatgcctggcactgttgaggtgcaggagatcgacagtgaaa

SEQ ID NO: 8574 - DNA, 1690 bp, Homo sapiens
gcctacctcctcctcaccagctacctggcaacttttgacttgttccttagaactctctttagttgtggtcaagtcatgaagcttttcctgccccggcctctctctgcagcgagagttaggggacttctcttttgcatcttcattgcactcagacatctggtactctgtgattatcacacttattaatgctctcaagatagagataaaatcttattcatctttttgctctcaggcattagcacatggggagttctcagaaaatacctgtcttataccaggaattaatgaataatcagtaggaatgagcatgacatgttcatgggacgttggagggtagtgcatggctgcagaggagaatgggaaatgaaggtcagataagttacgtgagggatctctaaggccaagagaagccatttaggtttgatttggttggaaaatgagcttattgaaagtttaaggcaagggactagcatcatgaacacatctttttagggaagtgtgtcttgtggtaagctgctggctggtttaaatgcagcagaatattccattggggatgccagctgggagacttgccacagttgcagcctgcagcagaaagaccctgggccagaatgggttgtgccatctgtcaccagatattgccaaggtagatctggctgactttgtgggacagcttgtttctcaataatcactttgcaggcactcttgaggctgtgagcatgctcccagaagatagcattacttctctctcagagcaggctcctttctaaggaaatgcaagtctaggcctgccctgctgtaatcttcatgtggaaacagcactctagcaaagaacaaggaacctgatgagcttttcaaaggaaaatcgagtagatacaggaaaccaagaattttctaatgagcagatagaaaagagcaggtaggtgagaagttggtattagaaaaattaaagatttgaagggcttgaggacagagatgattgttggatgtttcatttttccaggcaaaatatgtggagcaaataatcaaatgacatggacttaccccacaattagggacggagatgaggaagggttaggaatagtttctgttagaatggtagggatggaagacaattgaaaattaaagagaaaataaatggagaggaaatctaggcagcagccattcttcattctgggggaaggtggtcaggaaaaggaaggaagaaaaatgtatagcatagtagctagagtggtccggcgtgatcaaagtgttttcaatatcatgttgactgacctgtttacgtttgaaggcagagaagatagagccagtagaaggagagaaaaatcaaagctgttttacggagttgtgaaagagctggataaggacaagactaaatgagttatttttaggccaggcgtggtggctcatgcctgtaatcccagcactttgggaggccaaggcaggtggggcacctgaggtcaggagttcaagagcagcctagccaacatggtgaaaccctgtctctattaaaaatacaaaaattagctggacatggtgcatggtggcaggtgcctgtaatcccagctactcaagaggctgaggcaggagaatagcttgaacccggggggcggaggttgcagtcagccgagatcatgccagtgcattccagcctgggcgacagaacgagactccgtcaaaaaaaaaaaaa

SEQ ID NO: 8575 - DNA, 6249 bp, Homo sapiens
aggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttggtaagtacaattttagcaatgttatatatggctggaagtcacttccctatgaataatcatcaaactctgttgtcattgatgactttcaagttgtggttaatggaatatttgtttttaataatgttttaataaatattttattttaaagatcaaggcttattaatataaattacggtatcccttaaaagaagttgatagtaattccttactgtcatcagtagtcagtgtttattgcattatatcttgtaactggtgttttacagttggtttgttcatatcaggatctaaagtcttcacattgaatttgcttaatatgtctcttaggccttttaatctacaacagtctcctcccacctcttttttacctactatttgttgacaaaccaggtcatttgttccctagaattttccacattgtagatattgcttgttttatccccagggtgtcccgtaatgtgttcctctgtctctaatatttcctttaaaatgttagcaacagaggcttaatcggattcaggttcagtacttttggcaagaatgtttcattaggtggttctgtgttctcctgtggagtcacatcccatctcaggctggctggctgtgtctctctcattgtaatcctgacgaccagtgggcttagagggtgtcaacctgatccacccagtaaaagttcccctcttatatcatggtttgagctcccaaaaatagttttgcactgggagggaggatcattgctcagatcgttatttcactaaggattgctattgttcaccttctaattctatcatctttctgcttttatcgaacttttctctcaccagctctttagtgccctgtaacacagttcgtacaagaaaagcaatataaatatctacattttctcctttacttaacatttttccaaatagtgagctggttccctaggggatcttctagaagtgactaggaatttgtttttttaatttgtttaatgtcatttagttattatgaattttttggaatgccttattttaaggtcattgaagtcctcattagttcacgcacataagcagctttttagaaaaaggaagaaaagcactactgtgttattactggttaatccagtaccaggaacttctagtacagttctagaaaggtgctttgcagcatgtagcttgtatcttttgcttcccctggaatttaagcttcaaggccagcacactctggtatatgtgctgagaaacatgtgatggggctgcccagccacgtcggggaaagaaggaagatgtcttgaggtgcagtgagcttgcccactagtaattattgtctgatcagtgtcctagagtctgactgtgccttttaggcatggggaaaggtagaagagggacttaagaagagagctaaagctcctggtagatttgtggggttttcttttgtttgcctggtgtccttaaccatagcctgtcaagagaacaaaggtggatatatttttcagtgaacacatacatgtttaatagtcattctggaaaatatttctaataccttctttggaattttctcatgctataaatttagatttttaagaattggtcatatcgcaccaattttagactaagaggtgtaggatcgtcactgcccccccatggtgcccaccatgtggctactaagtggggtgcacattaaatgcggacaacttgcttaattatttatagggtctgcaggagcacactattcctgcttttagcacagcactcatataattttttttttcccctccagccttccagaatacattgtagtgccaagttctttagcagaccaagatctaaagatcttttcccattcttttgttgggagaaggatgccagtaagtgatttctgttggattttatgaatgctgacgtccattgtttctacacagtgaagtaaggattctacctctcccctagctctggtgctggagccactctaacggcagtgctcttgtgcgaatggccctcatcaaagacgtgctgcagcagaggaagattgaccagaggtaattgagaaatggtcattgtcactttagatagttttacttgttgtgtaactacagtgagttccctactaattgaaaataacaaaatgcatagtcttactaattagttagcaccatgttttatataagaattgccattttgaaaagaatgtgataatattaaaattaactgacattggagttacactaaatataatttaattatttggtttgtaagacacttgtggatcttacattgctgacatcttgctatagcatttcctataacatactttcaaagtgcagtgatatccagttgagacacttcaggataaatcaaacttttcttgtagatctgatgtgtcttatttaggtctacacatttgcaaatagcctagacagtgcttttaattagccaccacagacgagtctggcatcatctgctgtgggtcatagtaactccccgtcattaaagtaggaggcctttctcagttgtgctcatagcagtgagcaatactattgatcactctctccttaaacccgcctgggccctcagcctctgctcctctccactctcctgaagctcctcttcctcactggcactccgtgccttctgcagacccatcctcttctctccagacattacacagattctaaggccgcttcctcatgttctgtattcttttcctaaagaagtttccccaagaatgtggctttagtgaccaacacatttatatcttcagtctaccttgacttctacatggaggtctcaaagaccccttaaactcattatgtccaaaaccaaactcaaggatatggcctccatgccctcccccagcctgctctcagaaaccggggggtcatcctggatgccttcctctttctttcccttccccatcaccaatccctcctcaggttttctcacttcacttttcagacaccttgcaaacccatgtgcttccacaaacccagctccacctctgcctgtgtgttataagtgctatcatttcctccttccatgtctcctccacccctgggctccagccccctggactttccctggtgttttcaacctcctgacattgtccagcgctcttcccttctggactgccttctttgcactcatctgggaacactctccacgcttacccacttggcactccttgtttctttttttttgagacagagtctcactctgtcacccatgctggagtgcagtggtacgatctcggctcccgggttcaagtgattatcatgcctcagcctcctgagtagctgggattacaggcacccaccaccacatccagctgatttttgtatttttaatagagacaagatttcaccatgtcggccaggctggtctcgaactcctgacctcaggtgatccacccgcctcggcctaccgaagtgctgggattacaggcgtgagccactgcacccggctcactcattctttatatctcaattcaaacatcatttcctcaagataagccttctctcccctctaaagtttgatcagacctcaaaagtctatgttcttagagctcctgagtttttaacatttatttcagtttttaattatatatgtgtgtgttacagtttgattaccgcctgtcgtttttactccatgagatgagggactatgtctgttttgcacaccgttatatatttagcacccaggaagcatatatgatatttattcaatacttgttgaataaatgaggagtaaatgaacagatcttataaaacaggcttatggagcctcagaaattgtgtatcacagtcctttttggtacagccagagtgtagggtttttccactgtaccgtaactgacagagccatattcactgaagcaaataaccatcaagtgaccctcaaatgaccttcagttttctggaaaggaaggtgactatagttcacacgagtccgtattctctgtggattttgatttacctgaactccatttggaattaactgtctgctgtgtcatactccaagccttgttttcattagcatacatgctgatgaagtgcacagttaggaattttgctgttaaagggacaattgtagcattgttgggtgagagttagttataaaaccttataatcagtggcagtttcagtgatttattaagctgaaaattactttaatgccttttgtgttttcagctatcctattcttcataagtagaacagatcctcttttttgtccaacctcgtctcctaacctttttccctcaggtgtgtcatctagccccactggccttctttaggtttctcagcagccatgcttgttacctgccacagggcccttgcactagctgccctctgcctagaacattttcaccccagatctttacattgcttctctattcatttaggtttcggcttcagtaccatcttcacagagcagctgtttttcaccatgtgacctaaagtagcctgtaatctcatgattacatcatccatggcattcaccacagcccatttatcttatcatctaccccaccccacgaagaatgtcaaccccccacttgcttgggcaacaccagtagtaaaattggaatgatacagggaaggttagcatagcccttgcacaaagatgacatgcaggttcatgacacattacatattttaatgaaatgggagcatattcttgttatttaatttttaaaaatcagtttatcaagcaaatgtacagcgccattttatttttcatgcctacattaaattccatacacataaaggtgcatagaggaaacctagaaagattgcaccaaaattttagaattctgagtgattttgtttttcttatcttttctaggtgtttttaaacattccacactaatttatattactttttctattcaggaaaaaaaaaaacaacagcagggttttgttttgtttttttaaagtggtgtggaagttacccattgaatatagatgggaatcccagtcctggctgtttcctttgaaaagatctagagaccccatggcacatatttatagtagcccattctctcctaagaatagaggaagggtgggaggaattttggtgaatgtctgtacttgcagtttatcctacagcaaatcgttaagactgtgggaataggtgctttgcattctctagagctggagaatgtgcatctggtttgccatccttctgtctacatcatgtggaaagatgtgggagtgtagggtctccttaatctaaatgcagtgctgccccgccccccccttggcagtgtttctgtttcccaggcaagtgttccaatggatgtgctttattttctcccatcagaaataagggaatgagcccgggcgcggtggctcacgcctgtaatcccagcactttgggaggccaaggggggtgaatcacaaggtcaggagtttgagaccagcctggccaacatggtgaaaccccgcctctactaaaaatacagaaatttagccaggtgtggtggcgggtgcctgtaatcccaactactcgggagggtgaggcaggagaatcgcttgaacccgggagggggaggttgcagtgagccgagatggtgccactgcactccagcctgggcgacagtatgagactccgtctcaaaaagaaaaagaaggaaatgatctaatttgttctgtgcactgcacgtgggggtggcagtgaggtgaatggcagcattctgcagtagtcaaagccagatgggtgggagaagttgggtgctaagagggaaacaaagtttacctgtcttctccttgatttcactctcagttttatgagaatacagaaaaatcatgcagagaaacctgatggaatagtctctaaaactaaaaaataagataagcaatggttctgtcttaaaaaaaaaaaagtaaactccatgaaggcagagaccttacctgtctcattcctctctctatcccctggtctatagtaagggttaaataaatatatgctgaaatgaatgagtaatgactaaagtatttttgtctttattaggatttgtaatgcaataactaaaagtcacccacagagaagtgatgtttacaaatcagatttggataagaccttgcctaatattcaagaagtacaggcagcatttgtaaaa

SEQ ID NO: 8576 - DNA, 33618 bp, Homo sapiens
ccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaaggtgagccatgctgtatgtggtcagccctgttggaaaccacagtattataagtagcaaggaaagcatatgagggtgaaggtcattaaccaatagtaggtattttgaaatacattgtacatgaaggaatgaaggatggtggcctgatgtatataggctggaagatgattctagccttgaaggaataaagtcagaagtgcttgagataggaaggctcagttggggcagtggtcagcttgcatgtgttagactacgtgtaagtggtgcagctccaggtgatttgggccacctgtaaagatgagagcaaaacagcgattgtaactggcttggataataagactacaaattttgtacacggtgagagcaagactcttattctctcaaagaggtagagtttcagtgttctaatgccttttttcttctttcagtctcatcttaaagaaattcaaagtgcatttgtttcagttctatcagaaaatgatggtaggttgttaatatttgatttctaaacttaattgaacttgtattttaaatgttcaaaaacctggattaatgaacatgaaagaaaactttcttgagctgtgtgattaaaacaattattaaaccttatttgttagtagtaaggataagcattatgttaatgtttagaaaccaaaatttctagttaggatacaggaaacttagattctttctcatttattggtttatacattagaacatgttcctcaactctgcattttaaaatggagccgaggccttctttaacattagtatctctcctaatagcttttttctgcctctggttacttttcctctctgatttaagctaggagagagtgaacgtatatgtgttaaatctttcagtactaagctttgttttataacttgttttaaacatatggtcttgcattgacttttaaaagttaggtctgagtgtattgagatcttgtgaggctgttttatctctgatgtatgacttacagcccatggataatctgtcgctgcactgtccagtgacactgtataggtccatcagtattgtctagatttgtgaactggatcttctgtgaatgtggttctcatttacagtaacttgtgtggtgccatgtcccctgaaatgattattatttttaacaaaataggcatattgattctgtttttatatctttactttgatatcattttgggtcagtgtcaacataactttaaaaattttgatttcatagcaagtagacaaaattttttttaaagtgatacaatcttgtctgactttcttgtagaacttagccaagatgttgcatcaaagggccttgggttggtttatgaactaggcaatgaacaagatcaacaggaattggtttctacacttgtggaaacacttatgactggcaaaaggtatggtgaacttgaaaattttagattcaagcccatagaggaagtctctacacatagtgagaagatgctggagaaggaagattcggctttccatgttttggtttatgaagccttttctaagttgcgagtccataattgttgtgctgtggatagcacaattattccagggtatactgttaactttaggagcatgccactaggtcaagcgtcgaaagtttaatggtctcagataatgtattgggttagaaaaatgccgtaattactgttggctaaatggaagttaagatacggagaagaagcttgcatatcattcatagtctaacccgtgaagagtgtgaggggaaatcatctgtgtaagggattgctgcttcatgttgcctcccttgtaggaaggatagtttttcatgtgctaccacatttaattcagtggaaattatgtgaaatgtctttttcatctgttaatttgttcattctgaattcattttataaaatttgcagcctgttggaaagggctgttttttgttgttgttgttgtagtcttgctctgttgcccaggctggagtgcagtggcacgatgtcagctcactgcaacctctgcctccctggttcaggtgactctcccgcctcagcctcccgagtagctgggactacaggcgcgtgccaccatgcccggctaattttttgtatttttagtagagatggcgtttcaccatgttagtcagaatagcctcgaactcctgacctagtgatccacccacctcggcctcccaaagtgctgggattataggtgtgagccaccgcgcccggccggaaaggacttttatatcttgtacacagtaaatgcttgataggaagttttatcactttgtaaatgaatcgtattggctagttgaatgttggtatgaaaagcttgaagcttattgaaattattgttttggtttagagttaaacatgaagtttctggagagacagtggtatttcaagggggagctcttggcaaaacaccagatgggtaagtatgctaaatccattgaatggtaaacatctttaaatatatatatgcatttattagtctggtaaatagagcagtcatgaagttgatttctaccctcttaggaaatgttatctattggtggaagaagaaaacttacatggaaaaaagtctgatgtctttttttttttttttgagatggagcctcacttttgttgcctaggctggagtgcagtggagtaatctcggctcactgcaacctccgcctcctgggttcaagcgatagattctcctacctcagcttcccaggtaactgagattacaggcacctgccaccacgcctggctaatttttgtattttagtagagacggggtttcactatgttggtcaggctggtgtcaaactcctgacctcaggagatccacccacctcggcctcccaaagtgctgggattacaggcgtgagccactgtgcctggcaggctgacgtcttaaattgagtgtcctgggaaacaaactctgagttagatttctgtgtgggaaatttactggggagtgccctaggggtcactctggggggatgaggaggcaggatagggcctatgactgagggaggggcggaactgctaccatcgtttcagtggataccagcctcttgaggagctctgagctggcacaggtggcctttcggagttgttctgctttgaggcatggagcctggccctttatgtcctctcagtgaccagccattggtggtgggctgctgcgtgggagcccatgatgttgggctctcagggcagttgtgggagactgactaggccaacagctgtcagctctcaggcagctgagtcctgcagaacacctggaagcatagctaggtgcacccactgccgctagttttgggtgggtgtaattctttatcttagaggccactactttagcatttaaaataaattccttgagcttgaccgcctttattttatcatgctttatttctacggatcgttaggcaaatctttgctggttgcagggccttgctgtggtgtcacacacgagcctgcttcattgttgtctgcagcaggagaaagctgcagtttgttccatcgttgacgttcccccacagtacactgttatcacatcaaaagttgttttcattgtacttaactctccttgtagactccttctaagtttttaaaaaagtgcttacattttacaaaataacaaaacaattagatatttgagccaatattatttgttcagaggaaagttaacaagactcaatcagaattagggtggtctagcttagaaaagacttagggaagacagatgttgtcttccaatgactctcttatgatcacgtgagattatgcataacataatgaagaattattgagttgcatctccaggtggtgagtggaccgtggctatggacttagaggtgcatttaggtcatttatcagcagcaatgtagaggggcttaggaattgctaatagttgaattaggtgactttttatattcttactaacttgtgttctgtctccatggtgataactcagtattagaaattgagtgaaaatttgattttagtatgtcctagtaatattgatgatgtaattttttaggctggagagagagaagtgtattattgcctacctctttttctttgtttccaagtcagggcctttctacttacaaggaactttgttctctggcaagtgatcttagccagccagatctggtgtataaatttatgaatttagccaaccatcatgcaatgtggaactctaggaaggtaagttgctatcactggacaattatttatttttttcatgcaaaccaaacatgctacattggcagacagtggcaaatggtatgtagtgcattttgtgaaagtctgtgcctgatgagaaagctgaaccccacaaatgctgttgattggaaagaccaataaatcaggctgtatttaggcataagtttggagggagaattttttgctatgttaatattttactataatggtgcatctgagtcacttcagcctattatttttagggtgctgcttttggttttaatgtaattgctaccagagctggagagcagctggctccttttctgcctcagctagttcctcgactttatcgttaccagtttgatcccaaccttggcattcgacaggccatgacaagtatttggaatgcgttggtcactgacaaatccatggtaagtgtctgtgaacccctgtgttaggaaaacactgtagactgtccagggtcatgcataggatttaaacccagtgtccatcttcctttctactttttatgtttacttgtttaaacaaataaattgtctttcattccatgctttcttccttctttcaaggtatcaaagatgtgtatggcaacatttattgaaatctccaaaagggaaacaatataaatgtccactgggaagatggttaaggaaatgattatgtattcacacaaatggaatagtaaatgtggatagggactgttgatggaatggagaatgggtcatagtcccatctccaatgaattcagttagctggggagacagacaaggaagcaggcaattgccattttgttttctctgttggtgtcctctcatctggctgttaatcatgttctgtcccacttttagatattaagatttctcagggcttgtctctgagtatcttttgctctctgagccttctctatatcaatcagttccaaggcatgtaaatgtcatctttattgtgaaagttcccaaccttacacttttggtccagatgtcacttgcactttagacatgcatatgtaactgtttacttgaaaatttcacttcagtgttgtttcagaataccataaacccaacatgcccagaacaggacttaaaaaataaccttccccctctactctcactgtttacctatttgcccaagccagaaaacttggtgtcatactttattttgatctgtgtctcaccaccacccccaattgaatctagtagcaaattctgttgattctgcttccaaagtattccttgaatctactctcttctttccctaattctttactgatgaataggtcatcatcatctttttttttcctctttgccgttcttcatttaattatctacatagtagcaaaagtaatttttaaaaatgcaagttagattgtgccattttgggttaaaatcctttagtagctttacagctcactttaaataaattccatgatccttactatgtcttacaagtccctgcccgtaatgtggccccttcctgtctctcctgtctggtactaggctgaatatgtttctattcttggtggtaggtacttgagggttcagctttgaagactcaatgagttttgcttgctccaggagaacatgtggcacttttgggtcagccaagatctagtaggccagtgggctttgtaggtctgagctcaggacacaagcctagacccttgagacgtgagtgtcatctctataagtgaaaggattaagccacaagtgtggatgagatcatccatggagaatgttgagagaagcagacataggaagacatcagtttgttatttacctctttgtcttggttttcttacatgtaagtaaggataacaaaacctttcctacctacaaaagtggaaaagccgtaaatttttgagaatgtcagcattggtataagactgattctaccattattttgtcattattaccaagttgctaagtgtatatcaaaacagaacagaggcttaaaaagtaaaactcatctttcattctgaacagtcatgaaccaggcactgggtaaggtactggggataaaaagatgagtgagactctgtccctcaataactgcactgatgatgagtgagacactgtccctcagtaactgcactgttgatgagtgagactctgtccctcaataactgcactgacgatgagtgagactctgtccctcaataactgcactgatgatgagtgagactctgtccctcaataactgcactgacgatgagtgagacactgtccctcaataactgcactgacgagtgagacactgtctctcagtaactgcactgacgatgagtgagactctgtccctcagtaactgcactgatgatgagtgagacactgtctctcagtaactgcactgatggtgagtgagactgtgtccctcagtaactgcactgacagtgagtgagacagtgtccctcagtaactgcactgatgatgagtgagactctgtccctcaataactgcactgatgatgagtgagactctgttcctcaataactgcactgacgatgagcgagacactgtccctcaataactgcactgacgatgagtgagacactgtctctcagtaactgcactgacgatgagtgagactctgtccctcaataactgcactgacgatgagtgagactctgtccctcaataactgcactgacgatgagtgagactctgtccctcaataactgcactgatgatgagtgagacactgtctctcagtaactgcactgatgttgagtgagactctgtccctcagtaactgcactgatgatgagtgagacactgtccctcaataactgcactgatgatgagtgagactctgtccctcaataactgcactgatgatgagtgagactctgtccctcagtaactgcactgatgatgagtgagactgtgtccctcaataactgcactgacgatgagtgagactctgtccttcagtaactgcactgtcctgtacaataactgcacccgacccccttgagggtctgcagtatagtgaaatagtacagttattgtatgattttgtgtgatgcttcttcagaaggtgctatgggaacagagaggagagtacccaagctaatcttctctgggaaaggatggctaatatgaaccttgaaggacaagtaggagttagccaagcaagtaggacctgggaaggggattgtagggagaggtggcatgtgccaaggaatggaggtgagacagaatatggtacttttgggtctggatgagtcatggaaggctttgtgtgcatgcctgggtgaatggacttcattctcatgcactgaggaaaataaaagcatcaaatgtacattttagaatgatcacctggcagctttatagtgaccaaagtgggaagagatttgtgggctgagtggcctagagagacatggaggccgtaaaatatagaaacatggtcagtgtggttaagtgtggttaaccagtgtggttaagagttgagtaatttgattattgatggattttgcattttaaattttatccttttgctttcattaggtggataaatatttgaaagaaattcttcaagatttggttaagaaccttacaagcaatatgtggcgagttcgagaatccaggtaccgtttttaggaatataagtttagtcaaataaaactgaatttttttcccttcaaaatttctaggttttatactttgtgcaaaaggaataaattaaaactactaaaaagctggccgggcgtggtggctcacacctgtgatcccagcacatggggaggctgaggtgggtggatcacctgaggtgaggagttcaagaccagcgtgggcaacatggtgaaaccccgtctctactaaaaatacaaaaatcagctgggcccagtggcatgtgcatgtagtcccagctacatgggaggctgaggcaggagaatcgcttgaacccagccagggggcagaggttgcagtgagccgagattgtgccattgaactccagcctgggcgacagaatgagatgagactctgtctcaaaacaaagcaaaacaaaaaactaccaaaaagcatatttcttgttggctacattagttatttttctttaactgtttaagctttggtcaatgattttcctaaattgtcatagtttatgtaagtatgaaatcaaagaagttgaagattacctgttaaattggtagacaccaagatgtattttgtattgtcatgactttatagtatagcatttctgtatacaagttagattcattcggtgcccagtgtgtatgtggcagtgtgctaggccttggaggcacactggtgaataaaaaacgatgtgtcatctcaaagggattgtattatagttgtgggaaacaagcattttataattgtaaattacatatatatatggtatatttgagggacctggagagaagtcattgctgttttggggtgaggggatgagaactcgaattagaggcagaatctgtattcttttttagtataaatgtttcatagtaaaatactgacctttttcatcatatattgaaatgaaattttgattttcagctgtttagctttgaatgatttattgagaggaagacccttagatgacatcattgataaacttccagaaatttgggaaacgctttttagagtacaagatgatatcaaggtattatagaaataaatcagcatttatatatacaaaaagttaaattggaattattaaaatatttatgttgtgtatgtcaaaattccatttccagataattttaagagaccaacgttttcccccaaagtttcagtcttaatgtgtctgtgaagttgcaaggttgggtatccttagatctaaattaaatagacttagggaaaaaaaaggtggctgtataccttctttcaatagagatctcatgattctattggattagggacaaataacagttttggacatagtaacagtattttgatcagttctgtaaatgggattaattattctcaagtaatgtggccaattcctctgaatttttcttgggcaatcttaattttaggtattttggtattttaccattaaaattaggcacttcagttttacctttctttttgctttatttattggaggcttttaagtgtttcagaattctcacatagatctttatgtatttacttttataatacatttagtttctcaactgttaatagctaaattttttaaggtcaaaataggttacagttaatgtttaaaaattaatagtatggcatggtaatgtgttccttgatgggcagagagtctgatgagataccaatttttttaacatgatatgaaatgtaagattttccaccaaatctctgtagggcctgaggcaattaaattgcaaattgtagagtagatgatagtgaaactctctaacttgtatgatgtcacacttttgtcatttttaggaatctgtacgaaaagcggcagaactagctctgaaaactctgagcaaggtgaaaaccccgtcttacattgggaatggagtggagcagggttctgggtgaccatgacaatgatttacttactgtcataggaaaagacatttagttgcagtataattggcttcatgttgtagttcactgctcttagaatgaatgagaaagtgagtgctgtaaacactgcagtactagtgtgttgaacagagtatactgtggtctctttaaatggtgaaattaagataaaacttcgacttaaccctgaagagcacatcactcagatcaagcaacacctgtcttttctcttgcttttgctgtgtttatatataaagctacctttcatatttgtgaggttggaaagctttttgaaactaaattatctcccacttgaacttgattttgtgatatatcaggaactttacattctagttgcacaaaccttgccataggtcacataaatagtaaaaccaggttttaaatacaggtgttttcctgtttcacatgtgatcttgaccactatattgtgctgtgacccagcgttattgatgatgatgatgatgatgatgatgataacacttcaaaacttctttatttaattttttattttaatttttttttgagacaaggtcttactctgtcacccaggctggaatgcagtggcgtgatcacgactcactgtagtctcgacctgccggggtcaggagatcctcccacctcagcctcctggagagctgggaccacaggtgtatgccaccatgcctggctaatttttcatactttttgtagagacagggtctcttcatgttgcccaggctggtctcaaactcctgggctcaagcaatccgcctgcctcggcctcccaaagtgctggctttataggcgccggctactgcacccagccctaaaccttttttaaagtgctttcttacatatttcctggtttgatcatcatctgttttgttctgtatttcacaaattggaggaccagtgcttagagagtgaaatgcattaccaaattttctgtttagttcttggcagacctaggactcaatctccgatctcattcctctgtgtctctgtagtgtcagagaaagtagattcacttattcttccctgtagatatgtgaagtagaaagtcttttgtcagatgaattctttattggatgcgcggtcactttcactaacgtccatgctctttgtatgtgaggtctgtgtgaaaatgtgtgaccctgccaaaggagcagctggccagagaaccatcgctgcccttctgccttgccttctggacaaaggaatgatgagcaccgtgacggaagttcgagccctcaggtgtgcatccgttgatgaaatgaatgtattggatttgctcagttcctagaaattgtgtttctttcaaggttagattctggaaaatatggagaaagaggtttaggagaatgacccttgggtcatttgtgaaaacttgtgagtcacaatattttcacagaaacattctcatgagaccttatttttgcctagcattctgagtcaagcgtgttgttctgttgtcatcagcctctgctcccaacaagcacgtcttcctgttacactgtaggtcctcaggagcatgtttgttcattataatatttagtaatatttcacagattattagatttaagagaagctgtttaccacctgcaacgatgaaatattcaaaaaatgtacttacacgttttgatataatatatgactactttaagttaaaaccaatagtgtaggattctagtttgtatgttttgtttgtttttaaagtacagtgctgtctaggaactttatctgttccattgttatttcactcttaagagtagaacaaattattaataatactgccagtggtatttcatggcaagtagatagttgatgaaagagttttttttttagaaggactcacctaacaaatgcaaaggcatgacgcaattaagagtgtcactttggctgggcctggtggctggtgcctgtaatcccagcactttgggaggccgaggtgggcggatcacttgaggttgggagtttgagaccaacctggccaacatggagaaaccccatctctactaaaaatacaaaaaaaattagccgggtgtggtggtgcatgcctgtaatcccagctacttgggaggctgaggcaggagagtcgcttgaacccaggaggcggaggttgcggtgagcccagattgcgccattgcactccagcctggacaacaagaacgaaactctgtctcaaaaaaaaaaaaaaaaaaaaagtatcactttttgctctcctcagtaaaataatctaagtagtgatcattagatgcccctaaatccactgggtgaatggctgaagagaactttataatgattcagggcaaccagacctgaacctaccaatcactccttatagcacaaaaagacaaccagtgcatggtgatgtgatggaataggaggaataggacacacagcattgcctaggaaggattctttgtgtgtgtgtgtgtgtgtgtgtgtgtgtgtgttttacaaaattgaacgtgaactcagtttagcctgtagatctgtgcaggggaaagaggaacatgttaaatgacatgactggaatacaatcaaagaggacgaagaagaaaaaaagaggagagtggagactgttaaaaaagatttaagaaatgcagtagattgcaatgtgtgagtgagcttggatcctgattcaaacatgccaactgtttaagaagctaatgaaacagagaaatttggatacttgatatgaaaaaatcattaatatttttaaagtgtgaaaatggtattatgattatgataaagagcctttgcttttagatattcatagtgaagtttagttaagggatatgctttcaaatgcagtcacacgtcacttagtgacaaggatatttctgagaaatgtgtcgttaggtgatttcatggttgtgcacacattaacatgaagttggaaaaatggtgcagttagattgcttgatgcagggttgccacaaatctgttcacttcatatctctatgtcatattttggtaattctcacggtatttcatactttgcattactattatatctgttttggtgatctgtgatcagtgatctttgatgttattttgtaattgttttggagttgtatgaactacacccatttaagatggtgaacttaattggtcagtgttgtgtgtgtcctgattgctccactgaacagctgttccccatctctctccctcttctcaaatgtctcattccctgagacacaacaatattggaattaggctaattaataaccccacaatgccctctgtctaaatgaagggaagagttgcctgtctcttactttaaatagaaagctagaaatgattaagcttagtgaggaagggatgtcatgaaagctgagataggctgaaagctaggcctcttgtgccaaacagccaagttgtgaatgtaaaggaaatgttcttaaacgaagtttaaagtgctatgttagccaacacacaaatgataagaaagcaaaacagccttttgctaacagggagaaagtttgaatattctggatagaagatcaaatcagccacaaaattcccttcagccaaagcctaatccagagcaaggccctaactctcttcaattctgtgaagtctaagagaagtaaggaagctgcagaagaaaagttggaagctagcagaggttggctcatgaggtttaaggaaagaagctgtcttcataacataaagatgcaaggtgaagcagcagttgctgatacagaagctgcagcaggttatccagaagatctagctaagatcactgataaaggtgtctacactcaacaacagattttcaatggagatgaaatagccttttgttggcaaaagataccatgtaggattttcctagctagagagaagtcagtgcccggctgcaacgcttcaaaggccaggctgactgtcttgttaggggccaatgcagctggtgactaagttgaagccagtgctcatttaccattctgaaaatcctaaagccttaagaattctgctaaatctgctctgtgctctagaaatggaacaacaaagtctggatgacagcttatctgttaacagcatggtttactgagtattttaagtccactgttgaggcctactgctaaaaaaacaaaaacaaaaaacaaacaaacaaaaaaataacaacaaaacaaaaaccaaaccaaaaaaaaccccaaagattcctttcaaagtattactgctcattgacagtgtgcctggtcacccaaaagctctgatagagaggtacaaggaaatgaatgttttcatggctgttagcataacacaacatccattctgaagcccatggatcaaggtgtaatttcaactttcaagtcttactattcaagaagtatattttgtaaggctagagctgccattgatagtgattcctttgatggatctgggcaaagtaaattgaaaaccttctggaaagggcttaccattgtaggtgctgttaagaacattcatgattcatgggaggaggtcaaaatgtcattaatagtttggaagaagttgattccaactttcatggatgactttgaggggttcaagatgtcattggagaaagtcactgcatatgtggtggaaatcgtaagtggggcctgaagacgtgactgaattgttgcaatctcctgatgaaacttgaacagaagaggagttgcttcttatcgatgagcaaagaaagtggtttcatgagatgcaagctactcctggtgaagattctgtgaacattgttaaaatgaccacaaaggatttagaatatttcataaacttagttgataaagcaacaacagggttggagaggattgactctaactttgaaagacgttctaatgtgggcaaaatgctatcaaactgcatctcatgctacaaagaattattttgtgaaaggaggagttgattgatgcagcgaacttcattgttgacttattttaagaaattacgacagccacgccagcattcagcaaacaccaccctgattagtcagtaggcatcaccattgaggtaggaccctccaccagcaaaaagataatgactcgctgaaagctgagatgatcagtagcattaagatattttaaagttaactaatgtactttattttagacataatgctattgcacacttaatagactacaatatagtgtaaacaaaacttctatatgcactggtaaactagaaaattcatgtggctttctttattatggtggtctggaacagaacctgcagtatccccaaggtattcttgtatgatcttatgggactactgctggacattgtggtctgttgttgttgactgaaatgtctcatgcagcacatgactgtaatacagtggcaggggggaatagcggctgtatgtatggaggaggtataaatgaaacaaaattggtcaaatgttgctaattgttgaactgggtggagaatacatggaatttcatgcctactataaattcctaccataaaatttcactataaatataaattcctactataaataaatacatggaacttcattcctactattaatgaaggtaggcttttcctacttcatttatcattctacctacctctatatatgcttcaaggtttctttaataaaagttaaaaaaagtaatgcccagaccaggctctgcaaccatgtgaaaatatgctttaatgcagtgaactgcagaacatcctcatggttagatttgtaggtcttctcacttttgttaaaaggactcaggagttgtgttccatatgtttgtagcattaacacccttgtgaagatcagcaaaagtgcaggagccatgttgaaaccgcatgcaccaaaactcattccagctctgctagagtccttaagtgtattggagccccaagttctcaattatttgagcctccgggcgacagagcaagaaaaggtgagtggatagcgcaggcatattggtaagtatcatgagggaagagccctgttaagataccaaggttcatttgaatgacactgtcactactgttaccagaactcaccctctgtcaccacatgcagtgttttactgtttttttggagagaggttgtcagctcatacactgtcttgtgaattggatgaaaactgacacttccatctaaaaaatgaattaacatttgtttaacatagttttttgtatatttcaattttgttagggcttggatctataccttcagagtccttccatgggctccctcgccctgtaagcaaagagtatttgcacctagactttggcatatctcaaaattgttctgctttttaggtgtaatggagtcacctggtctctgatcagggtcatttttatttttatttttatttttatttttttggagacggagcatcactctgtcacccaggctggagtgcagtggcaccatctcggctcactgcaacctctgcctgccaggttcaagcgattctcctgcctcagcatcccgagtagctgagattacaggtgagcgccaccacacccagctgattttttgtatttttagtagagacagggtttcaccatgttagccaggatggtcttgatctcctgacctcgtgatccacccgcctcagcctcccaaagtgctgggattacaggcgtgagccaccgcacccagcctgatcagagtcattttttaaaacttcagatgaaacatatttattgtgaaaagttaatacagaaggatagaaagtaatcccatagaaggtctcccaatcaccacagtatcattccctgaggagcacctgctgtcaaaagtttcctgtgccttctctcaaattcctttttagtcataggctaccaaaccaaacaaacatactaatttaaaaatagtatcagaccgtgaatgttgttctgtgatttgttttttaaattaacagtatatcgtgtctatatatacacttattctttttaatgtatgtatagtgttctacagtgaggtgattttgaatttttgatggagaggttttgcaacatcaaaggttttaagtgttctttttttctccgtacctttggcactgttgaataacgtatgtgtgataacaagaatctcatttttctgatttgcactcttttcctagcattgtccattgccttttcaatattgtattagtcgtttatatttcttctgtgattgtgtttatgttccatgtctatttttctatttgactgtttttttaatttatatatttttattagaactgttaaaccctgttatatacaacatgtttcctctgttcactatttgatctttaacttgcctaaacttctctaataacttactctctttaccctttgcctctaatattgctgtttcttcttcattcattatttttccctctttcagcagtagacttgcaccttcctgggtgcccataggatgtttactaagcattgagaatttggaaacataaattctagtctaaactttgtagccctaggcaagtcacttgtgtatgccttacttttctcccttatcatatctggatagtgttaacctctccttcagcacagttgttagattaaaataccttcatagatacgaagggtaattacaaagttaaagaactgcacgtataaaattttctactgcttagacacaattttaaaaaccttagaaatttgtttagtcagttcctttatttagtggatggagaacctcaggctcaagaaggctggatgacttgcccagagccatactatgctgatttcttaactgttatctgaatttctcacctgtagtgtggtgctggttcccctggtaaattgttgagtgtaggtcaaaagaaattagagttagacttgatgtttgcctttgttatagctacggattatttttttttaaagttctttagcttggaagtgaaagtcttttatgggtgtttgtgcggattattcctaattaattgaatgtgccgggtgactttaatttctcttctttaggctgcgatggatagtgctcggcttagtgctgccaaatcttctccaatgatggaaacaatcaacatggtgagtgtcttaaataataatgagagggtttgtttgcttacctgaaagtgtaattcttcaaagtcttcaggctatgttaaatgaagcagagacttatgggatgagtcaagcagctgttgtgactccagttttttcttagtatatttctcttttcttctctgttactaagtggaataaataattccccaaataccagaaacagttggtccaaatttgtattacaagagacaacaacatatcaagagctctctataaatttacatctgtagtcttttgatctgcctatttagaaaggttcagagttgtgcctgtgcctaatagttatctttgggaggaactaggaaagttataagctgtggaggtatttaatgaagtaggtaacataaaggtatgtgaagagattgggcaatgtcgatatgttgttttagtcataggaaggcatttgcagtaaagggctgcttggcattctgaggttctgatttctaaacttcctggagtcttggtaaagttactctgttgtgcattccctgtaatggttagttagctatgattgtgtttactggaaattagtttgctaagcagatctgtacctttagcaggactctgaaggtatagatccaacccctaaaaaaactgaagtgtacaaaaaactatgttaaactggtgaagagaagtagctattttttagtgcctgctgggggagtattaccaaaatttggtctaagaatgttatgtcttagttggattattggggggaaataaaaatttaaagaaataggaatagttagtgaataccatttagttatattcattagtaatagaaaacatgttaattgcattttcaaaaataaaggccagcaatttataggaaaagtcatctaagaagttgactcattagagggggtttggtagggtaggcccactgtagaagatcaatatttagtttaggttttttatactaaacatggattgataaagaggaagtaggcccagaaagattcttcattcttgagtaatcattatttttcttttttagcaaattgatgtttttcatttttttgtttgtttttagtgttgaatcactgatgaataatttttctgtttgtagtacaatagtggttttaatattgaaatcagagcagaagcaagcagtgatttttcaacttcatgtcaaatccagttggtacacgtttgacaagggcagtttttaattgaagatgtggtcctgacttatttgccaaggcttacctttatatttgtcctttttcaaaagtgcctgcaataccttgatgtgtcagtgctgggcgagctagttcctaggttgtgtgaactgatcagaagtggtgtaggtcttggaactaaggtaagtgtactttccacaagaggaaatgtgcatcttcattagttctggccataaggatataacagccatcatgtttgaaattcatgttttaccacaaaatctaatattatacactaaccattttatttctgtggttgcactgataactgaaaacatgtaactggttcaagaaataaaacatctaactgttccagtaagtattaacttatttagtggaatcatttctgttctctggttgccgtgtacataccctctgggttgtcattcattagcagttcatggaaatgcacatccagttattagggcatggattgttttaggtggcaattgcatttttcacagaggggtcagcagtgtttgaatagaaaaatgtcctagttttcaagatctttgaaggatcagacacccccctaccacccttttaacaacaaattaataactcacattttttcttatgacaaaattaacacttgctggtattttaaaattttagcatttatagattaggagaaagttaaaataaaaattgtccagaattttgccatacagagataactgctgttaatattttgaagtgtttccttccagtcttttctgcacatgtatcttctgcagtgtcctcttctaatggccgtatgatactccactgtatggatgtaacatcatttattttactccatcaaggaacatctgatttgttttcagtttttgaaaaaaatagtaaagcactgtgatgagtgtcttcaggcacacctgaagatatttggttaaatttctggaaatggaaatgttagcacagtgatggacaagatgacatattttgcttttccagaagattgtaccagttttctttctttttcacaatgtctgagatcacccatctttctcttggaggtttaaaaaaaatcgctgcattactagtttaagagtttgcctttttctatattgagtcctggagggggtattaggcttcatgtattttatatgtttaaatttttggcacctaagccaatggtttggtaggtagaacattgtgaccatcagatttagacctttgcttttgtaaccctgtagggtggctgtgccagtgtcattgtgtcattaactactcagtgtcctcaggacctaacaccttactcaggtgagtttgtcaagggatgtgtggtgatatttttgcacagccctgtcttgtgtgacagagttttaaaaaggaaaaatacttatcattcagacctgcttgtgatgctgtgtgccttttctcccctcagtcccctgactccttcatttctttgtctgcaggaggtgcagagtttatcaagtttagcagcttttcactgttcataaacatttgattattccttagtggtataaggaggtaaaagtatcctcttttccacaggacttaccattgatagctgattttacatcagcatttttctcttcttagattggcttctagactggactagtgttctttatatacctcgttcttattttgcatctttttccacgatattctagtttaattttaactttatatcatgtaaaaggaagcaaatggatatataaatataacatccagaaatctaaactactgtggagtaaatcagatgttaattacagggttaggtttgtttgggttctgggaacagagtggaacatttggtcaaccaagtatcagatttttttctctttatttctggtaggtaaacttatgagtgctttgctgagtggcctgacagatcggaacagtgtgattcagaaatcttgtgcatttgctatgggccatttagttcgggtgagttaaatttcttgcttagttaaataaaactctttgacagttataaagaaatacttaggattgtttctttttcagacctcacgggatagcagcactgaaaaactcctgcagaagctcaatgggtggtatatggagaaagaaggtacctttctttttctattttatgtcattttaaatttagatgttaacagcccagtaaaacagtacaaattaggtcttaccctccatgattttatgtgatttgctagaaacatttgtttcttttcttttctttttttttgagatggtgtctggctttgtcgctgaggttggagtgcagtggtgctatctcagctcactgcaacctcagcctcctgggctcaagcgattcttgtgtctcagcctcctgagtagctggaactacaggcacgtgccaccacgcctggttaatttttgtattttttgtataggtggggtttcgccatgttgcccaggctggtcttaaactcccgagctcaagctatctgctcaccttggcctctcaaagtgctgggattacaggtgtaagccaccacaacccagcctgctagaaacatttctaattgattttacctgtttgttttgctattatatgagttgaacaatagcctgtttagatcagttacccttaaaaacaataaatatcgtaaagattttggtttctccttttcagaacctatctacaagacctcttgtgctttgactattcatgctattggacgatacagccctgatgtattaaagaatcatgcaaaagaagtcctgcctctggcatttttaggcatgcatgaaattgctgatgaggagaaatccgaaaaagaagaatgtaatttatggaccgaagtgtggcaggaaaacgtacctggttagtagtgtggcctgagttaaacctgcttcttaggaatcacagctagaattttttacttgcattcgttattcataaactcctctgaagttactttcccaggaccttaatatgcatcccatttagttttaaacccatccaaattgctcatcccatttagttttgaacccatccaaattgctgagttctcaaggttggcactcaggatttttgtctttactcattcatcactgcccacatgagagaatataaaccctgtgagcaaggagagctttacatttttaattaagagtgtgattttatgtggccttagagtattttagagtagttttctaaatgtgtttttcaccttgtcgcatattaattgatgatgcccatttgtgtgatacgttcctgtgggcacccaagttcgtaaagttctactattgtgagaataagtcacaacaccaacacactttctctccctttgagagagtggtgtgttttaacagttgagagtcactgcttttagactgttggtcactgactttttttcaggtttagaaaaatcagttaatttttcttgtcacttaaaagttgttttaattttgctttcctaggatcctttggtggcattcgattatacctgcaggagttaattactattacccagaaggctttgcagtctcagtcctggaaaatgaaagcccagggtgcaattgccatggcatcaattgcaaaacagactagctctctagtacctccatatctcggaatgatactgaccgcattgctgcaaggcctggctggaagaacgtgggcaggaaaggtaaaggaaccattcatacccagttaaagggattctgacttcatctttcattttgcataatagtaacgatctggttttgtgtaacttttccaatggattatttttgtgaactagatttcctagacagtggaagctttgggtaaaccttgcctgattaactgtggtatttcctctcaaactgcaacccgtgtggccttgcataatggacagtaatgctggagatagatacattttccatattcagccttccaagttacgtcttaaaccaacttgtcagcattttgtacctgttgacctcatgaacagatcaggattgggcatagaaagatcaggattgggcatatgtgaaatagagtagcaaggtagcctgcctctaaacctggggctgaagatgcccatctctgggacctatgaattagtaacagttatttttttacacaagagctttagtaggattcttaacagtgaacactcagtggggaacatgagattgtggtaacctaatgatctttatgttgtaaaggtcaatagtggcccatgcaggaatgaagtagtaccggactgggagtcagacatcattccaattctgtggttgacactgttttctgtgagacctgggtcgaatcagttctttaggcttctatgaaatggaggtgaagataattatcctacatccatggtttggagtaaaacttggtggatgtgcttaaaattatgcattaaagataaggtgactgttgttaatttttgttgtcatagttatcaaaaattcctaaggtaattgtaatcatggtttagacagtgtaaatgacatgtttgggcttaatagtatttcctcatctttcaaccccttaggaggagctattgaaagccattgcctgtgtggtgacagcttgcaggtaaatgttctttcaatgaagatgccatttcttaaactggacccgaaaactgcagcctttattaacttctgatgcttttgtatggaccctgtagtgcagagctggaaaagtctgtgcccaatcaacccagcacaaatgaaattcttcaagctgttctgaaggaatgtagcaaagagaatgtcaaatacaagattgtagcaatcagctgtgcagctgatatcttgaaggccaccaaagaggacagattccaggagttctctaacattgtcatacctctcatcaagaaggtaataccacctgtatcctcagttctggtttatactttaaaaagaaaaagttaaaaaattgttttcccctatgtcctgattattaggattagtttagctgcaagtagcagagaaattccaaaatacggccttaaacaagatagtcaatgctatgtttctcacaaagcgttgggagcatcacaaagtgttcaggtattccgtctctttacagctctgaactctgccatttctagggtgtggtcatcatcctcatggtccacagtgtgtttgtgttctaggcaggaatgcagaggagatgaagcaaggatgaaggatacagtgggcatgccatgtctctcttgaggagagttcctgggcaccgctagatggcactttgacttatagccatcctgttggtcagtacttagccacacctggcagcagactgagtcttcattctgggtgtccatttgccctccatgggagaaggggagagtggatttggtagtgaatgaacagtttatgtcataataagctttgccttggctaataagctaagccaccccagccatcctagagtaaaggcaagaagctcagtgtgccatgtgaattgcctctgccatatagtggaggatttgggtcaaaaaaagactcaagtttcatgtggaaaatggaatactcatttttaaaagttgggcactggtcccccccccaaaaaaaagggtgtggtttccctgtttatttgtgaaacatgaaatattttaagtaacattcttatttcttattgctcctaaattgcagttgttttctttcagtaataaggctatttaaataatttccattacaaacatagtgatagcatatggatttgggagacttgtgttttaagttgattacatcactagcaagctggaccagttgcttctcttagcctctgtttctctatcaagaaagagtttggatttagatcattactgagtttcttccatctttaaaatctgattctaatgcaagtcttttcatgttatgctcaaaagactacatatgcagtattttttagcttttgtttacagatgcctgtaaagtattgcctaaatttattagagatacagtattctggttataaattcttgttgtaaatagggaaacttatggtagagaatttatcatttaactcttggttaatatctcctgccttggttggtaccctgatagctttaatagtatacctgtaactttgaagaagaaaatattacattttcttttctttgatatatcctagaactcacttgaaagcagtggggtccggacaaccaaaaatgaagaggagaatgaaaaggaaaaggagctccagctggaatatctgctgggtgcctttgaaagcctgggcaaagcctggccgcgaaacgcggagacccaacgtaagcaccagaaactgcatttgaagtgctgtaaccagaggttacttaatgagagcgaagaattttctctatgacaaattatagttattgtttcttatcgagcctgattgattaataatgagaattatccagtgaaagttttttgtctacatgagtctgtgatctcactgatcattgtaccgctgtagctagggctgctgtaagaaagtatcacagactgggtggcttagcagaaatttattttctcacaattctggaggatagaagtctgagatttcgagatcaaggcgtcagcagggttagtttctcctgagacctctctccttggcttgggaatggctgtcttctccctgtgtcttcacgtggtctttggtgtctctgtgccctaatcacctcttcctataaggacaccaggcacgctggattagggcccactcatatgacctctttaaaggctctgtcttctatttaataataatacagtcaaattctgaggtactgggggatagtattttaacatacgaattttgggggcacagttccacctataataaccatgatacattttatgcagatagtttgatagacgagttctactgatcttcttgatgatcatagctctattcagaggaatgcacaaagtttattagcagggtctctttatcctgaaatgaatggtcttgttaccaagtgttcagtaagcaactgaaatccctgtttcagtgaaaaactcattactatttggacaattttcagaactggacatgtatttcccaaagattaaatgaacagtaaacctctattattggatgaggttgcagttagtttggagtcccctgacagggccttaaccttgggatgatactaccctttacacttgatcttagccaaaaggccaagaagtgatgatgctaccctttaagcttgccttgtgttgggtcctacagtgcatcctgctgaagatcttagtattcgttttttttttgtttgttttttttttgagacagggtcttgctttgttgcccaggctggagtgcagtggtgcagttcttgcagcctttacctcctgggctcaagtgatcttcctgcctcagcctcccaagtatttgggtctacaagtgcatgccacgacacccagcaaattttttttgaagaggtgaggtcttgctatgttgcccaggttggtctcaaactcctgggctcaagtgatcctcccactttggcctccctctcaaagtgctgggattataggtatgagcctccatgcccagcgacaatattattgaatgttataaaaagtactgttgattatttgtgattggatatgtctagaatcagttaaggttctctttgagccctgtcatcctttgtgtgaacttatatatttgctatgtttataggaagggtttcccagaagatacaaatttgcaggtggttttatttcttaatattatgttatagactgccatggaagtccactaatatgatgccataaagagtattaacttttccttgataggtagagaaagctaaagtagggaattatatgagaaagatgatacaaacataaagcagtttattttaatataagacatagaaggttgttaatagaaatgtgcatttattgagaaccaaggccttttctttaggaacttaactgttacacattggcttctcatatatatctacaatttctgggttttgtttctttaaaacagagaaagaaatttcaagctcttatgagacaatcctagtgcagaattctagattttttattgcctccccccatttttacatttgtttgagccctactaaatcctacagtaattaaaaataacttcgttgttgagttttctgctgattcatcagttggcataatattaattatatagttataattacagttgcagttggcataacaggtttataataaagcactgttgactcttggtaaacctgcaatttgcagaagcttgtgagcatctagagaggagcttctggcctccagagttctttctgtggctgtcattcagggagttttgaggggcaaagggagtgtggttaaagtgctttctcagttccatggagaaccatatgccttgaaagtgaatatttgtgaacaattatattgcacctttgtgggggcagtttctgatcaaggaaatttgtttggggattgagtacaaagtcatgctgaagtttttggggaaatttcaatggctttaattaaaagtatttattgttttatttctctttttcctgcttttctctctcttatcctccccaccttctctctttctctttccctcttcctttctcttgctctctctgcctgtccctcatttattccatctcttgttcttttatactgtctcctgctctgtcccaccttgtctttttttcccaggttgttatcgtcaggagctgtgcaaactgatgtgtgaacggctaaaactcagcacgtggaaagtgcagctaggagtcctgcaatcaatgaatgccttttttcaggggtaaattgcttcatggctcagttttttattttgttcctccccgcagcattttatgtataatcaatggaatttttatacatttaaaaactggtagctaaagtgacagtgatacatacagatagaaattgtgacaggaaagttttagactgtttcttaataattggcatttgtaccttgctttctgatttgtataggttaatgcttttggaagaagaacatgccgatcctgaggctttggctgaaattctgcttgaaacttgtaaatcaatcacatattctttaggtgagtgtagtaaactaaaactgatgagggagtcctaattttaaagctaaggagctgagcttcaaatatttcctactttgtcttaggaactaaatttctgaaatagctactggactctgctacttattatactccatgtgtaccccttaactggaatatttaaatctggaactataacaggattttagcatctagtttagaaaaaccttcgtgacaagtatttttacaaaattgttacttgaaagtaatttcaaacttacagaatggttgcaacgacagtacatgtaatactctgcaatatgtatacactttatgcagaatcatttgttaacattttgtgccatttgctttgtcatttggacttctatatacatgtttttctcctgaaccatttgaaagtatgttgcttacttcaggcccccttgttcctcaattatttagtgtgccacggtacagttgtcaactttaggtagtaaacatggatgcagttttttaaatcaaatgtttatcgttcatattctagtttgttcagttgattcggtaatgttctttatttttatttttattttttttgagttggagtctcgctctgtcactcaggttggagtgcagtggtgtgatctcagctcattgcaacctctaccttccaggttcaagcagtcctcctgcctcagtctcccaagtagctgggattacaagtgtgtactgtcacgcccagctgatttttgtatttttgtagagacagggcttcacgaagttggccaggctggtctcaaaactcctgagctcaagcagtccacctgccttggcctcccaaagtactggagttataggcatgagccaccacacccagccagtaatgttctttataggattttttccccctcccctccattagggaatccagtccaggtgatgatgatgatgatgatgatgatgatgatgatgataatggttattattatttttgagacagggtcttgctctgtcacccaggctggagtgcagtggcgtgatcttggctcactgcaactctgccttctgggtttaagtgattctcctgcctcagtttcccaagtaactggaattacaggtgtgtgccatcatgcctggctaatttttgtatttttagtagagacggggtttcaccatgttggctaggctggtcttgaactcctgacctcaagtgatctgcccgccttggcctccaggattatttattgaattttattgtcatatatttttagtctccttcaatctggaatacttcgtcagcctttctttgtcttaggacattgacaattttgaagaataaagtccccccgacttccctttttgaaaaaacagaatgtttctcatttggtgtttgatgttttctcatgattatatccaggttgtgaattcccagttgggatacatacataagtgatgtgtcctcacattaagaggcacacagtgtccatctgtcatcatttgtgatgttaattttgattacctggtcaaggtactatcagtttttctctactggatagttactatgttttctttttgtgtctaataagtagcctgtgggaacagatcttaagatcattcaagtaatttgtttctcttctttaaaatttcttctctatatttagcatgcattgatgattcttccctgaaccaatttttactaagatgattttgcaactctagcactttgtccacattcaccatttgatagttggaattctgttgtaagcaagattcttctcttctgcccatgtttttatttatctgttactggcattgattcatggaatctttcccccttcaaatggtttataatttaattttttaaatctaattcgttattccagttgtcccagatttggccagtggaagccctttcaagctgcctcctgtgtccttttgacaggtcaccgtcactctttgtagcacttttgtactttgtagcataacaagatgataaggcccatctcatgcctaccctgctttgggcttggttgtgtgttgatttttttggtagacaatttcaccatgaaccagacgccgtgtcaaagagtggatgccaaggaagcatgtttcattcgcagttgttggcagcagcatccttttatggataaagaacaggcagccaacagacctctctttgctgagttccaggtgtccctgatcggcttaaacactgggtcatataatgttctttggtaaaatgaggagggtcatgtagacctaaggatcgttcttatccgtgatacgaagatgattttgtgtttgagatagttttttcatctcccacttctaaaatggatcatttaaatattgccatttgttgtggtgattggtatacttggctgacaggtttttgtttttccaaagtaaagactgtggacattagcacacatttcaagtatttgatacttagcaaagggaagcttcctttaaaaaaaaaaaatcagatatacccttccctagagttgtaatttctggacatctttctttcagcaacacaaatttaatcttggaggttgtgtttttcaggcaggccatatgaactgtatgatatttctttttagaaaataagacctactcatctgtgagaacagaagctttatctgtgatagaattgctgcttaaaaaacttgaaggtaagttgttgttagttctgactgggggaccataaagccatgtggcatatgttttagaaattttttgtttcgtttttgcttatactcttaagcatatactctgaaatacaaatcagtatgtatgcacatgcaagaagaatggacaaagccaaaactattaaattttactaaatatttaaatttgatacacttttatatatttttaatatattattaagctatagttgtcttaaagtaataaagtttttgttttcatcgtgaatcctgatttaatcttggttaattacaggaattggttgacagtggcatgtgtacatgtaaataagcagaacgacacactgaaaagtggagttggaaaaacatttttaacagttatctacctgagtcatcaaatctgacagtagcaattttcttaatcctatttcttctcccctaacctctttttcttctaatggtctatcagtgggtggggtgggggggaactgttagcattttctccagtggtgtatctgttactgacttcagaaggaggaccctcttcttttttctctctctctctcaaattgttttcacggattaagaatgtagaagatggaaacgtttttcctgcaaccttgtgtatttgctctttctacttctctatctttgcttagcaattaaaacacctctcttagggctccatcaaacagaacttttagactgagtaacgctaaacatctcctaatcccttttttccttgttgagataaaagagctaggcacttagtcgtattaccgaattctcagtttgccagatatgtactaatatagtccagatgaggaaaataaggctgaaggcaagctaaacttgcctgaagccacattgctaggaagtgacagaaccttgtaaacaagatttaagatttgatatactttcttattttctaaaaatttcaatgtgcatgtagttctcagatgctttcctcgaagaaaagggagtgtcatctatttatctgaccttgcaattatgacatttcttagaagttttttttttttaactgaccgtatcttatgaaatggtcttgcgatggtgttgttgaaatgacttttttgctgcagtgtgccttgccctgataattccttcttcctactatgcttcagtgtaattatttctcttactcccactgatactgggggaaggagaggaaactccctgatgtgcctctacgctactgtcaagaattaggttttgagacacatattgacagtatgtaatgataattatatactgatctgttatcaagaggttgctttgcatttatttgggggataggatatttttaaatttttttcttgcttgttctataaggattctttggggttttttctttttgctttgttttttgttttttttgtttttgttttttttttttcatgcagaatctaaacagtgggaatgtttgacatctgaatgcagagtgctcctaattgagtctttagctactatggagccagacagcagacctgaactgcaggagaaagcagcgttactgaagaaaacacttgaaaatctggaataaattagaaggggaagaaacaaacaagtgccatgttcattgggggttgaagtggtggtgttctttgaaaaaccaagtgggaaaaagtaaagattaatctgtagcatgcatcattccttggctgaaataaaaagaaaaagccttaaattttgttccttattagctttattttactttatgtttttaaagtatctgggctgagtgagcttaatggaaccttggatgtttgaggggtggttgtaaaggaaactggcagaaatagttactaaaagagttcaagctgttattaaaggaattaatagacagagttgcagagcaagctggataaaaatcttagaactgcattcaaattagttatttcaggaaggggccctataaataacttattttaacctccctcttacacctgaagaaataggaagctgtgtcatctcagaggctttctgaggcctgtgccaaagtcagaacccaggtgtttaatgtctggccctggatactttcttttatggccatctgccaaatcagtgctaaccccggcttacccaagaaacttccaagatgaggtacgtttagggtggcacacagcagtctttgtgccagaactaaactgacccttaccattgggtttctgaaagccagaagctaaacattgtcttgtcatgtgtttaggtggttgatttggagaaaatgattgtttagcatctttacagatggagaggacagagtcagtctccttcggataattccaatcgtcttccttttacaggtggataaagtagattaggacaagatcacacattctatctgtgtctgtggctgcatattttgcaaaaccagaaacaaaatcgcagactgccgtggtttagaccatttataatgtcaaaactgtaatgacaaatttctgttcacttttatgctaccagtatgactttataggggagaaggaaagccttttaattagccacctgggaattactcttttaaaaaatgccttttctcaaaagaacatgataccactccaagtaaatcattgccactaggggttttcctccttccttctgttgcccatgcccctgcctgaaagtgtagggtaagaggaaaaacaagtaaaaccttagtgttgatggtaaactgagaactctgtagcttaccttggattccagagcagaagactggtttacattcagtactcatccttattgacgttaacaccaggaatctccatgtttattatttttcgtggaaactccatgtttattatttttggtggtctctattgaccaatgtatttcaaacttttttgactgcaagtcataataaaaataactttttacatcacgacccagaa

SEQ ID NO: 8577 - DNA, 205 bp, Homo sapiens
gggatttgtttctgattgaaaagggagtttacaaataaaaatttaagtgtttattacaaaaacatcctctttgctgatactgaacgtcagttttagtagcatcatgaattttaaggaatctatctcggattttcatttgagaatggctattgcttggggaaaaatcaacttcggatgttttttagaaagcttatggcgtctttta

SEQ ID NO: 8578 - DNA, 427 bp, Homo sapiens
caaacctgaagtgggaattttcaggttgcatgtgagaggtggtaacagaggcttgacaacagggagggctcacactgaggagtgggtttgctgtgagaggcatgtttttgactccatgggttttttacctagtgacttaagcaagtagaggttagtagagaggcatctgtgccagtcttcatcctctgaactcttgtattgcctcaaactcttcttggaagattgcatcctgcttggctttttactcatgcaaaggaatctccaattgtccattaaatgttgaagttctatttttgtctgttttgggaaaggaaaacataaaatattgtggagaagggagggatgatgaatctctgacgtgaattttgatcatgcgtgttctatgtcattctcatctgagtgcttcttagcctttggatgtcattgt

SEQ ID NO: 8579 - DNA, 6452 bp, Homo sapiens
ttccagagtgctgggattacaggcgtgcaccactgtgcctggtgttattggtttttttttttttttaaataatgagcaaatgtatacctattataattaggaaatttagtttatggaggaaaatctcatttttctatctgtcacagaaatatgatctactttgcatgcttgtttgaatgttggaaagagtgaattgatctattaagttaggaaaagcatttcaaaaatacttgtactataattataaggtggtggtaatagtgtggccactacttctgtttcattattcaccagttaataaataaacaccttgttttttagagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcataggtcagtcctagggaatgtgtatttctctctcactttgggctacactgaagcagggaattgaattcttagtcatttttgcagtcctagtgactgttctgttcagcagcagcagccagaagttgaattggtgcttgttgcccatgtttcagtttttcacaaaacactggggctcatatactggtttgtttcacacagtatttggctctatcatgtggctatcagtgggtttaattccaagtgggaatatggtgggtgtagagggtcacagtacttggttatcttttaaatggctgtctcggagtttcttaggtacttgaaagccagattctccttattttaacttctcagtacttttggatttttggtgaatcgaatctacaattaaaccccttgggtacttttttatatctcccatattagtctgttaggttgttattagaaagttcagattataggccgggcgcagtggctcacatctataatcccagcactttgggaggctgagaaaggtggatcacctgaggtcaggagttcgagaccagcctggccaccatggcaaaaccctgtctttactaaaaatacaaaaattagccaggcatggtgacgggtgcctgtaatcccagctacttgggaggctgaggcagggataattgcttgaacctgggaggtgaaggttgcagtgagccgagatcgtgccattgcactccagcctgggcaacagagtaagactctgtctcaaaaaaaaaaaaaaaaaaaaaagattcagattatagtacgataaactactcagaaaaagtgaaagttcctaacatgaagtagcatttacaagctttgagaaataaaatggttgaacactggggcctgataaccactgcttttttaacctctgtggtttattctcttgtagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaaggtatatgatgtttttcttaataccagtaacaaaaagaaggacagaaaaaaagctgactttgctttattgttacgtgttcagcatgcatttttgagtactagatgctagtgtggtggtagacagggtataatataaagctgatttggtcagatatttgtgtggtaacgatctttaacctggccatgaagggaaccctctgcttctgtcatcttaaggcaggcattcttcactcgagggccatgaacctaatgaaaaggtataaatgctgtttgttagggatggggtctgtggtataacagattcttagaggagttcttaactctagaaagttttagaacttggtaccgtaataaattgttgacatagagctttgctgtctagaattagagtgggatttactatttcctcagccttgcaattctgattttaatggcagagttctggaaaaattaacaacatggaaaggagcaaaatgtaggatgtagcacaatatagcgtctggaaaaagggaataaaagagctaaaaagaggttactaaggcctgttaaataaatggcctgtccccacttcttgctagaattcagtgaactcataactgcacttagttgcctcaagaaggggatgctgggtttgcataatatctttgttctccatacatctccaggaggtcttcaggaagttgctgatcagttggatttgcagaggattggaaggcagcaccaggcaggctcagactcactgctgacaggaatggctttctttaggatgaaagaggtaagcttccttgaatgtgatcacaggcctctcggcagtaacttgctgaaggctaaggaggtagtggatggtctgttatgtgggctgaggtttgttgaacatttattttttatttatttattatttattttttttgagatgaagccttgctctgtcacccaggctggagtgcagtggtgcgatctcagctcactgcaacctccgcctcccgggttcaagcttttcttctgcctcagcctcctgagtagctgggattataggtgcccgccaccatgccctactaatttttgtatttttagtagagacagggtttcgccatgttggccaggctggtttcaaactcttgacctcaggtgatctgcctgccttggtctcccaaagtgctgggattacaggcatgagccactctgcctggccgaattttttgtatttttagtagacacggggtttcactatgctggccaggctggtctcgaactcctgacctcaggtgatccgcctggcttggtctcccaaagtgctgggattacaggcgtgagccaccacgcccagccacatagactgtttttttagcaagttgatgtccactttgaaagtggttgttttttgttatggtattctgcatgtcacatgtttgagaggcaaaagcagcattctgacgtgaaagccactttccagtaaccaagtattcttgagcacacccaagtccagaacttcatgttcttgtcagctctaatcctttcagttatttgctttttttctgattcctgtaatagaaatatatttgttaggccacctactgacattatggtaagttctgttaattattattaaataaatactatattgaatttactataaccccttagtaaaaattagactcttaatttcttcttttagtttctttactcactgactcaggttttaaaatatattcaaagatgtagaaggagtaagacgctgctttgaaaaattgaaatattgattttgttgacacttttgaggaccggatcagattaattgatctgtagacatggatctcctttttagaactaagattgtagagagggagagtacatttcctctttgttactcttaattataaacaactgttaccatgtgttggtaaatgttctaggtcagtgattctcaactggggatgattttgccctggagggtacatttgttaatatctgtagatgattttggttgtcacaatctggtgggggagagtggtgtgctacctgtcaggatgctgctaaacatcctgtgatacactggacaagttcccccaaataattatcctaccccagtagtgccacagtggagagatcttgcgttaagtgcttactgttcgttatctcattcctcataataaccctattatcctgttttatagatagggaactatggcttaaaaggagtttaaatgactttgccaaggtcaagtgagtccggctgaatccacagcccaagcccagcccattgctctgcctgttaaagagaagggagcagttgtgttaaacagcagcagcacagagatactggcagtaaaagaatacatggaaagtatgttcagataggagagcctttctcctatagagaaaggagcatgaaaagactgcattaaaaggaaaggtttaggccgggtgcggtggctcacacctgtaatcccagcactttgggaggccgaggcaagtggatcacttgaggtcaggagttcgagaccagcctggccaacatggtgaaacctgcctctattaaaagtacaaaaattagtcaggtgtgatgacatgcacctgtaatcccagctactcgggaggctgaggcaagggaatcacttgagcctgggaggcggaggttgcagtgagtgaaaccctgtctctttttctttttctttcgagacggagtcttgcattgtcacccaggctggggtgcagtggtgtgatctcagttcactgcaacctctgcctctcgggttcaaacaattctctgcctcagcctcccaagtagctgggattacaggtgcctgccaccacgcctggctaattttttgtatttttagtagagacagggtttcaccatcttggccaggctggtcttgaactcctgacctcgtaatccacctgccttggcgccccaaagtgctgggattacaggcgtgagccactgtgcctggccgagcctttctatactattagtttttttttctagtttggtatattttcagggctttaggaaggctgggaggtggtgatgtggtagtggtttttttcttttttgagatggagtcttcgctatgttgcccaggctggagtgcagtggtacggccttggcccactgcaccctctgcctcctgggcgcaagtgattcttccgcctcagcctcccaagtagctgggattacaggtatgtgccaccatgcccggctcatttttgtacttttagtagagatggggttttgccatgttggccaggctggtctcgacctcctgaccccaagtgatctgcccgcctcagcctcacaaagtgcttggattccagacgtgagccattgcacccggccagatgtgataatatttatacttgtcatgacttctagcataactctcaccatggttctctgtcccattctgcagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcatt

SEQ ID NO: 8580 - DNA, 1328 bp, Homo sapiens
ccccaagtgtagcacagtgtgctgactgagtgcttatcttgcccaagagaaaatgctgcttttgagcacactgtacctaccatctgcattgagcagacagacttttgttttactgaagacaaaagatgtctttattttagacccagaagagacgagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttccttttcttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcatgacttttttctttaaagctagtcatttcaaaagcatattgtatttttttgaatgactacagtatggacaatttcaaaaaccaaaacccactttggattggtggaaataaaaactggtaactcactcaagtgaatgaatggtcttgcattttaaaagcttatgggaaactcaatttgaaatgattagaaaatgtcaagtattataagctggtatttaagatgcttggaaatactatttatgtttttaattttgtaaaataaagatttctttttaaccactggcattaaa

SEQ ID NO: 8581 - DNA, 200 bp, Homo sapiens
agctcactgcaacctctgcctcccaggttcaagcgattctccaacctcagcatcctgagtagctgggattacaggcatgtgccaccacgccctgctaattttgtatttttagtagagatggggtttctccatgttggtcaggctggtctcgaactcccgacctcaggtgatccacccacctcagcctcccaaagtgctgg

SEQ ID NO: 8582 - DNA, 260 bp, Homo sapiens
gggcacagtggctcacgcttgtaatcccagcactttgggaggccaaggcgggtggatcatgaggtcaggagattgagaccatcctggctaacacagtgaaaccctgtctctactaaaaacacaaaaaattagccgggcatggtggtgggcacctgtagtcccagctacttgggaggctgaggcaggagaatggcgtgaacccaggaggtggcaggttgcagtgacccaagatcgcgccactgcactccagcctgggcaac

SEQ ID NO: 8583 - DNA, 5884 bp, Homo sapiens
atggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgaggtaatgaaaatcttcatctgcccacataggctttaagcaactgttagtcaactattagaaaaaacaaaggattttttaacttatattttatattggcagcagtgttttttgaattggtagattggatggacggaacagcactgtcttgctgttggagtattaaaaactatttggcattagcagccttgtggagctaaattttcctttattttcaaaataacaagaatcagttttgatttttaaaaaataagaattgacatacataataatattaggtaatgaagctgaactactttcttaggtagacattattatcaaagagtattttgccttagggtgttgtttactggaagagaaacacgtttctgagaagttgggaaaactttctgttttaaagaaacatacagggctgggtgcggtggctcacgcttgtaatcctagcagtttgggaagccaaggtgggcgatcaccttatgtcaggagttcaagaccggcctggccaacatggtgaaaccccttctctactaaaaatacaaaaattagcctggcatggtggcatatgcctgtaatcccagctacttgggaggctgaggcaggagaattgcttgaacctgggaggcagaggttgcagtgagccaagatggcaccactgcactccagcctgggcgacagagcaagactgtctcaaaaaaaagaaaaaaaaaaagaaacatacaggatagcctgatttgtcttaagagtgaaatgatcttgaaaaaagtaaaaaaatgtacttttctttctggtagttctaataatgaagccagacatacttttgaataactaaatacatttctcagaatcatttaattaaaaagcctgaagtagttagtaccttgaaagaagttggctgttcttaggttgaattgtaaatgtgcccctggtggagaatcttgctgcagcctttgtgttgttttattttattttatttttttgagacagagtctcactctgttgcccaggctggagtacagtggcacgatcttagctcactgcaacctcccaggttcaagcagttctcctgcctcagcctcccaagtagctgggattacaggcatgtgcaccatgcctagttaatttttgtatttttagtagagacggggttttgccatgttggccaggctggtctcgaactcctgacctcaggtgatccacccgccttagccttccagagtgttggaattgcaggcctgagccaccatgcctggccttttgcattgttttaaaacgtaactctcttcttccaaccccccaaaatatgttttcatttacccttcaaagttaactttagaatgttaccacagctttataacaaggaatgtttattcacaattaacaaaggatgctttattcaaatgcaaatatgttgactcaaatattttcaaatttatggaattatcaaaaagcagccaaaaatgaaacaaagtttgaggcatgtaattcatacctaataagttaataatatatctgagatggaatcatacacatacagatctttttattacagtttgaaaaaaaataagcaggaaaaactgagtcatgaatgaattcttattatgctctgtacttatttaacctagtttatataaattgaaccacatgtttacgtttaaaaggactttgcatgttgattaatgaattagacacattgggtttattgcagggtttttttggtcatctctttaaactcttgttttctttgcaggttaaaagaatggcaaattcatatctatatttttaataactttgtatctctttttagatttgtattgaacgatgtcttgagaggggaaagagtagtggtaggagtgatgacaacagagagagcttggaaaagaggtacttggcagtttttacatacaaccacttcaatcccagacctgccttatttggtacaggaataaaagagtcacatttaaacatgtaaaatggcttgtttaagatgttaggtcaatcagtcggggcagatccagtgttctgtgagctctcctataacatgtagaagaaaggatagatacctagaaccttgcaatatttacttcttttgcagaattcagacctaccttcagtcaacaaagccaattattgacttatatgaagaaatggggaaagtcaagaaaatagatgcttctaaatctgttgatgaagtaagtgttcctagcctgtctttaaaaaaatatgtcaaataaaaatgtgattatttgttttggggtaagcaggaaaaaaagaaatactatcacagattagttagtttttcaagacactggaagccagtcatggtggctcatgcttgtaatcccagcacaagtgttcaagaccagcctgggcaacatactgggactctgtctcttaaaaaaaaaagaagacactggggactaaatgaaaaattagggtttttttcctttctgagtaaaacctaaaatgaggtttataacttcaaacttgttcttcatgagaaatgggtggtttatgaattctaaatttgctcccaagcactagaaaactggtattttaagaaatgtgagttggatcacatgaatggcaagtcatctagctcaagagctccaggcttctttcttctgccacagaacaagtagcaccacaggtgaaggtttccatgacttatcacttctctttctttttcataaatagcgatctctaaattgtggtttgcaagcgcaacaaaatttctagtgtctcttaaggaacctaacctccctttccccgattccctgaatcttcatcctcttatagtcataagataaaaaagaaaggcccaggggaagaagattcagggaatctttttttaatccattgacactttgtatagaggtgaggtaatacatgagaaaactgtgttttagaatcagaactaagaagataagccacttcagttatattttatattttattttacattttatttacagtttatattttatcaaattattggtagcctctcaagaatattttgtcctaaaagcactaatcgaatgtaatatagtcataattttatatgtattatttatataatattactgtctaaagtaaaatagatgaaactaagtatgtgattcaaaaaaatgattcattttgaaaattaatgtaaatttgatttttttgtgtgtgaccctgtttggagatggagtctttattttttatattattttatttatatatattttttgagacagtgtctcactctgttgcccaggctggagtgcaatggtgtgatctcagctcactgcaacctccgtctcctgggttcaagtaattctcctgcctcagcctcctgggtagctgggattacaggtgcccgccaccacgcctggctgatttttgtatttttagtagagacggggttttgccatgttggccaggctggtcttgaactcctgaactcaagtgatctgcccgcctcgacctcccaaagtgctgggattacagatgtgagccaccgcgccccgccaaatttgattatttttaataagaacttagctgtatggtattttaacagtacctgcttttaaaattattatcatctttttcctttacaggtttttgatgaagttgtgcagatttttgacaaggaaggctaattctaaacctgaaggcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctattttttttaaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgctatt

SEQ ID NO: 8584 - DNA, 137 bp, Homo sapiens
caaaaaagtagctgggcatggtggtgggcgcctgtagtcccagctactcaggaggctgaggcaggagaatggcgtgaacccgtgggcggagcttgcagtgagctgagactgcgccactgcacaccagcctgggcgac

SEQ ID NO: 8585 - DNA, 1671 bp, Homo sapiens
tgaagagatcacactgtactgaaacctacattattttccaaaatctctggatctgcttctgtcttgcaggcagagagctcatccagtagcccttagctcttcccagccccctcctttgatttgtgggtgccactgcggcagctgctgagtctcagtggtttctggtcttcaccaagttctgcccacccagatggtttttacctgtcctcaccagaaacctgcactgtctagattgctgaggctgcttctccttaaccgatctgctatctgtattccaggggcaccccagggttagaggtaaatggcacaggccttgaaatctccaactgctctgactccaggttggtgcacttcaatgccaagtactaaccacacaattacaggatgccaccaaaaccttgatatggggctgctgcatcctaattaaaaaaacagttaatagacattattttttagaacagttctaggtttacagaaaacttgagtggataatacagagagttctcctaggctcccctgtcctccagcacacaattttccctactagtatgttgtattagtgtggtccattcattacaattgatgaaccactgttgatacgtcattatcaactaaagtccatagtttacattagaggtcattctttgagtttcacagattatgggttttggcaattacataatgtcctaaatccccaatacagcatcatgcgaaagagtttcactgctgaaaattccctgtgcttcaccatttcacgcgtcctcctctcctccacccctgacaaccactcaccattttactacttctatctttttgactttccaagaatgtcctagagttggagtggtacagtatgtgggtttccagactggcttctttctagcattatgtactttaagttccttcatgtcttttcatggcttgataacttgttttttaaaatcagtgaatcagatttccttgtatggctacaacagtttgtttattctttcgcttggtgaaagacatcttgggcacttccaagttttggcgatgatgaataaaattgctgtaagtacttctgtgcaggattttgagtgaacttaagttttccaaagtgactgtacccttttgatttccactagcgatggaaagttctggttgctcctcatctttgacagcatttggtgtgttcacctttttgaattttagccattctaaacagcttatctgcccctactgtggaatgatgtgacagacatagaataacacttacagtgattctagttcaaaatgaggcaacatggaagggataaagaagtcactgacccaaaatagtttggaaatggagctgggcaaaatccagcagaagtttcttaattaggatcgacagcctgggaccggcccgccgtcctgtgggtctttgcctctgggctgtctgctgtgcatttcttggaaccattattatttatctttttttctcacacttttttgggtatggcttctatcgcactccaaatgtttttgagattcatccatgttgttctgtgtgtcaccagtttgttcctttagccattccatggaatgagtgtatcacagtttattgatccattcttgtattgacagatacttgaatgtttccagttttttgtattatgaataaaactgctatgaacattcttgtataagtca

SEQ ID NO: 8586 - DNA, 1657 bp, Homo sapiens
tgaagagatcacactgtactgaaacctacattattttccaaaatctctggatctgcttctgtcttgcaggcagagagctcatccagtagcccttagctcttcccagccccctcctttgatttgtgggtgccactgcggcagctgctgagtctcagtggtttctagtcttcaccaagttctgcccacccagatggtttttacctgtcctcaccagaaacctgcactgtctagattgctgaggctgcttctccttaaccgatctgctatctgtattccaggggcaccccagggttagaggtaaatggcacaggccttgaaatctccaactgctctgactccaggttggtgcacttcaatgccaagtactaaccacacaattacaggatgccaccaaaaccttgatatggggctgctgcatcctaattaaaaaaaaagttaatagacattattttttagaacagttctaggtttacagaaaacttgagtggataatacagagagttctcctaggctcccctgtcctccagcacacaattttccctactagtatgttgtattagtgtggtccattcattacaattgatgaaccactgttgatacgtcattatcaactaaagtccatagttacattagagttcattctttgagtttcacggattatgggttttggcaattacataatgtcctaaatccccaatacagcgtcatgcgaaagagtttcactgctgaaaattccctgtgcttcaccatttcacgcgtcctcctctcctccacccctgacaaccactcaccattttactacttctatctttttgactttccaagaatgtcctagagttggagtggtacagtatgtgggtttccagactggcttctttctagcattatgtactttaagttccttcatgtcttttcatggcttgataacttgttttttaaaatcagtgaatcagatttccttgtatggctacaacagtttgtttattctttcgcttggtgaaagacatcttgggcacttccaagttttggcaatgatgaataaaattgctgtaagtacttctgtgcaggattttgagtgaacttaagttttccaaagtgactgtacccttttgatttccactagcgatggaaagttctggttgctcctcatctttgacagcatttggtgtgttcacctttttgaattttagccattctaaacagcttatctgcccctactgtggaatgatgtgacagacatagaataacacttacagtgattctagttcaaaatgaggcaacatggaagggataaagaagtcactgacccaaaatagtttggaaatggagctgggcaaaatccagcagaagtttcttaattaggatcgacagcctgggaccggcccgccgtcctgtgggtctttgcctctgggctgtctgctgggcatttcttggaaccattattatttatctttttttctcgcacttttttgggtatggcttctatcgcactccaaatgtttttgagattcatccttgttgttctgtgtgtcaccagtttgttcctttagccattccatggaatgagtgtatcacagtttattgatccattcttgtattgacagatacttgaatgttttcagttttttgtattatgaataaaactgctatgaacatt

SEQ ID NO: 8587 - DNA, 1669 bp, Homo sapiens
tgaagagatcacactgtactgaaacctacattattttccaaaatctctggatctgcttctgtcttgcaggcagagagctcatccagtagcccttagctcttcccagccccctcctttgatttgtgggtgccactgcggcagctgctgagtctcagtggtttctagtcttcaccaagttctgcccacccagatggtttttacctgtcctcaccagaaacctgcactgtctagattgctgaggctgcttctccttaaccgatctgctatctgtattccaggggcaccccagggttagaggtaaatggcacaggccttgaaatctccaactgctctgactccaggttggtgcacttcaatgccaagtactaaccacacaattacaggatgccaccaaaaccttgatatggggctgctgcatcctaattaaaaaaacagttaatagacattattttttagagcagttctaggtttacagaaaacttgagtggataatacagagagttctcctaggctcccctgtcctccagcacacaattttccctactagtatgttgtattagtgtggtccattcattacaattgatgaaccactgttgatacgtcattatcaactaaagtccatagtttacattagaggtcattctttgagtttcacagattatgggttttggcaattacataatgtcctaaatccccaatacagcgtcatgcgaaagagtttcactgctgaaaattccctgtgcttcaccatttcacgcgtcctcctctcctccacccctgacaaccactcaccattttactacttctatctttttgactttccaagaatgtcctagagttggagtggtacagtatgtgggtttccagactggcttctttctagcattatgtactttaagttccttcatgtcttttcatggcttgataacttgttttttaaaatcagtgaatcagatttccttgtatggctacaacagtttgtttattctttcgcttggtgaaagacatcttgggcacttccaagttttggcaatgatgaataaaattgctgtaagtacttctgtgcaggattttgagtgaacttaagttttccaaagtgactgtacccttttgatttccactagcgatggaaagttctgcttgctcctcatctttgacagcatttggtgtgttcacctttttgaattttagccattctatacagcttatctgcccctactgtggaatgatgtgacagacatagaataacacttacagtgattctagttcaaaatgaggcacatggaagggataaagaagtcactgacccaaatagtttggaaatggagctgggcaaaatccagcagaagtttcttaattaggatcgacagcctgggaccggcccgccgtcctgtgggtctttgcctctgggctgtctgctgtgcatttcttggaaccattattatttatctttttttctcgcacttttttgggtatggcttctatcgcactccaaatgtttttgagattcatccatgttgttctgtgtgtcaccagtttgttcctttagccattccatggaatgagtgtatcacagtttattgatccattcttgtattgacagatacttgaatgtttccagttttttgtattatgaataaaactgctatgaacattcttgtataagtca

SEQ ID NO: 8588 - DNA, 1773 bp, Homo sapiens
ctccttccctccttccctcccttctttcctttcttcctttcttcttcttctttctctctcatgctctctctttttctttccttttcattctctctacttttttgaagagatcacactgtactgaaacctacattattttccaaaatctctggatctgcttctgtcttgcaggcagagagctcatccagtagcccttagctcttcccagccccctcctttgatttgtgggtgccactgcggcagctgctgagtctcagtggtttctagtcttcaccaagttctgcccacccagatggtttttacctgtcctcaccagaaacctgcactgtctagattgctgaggctgcttctccttaaccgatctgctatctgtattccaggggcaccccagggttagaggtaaatggcacaggccttgaaatctccaactgctctgactccaggttggtgcacttcaatgccaagtactaaccacacaattacaggatgccaccaaaaccttgatatggggcttctgcatcctaattaaaaaaacagttaatagacattattttttagaacagttctaggtttacagaaaacttgagtggataatacagagagttctcctaggctcccctgtcctccagcacacaattttccctactagtatgttgtattagtgtggtccattcattacaattgatgaaccactgttgatacgtcattatcaactaaagtccatagtttacattagagttcattctttgagtttcacagattatgggttttggcaattacataatgtcctaaatccccaatacagcgtcatgcgaaagagtttcactgctgaaaattccctgtgcttcaccatttcacgcatcctcctctcctccacccctgacaaccactcaccattttactacttctatctttttgactttccaagaatgtcctagagttggagtggtacagtatgtgggtttccagactggcttctttctagcattatgtactttaagttccttcatgtcttttcatggcttgataacttgttttttaaaatcagtgaatcagatttccttgtatggctacaacagtttgtttattctttcgcttggtgaaagacatcttgggcacttccaagttttggcaatgatgaataaaattgctgtaagtacttctgtgcaggattttgagtgaacttaagttttccaaagtgactgtacccttttgatttccactagcgatggaaagttctgcttgctcctcatctttgacagcatttggtgtgttcacctttttgaattttagccattctatacagcttatctgcccctactgtggaatgatgtgacagacatagaataacacttacagtgattctagttcaaaatgaggcaacatggaagggataaagaagtcactgacccaaaatagtttggaaatggagctgggcaaaatccagcagaagtttcttaattaggatcgacagcctgggaccggcccgccgtcctgtgggtctttgcctctgggctgtctgctgtgcatttcttggaagcattattacttatctttttttctcacacttttttgggtatggcttctatcgcactccaaatgtttttgagattcatccatgttgttctgtgtgtcaccagtttgttcctttagccattccatggaatgagtgtatcacagtttattgatccattcttgtattgacagatacttgaatgtttccagttttttgtattatgaataaaactgctatgaacattcttgtataagtca

SEQ ID NO: 8589 - DNA, 1773 bp, Homo sapiens
ctccttccctccttccctcccttctttcctttcttcctttcttcttcttctttctctctcatgctctctctttttctttccttttcattctctctacttttttgaagagatcacactgtactgaaacctacattattttccaaaatctctggatctgcttctgtcttgcaggcagagagctcatccagtagcccttagctcttcccagccccctcctttgatttgtgggtgccactgcggcagctgctgagtctcagtggtttctagtcttcaccaagttctgcccacccagatggtttttacctgtcctcaccagaaacctgcactgtctagattgctgaggctgcttctccttaaccgatctgctatctgtattccaggggcaccccagggttagaggtaaatggcacaggccttgaaatctccaactgctctgactccaggttggtgcacttcaatgccaagtactaaccacacaattacaggatgccaccaaaaccttgatatggggctgctgcatcctaattaaaaaaacagttaatagacattattttttagaacagttctaggtttacagaaaacttgagtggataatacagagagttctcctaggctcccctgtcctccagcacacaattttccctactagtatgttgtattagtgtggtccattcattacaattgatgaaccactgttgatacgtcattatcaactaaagtccatagtttacattagagttcattctttgagtttcacagattatgggttttggcaattacataatgtcctaaatccccaatacagcgtcatgcgaaagagtttcactgctgaaaattccctgtgcttcaccatttcacgcgtcctcctctcctccacccctgacaaccactcaccattttactacttctatctttttgactttccaagaatgtcctagagttggagtggtacagtatgtgggtttccagactggcttctttctagcattatgtactttaagttccttcatgtcttttcatggcttgataacttgttttttaaaatcagtgaatcagatttccttgtatggctacagcagtttgtttattctttcgcttggtgaaagacatcttgggcacttccaagttttggcaatgatgaataaaattgctgtaagtacttctgtgcaggattttgagtgaacttaagttttccaaagtgactgtacccttttgatttccactagcgatggaaagttctggttgctcctcatctttgacagcatttggtgtgttcacctttttgaattttagccattctaaacagcttatctgcccctactgtggaatgatgtgacagacatagaataacacttacagtgattctagttcaaaatgaggcaacatggaagggataaagaagtcactgacccaaaatagtttggaaatggagctgggcaaaatccagcagaagtttcttaattaggatcgacagcctgggaccggcccgccgtcctgtgggtctttgcctctgggctgtctgctgtgcatttcttggaaccattattatttatctttttttctcacacttttttgggtatggcttctatcgcactccaaatgtttttgagattcatccatgttgttctgtgtgtcaccagtttgttcctttagccattccatggaatgagtgtatcacagtttattgatccattcttgtattgacagatacttgaatgtttccagttttttgtattatgaataaaactgctatgaacattcttgtataagtca

SEQ ID NO: 8590 - DNA, 6070 bp, Homo sapiens
gagacagcggcggtactgggaggcgtaggtgagggtcgcgaggctgcccgagcttctgagcgagcgcggtgcttttgggaacgcgggacgggcgatctgcggcgccaggagctgggccgaggcgcggcggcgcggctgccggctgccctgtgaatgggaagttacgcgaagtccacccagcgtttctgaggtgagggcgccgcgccaggctgggcgggcggtgaatccgggacccgcgggcgcacagctgggtcgaggcgcggccgtggcaagttttgttgcgcgagcgcgggggcgggtgggggctgtggggggtcgtgcaccgccggggcctgagttccccgcgctggattcttcgcctgccgctgccgcccgcagcccaactctcgtgggcgctggggaagaaactcgctggcgggtgttctgtggcatcccagggggtggagggacggagcagcttcgggggcacgtcctcctatatcctgtagaggacactgaccccgcaccccaccctccaggccagaaatccgttccctctgcggacctgagaggcgagcgcgctcgcgcccctgacttgcaaagttggggtctttactggcctccgggcttctgctcctggcggtgtctccaggctggtgatgggcaagccaggtgtgccagctccaggatgcacatgagcagcatttgtagccatcactgaatcacctcctgactagcggggcaagcctcaaatgaaccgcaggatttcgggtagattggattgtggggttgctgtttgcactccaaagagttgctgtgatttccctgcgtctggctggctggctggcttcttagatcatctcatgtggcgtcctttcagcggagagttaaccaagacgtttggcctggcttccttgttttcctcctatcttttgcttagagctgctttcgaaaagaagtcttttctggcagtggtatcttttctttgggttacagtgttgttcatcctttctttgccaaaagaatgaatcccagtgcttcaggaagttaaagaaaagatctgctggtagtgttctgagctgatatgcgttagtagctttttgtttttaaattctattggtaaaatttcactagtgaaccagaagctactttttctattctgaaatgctagctttaagatttctgagaactttgcgtcaaagaaatcttggaaaagttactgaagtatacagaagttcacaattttacatgtgcaggtggcccgggcgcagtgatcacacctgtaatcccagcactttgggacgccaaggtgggtagatcacttgagcccaggatttccagaccagcctgggcaatgtggcaaaaccctttctctactaaaaatacagaagttagctgtgtgtggtggcgtgtgcctgtagtcccagctacccggtaggctgagttgggaggatcaccagagcccgggaggttgagattgcagtgagccgtgatcatggcagtgcactccgacctggatggcagagtgagaccctgtctcaaaaaaaaaaaaaaaaaagtaatgaatttttaccaagtgaaccaccacagatcaagaaattgaacattactagtctggggtatatttgtaggggtggcattgttggttttagaggtatatgaatgataaaactttagtattacatattgttgaacattttcccaaagtagttgtaccatttagcagggatatgctggttaccccacatcttcgctgatacctgtcagttaaaaattattttgccattctagtaggggtgcagtaatatatcagtgtggtttcattgagattgagtatcttttattgccatttatatgtcctcttttgtgacgtgcctgttaaatctttttatccagttttcattgatatgcttgttttcctgttgatttgtaatactttattctggatatgcctcctttctaggatttatatgtattgcatttcccttttttcaatctgtagcttgcgttttcactcttttatggtgttttttcatgaagggagattctctttttttttttttctttttgagacaggatctcactccatcgcccaggctggagtgcagtggcacaatcacagctcactgcaaccttgacctcacaaggctcaggtgatccccctgcctcagcccccaagtagctgggacctacaggggagtaccaccacactcagctgttttctgtatttttagtagagatgggttttgccacgttgcataggctggtctggaattcctaggctcaagtgatacacctgcctcggcctcccaaagggttgggattacaggcatgagccactgcacccagcctgagattcttcattttaatgaaattatactttattaatcttttcctttatggttactgttttttgtgtcctgtttaagaaatcaatgcctaacctaagagtatgaacacatttttctgtgttaaccttataacgattttattttagtttttgctttttttttttttcagacagggcctcagtctattattgcccaggctagagtgtggtggcaggatctcagctcactcaacctccatctcctggctcaagtgatcctcccacctcagcctcctgagtagctgcgactataggcatgtgccaccatgcctggctaattttcatattttttgtagagatggggattcaacatgtttcccaggttggtctcgaactcctgggctcaagtaatctgcccgcttcagcctcccagagtgctggaattacaggtgtgagccaccccacctggctatgattcactttttactacatggatgtgtctgcttgatccagcaccatttattgaaaagaccatccttttccttccgcaccatgtggcactttttttcataaatcgaatgactgtatggtcatctgatttatgaaattagtgtgggtctgtttctgtttctggaccaacttgggtaacatagtgagatcccatctctacaacaaataaaaataataaataaatgaataaaatttaaaaaataagtgcgtagagcagatggagtcataggtgataatttataaatgattgccagtttcttggctacatatgggtgttggtaattcagatgtgttgggtgttcaggcaaaacgtattaagtgaattatatggtgttcagaatgattgctagatgttcattgtgacttgaattagatgttatttgagcctcacagagctacagtttttactcttttatttatttgtctttttaaaatttttacaatcttcctgtcaaggcagtaactcttttatacttaattgttcttaagtatacttaattaccagaaaagctttatggatcatacctaaataagtgttaagccatttaaggggctcacgtgctgtgatataaacaatagtattctacataatagttttaggactacatcaaataatttttttttttttcttgagacagtgtctcgctctgtcgcccaggctggagtgcagtggtatgatcatggctctctgcagccttgatctctcaggctcaagcactcctcccacctcagcctccttagtagctgggtctacaggcatgcaccactgtgcccggctaattttctcctttttgtagacagggttttcctgtagtgcccagactggtttcaaactcctgggctgaaatgatcctcccaccttggcatcccaaagtgttgggatcacaggcatgagccatcacacctggccattttagttttaataatttttatatttttctaatttaaaagatgtactaaaatctcttacagctattatttatgaatatagtattcattgttgttattatgatgattttgtatgtgtttaatctgattttcaatataagctcctggcaattagagattttgtctctttgattcaccagtgtattctcagtacttgaccttgcctggcatgaaacagatattgaataaatatttcttaaatgaatgaatgaatgaacatactaataccatattcaacaacctccgagtatcacagttttcaccatctaacaaataaagtagcttgtatagagtagagtcacagtcaacctgccataaaaggacatgtcaatgaaaaataaaccttcgtatgtgtagctgctaagattttggggcttttgttaccgtagcataacctagcgaaagctcagagagacagcatatacaatatacgtgtacagatagaccagctagaccagtagatgagattccaaagctactttaataagcattaactaacgacacccacactctcttaattccctaacagaaataatggaattcttgttcactaagatctgcctcaaatattacttactttgtgaaaacttccctggctactctagtatttagtcaggactctttatttttttccccccaggctggagtacagtggtgccatcatagctcactaaccgctaactgaaggctcaaggaatcctcctgcctcagcctcccaagtagctgagactacaagtgtgcaccaccatgctcagcttatttttccttttttcttttcccagacggggtcttactatgttgcccaggctggtcaggactgttgattacatatgacagaaacccaaccacctctagttcccaccacctttcaatctgctcttccctgggtcttcccagtctccgtaaatggcagctccatccttcaagttaccgaagccctaaatctcaacgttaaccttgatttctctcttttatctcacaggcaatctgaaggcaaatcctgtttagacccaggcgaaggttcccggtgacccgggctctcaccagccaattgtcccttgccgtcctcctgagggtgcctggagcttaagcactgtgtgctcttggcctccacactggggatgccgctgactcccactgtccagggcttccagtggattctccgaggccctgatgtagaaacttccccattgggtgcaccaagagcagcctcacatggtgtgggctgacatcaagagctgccagatccaacaggtaaaaatcccgaggcattgccagctcagtggggtcagagagtcctctttgtattatgactcagatgtgaagggaagatgtcaaggtccctaaacattgcagggccttgcttggcatgcaacagatattaaataaatatttgttaaatgaatgaacaaatatccacagcatgtgctgcccatgagctgcagtgccgtggtcaggtagaagtgattttacttcaggagaggacagtgttctctccaggacttttccttactagctagatctgcatccctctcctcactcttcccctctcaccccccattctctgcccccatttctctctgtttccaccctgctgtcccctttcacctgctttctgctcttcagctttggtggctcaccccctccctgtccacctgcatcccccaggctaaggctcctacactgtcctgggtggggagatgtgtctggttttaggcagtgccctctggatgtgtccaggatggggaaacatggctcagttgccagtataatgggttaaaagtggccacttttgaaggcctttcccatctcccattccagaatcctgtagacttagaatttatgggccacagtggaattcttggttccccaggaccttgtggtggacgtcttctttcactgagcattcatggggtgactgtgaggtagtaggccctgctctgggctagaggccccacaatgagtaaatctcaggtcactaccccatggaacccactactgcaggcattgagagggggagaaagaaaggggcatggcctgtttgtgttcttctcatgtggtcacccacaggtcctgggggagtaggagccagtgcaaggagagaagtccattgagaaaggcaaatggatgacatcagacccaggggctgaggtccccaactgcagctgggtagcttctggagtggacaaggagcaacagggaagttcgtggcctggtgttctgggatccactgtctcatctcattcttgtgggcaccagaacgtatccaaagacaagactcagtgtctctggcaacagtgagcc

SEQ ID NO: 8591 - DNA, 552 bp, Homo sapiens
gggatacaggacacctgtcatgaccaccaccatgaaattgggattcaggaaggaggctagtcatataaggaatcctgtgaccagcatgagcttctatcaggccacacagggcactcaagtgaacagggcatatggggtcctggggtcatggtgagaaagggtctcattggtaaaaccttttcccttggggaggtaaataaattcttggttccttcttggtagcccttgaagataaggatggtcaaacaaaataatattatatctgcagaaagtcagatcttggtaagatttactagttgggaatccaatgttaatgccaagaagcagctgccagttgggatcaaatgtgagcctatggatcaaggtgcgtactcaaacacagagagctttttgaaagatgctaccagcagtttttccagggcagagatgggtcctttatttttctctctaatctagcccatatgcttagctgagaaggtttcttcatatcactttaaatgatgatgtccttgtacaacaattttcgaaacattctttagataagaattttat

SEQ ID NO: 8592 - DNA, 552 bp, Homo sapiens
gggatacaggacacctgtcatgaccaccaccatgaaattgggattcaggaaggaggctagtcatataaggaatcctgtgaccagcatgagcttctgtcaggccacacagggcactcaagtgaacagggcatatggggtcctggggtcatggtgagaaagtgtctcattggtaaaaccttttcccttggggaggtaaataaattcttggttccttcttggtagcccttgaagataaggatggtcaaacaaaataatattatatctgcagaaagtcagatcttggtaagatttacttgttgggaatccaatgttaatgccaagaagcagctgccagttgggatcaaatgtgagcctatggatcaaggtgcgtactcaaacacagagagctttttgaaagatgctaccagcagtttttccagggcagagatgggtcctttatttttctctctaatctagcccatatgcttagctgagaaggtttcttcatatcactttaaatgatgatgtccttgtacaacaattttcgaaacattctttagataagaattttat

SEQ ID NO: 8593 - DNA, 552 bp, Homo sapiens
gggatacaggacacctgtcatgaccaccaccatgaaattgggattcaggaaggaggctagtcatataaggaatcctgtgaccagcatgagcttctgtcaggccacacagggcactcaagtgaacagggcatatggggtcctggggtcatggtgagaaagtgtctcattggtaaaaccttttcccttggggaggtaaataaattcttggttccttcttggtagcccttgaagataaggatggtcaaacaaaataatattatatctgcagaaagtcagatcttggtaagatttactagttgggaatccaatgttaatgccaagaagcagctgccagttgggatcaaatgtgagcctatggatcaaggtgcgtactcaaacacagagagctttttgaaagatgctaccagcagtttttccagggcagagatgggtcctttatttttctctctaatctagcccatatgcttagctgagaaggtttcttcatatcactttaaatgatgatgtccttgtacaacaattttcgaaacattctttagataagaattttat

SEQ ID NO: 8594 - DNA, 352 bp, Homo sapiens
acacactaccaaaaacaaagtagccaaaaaggaaccagaataacagaatatcagagccagaggaacatttggaggtaattcagtacctcctccttttcaacctacaggagagatagtggaacagaaacagaaatgggcctgcctgctgtgcccaaaattcattggagattgttgtggtgaagaatttcatttatgatgaaggagaaataaaccctgtcagcttaaattcaggcaggtttattgaaaaggtgaagaagcgtcttgcagaagcaaagcatggctgaggcttgtgggctctgtctgggaaaatgagcagctgacagtggctgatgctgcccctgactctggggcc

SEQ ID NO: 8595 - DNA, 552 bp, Homo sapiens
gggatacaggacacctgtcatgaccaccaccatgaaattgggattcaggaaggaggctagtcatataaggaatcctgtgaccagcatgagcttctatcaggccacacagggcactcaagtgaacagggcatatggggtcctggggtcatggtgagaaagtgtctcattggtaaaaccttttcccttggggaggtaaataaattcttggttccttcttggtagcccttgaagataaggatggtcaaacaaaataatattatatctgcagaaagtcagatcttggtaagatttactagttgggaatccaatgttaatgccaagaagcagctgccagttgggatcaaatgtgagcctatggatcaaggtgcgtactcaaacacagagagctttttaaaagatgctaccagcagtttttccagggcagagatgggtcctttatttttctctctaatctagcccatatgcttagctgagaaggtttcttcatatcactttaaatgatgatgtccttgtacaacaattttcgaaacattctttagataagaattttat

SEQ ID NO: 8596 - DNA, 6064 bp, Homo sapiens
gagacagcggcggtactgggaggcgtaggtgagggtcgcgaggctgcccgagcttctgagcgagcgcggtgcttttgggaacgcgggacgggcgatctgcggcgccaggagctgggccgaggcgcggcggcgcggctgccggctgccctgtgaatgggaagttacgcgaagtccacccagcgtttctgaggtgagggcgccgcgccaggctgggcgggcggtgaatccgggacccgcgggcgcacagctgggtcgaggcgcggccgtggcaagtttggttgcgcgagcgcgggggcgggtggggggtgtgaggggtcatgcaccgccggggcctgtgttccccgcgctggattcttcgcctgccgctgccgcccgcagcccaactctcgtgggcgctggggaagaaactcgctggcgggtgttctgtggcatcccagggggtggagggacggagcagcttcgggggcacgtcctcctatatcctgtagaggacactgaccccgcaccccaccctccaggccagaaatccgttccctctgcggacctgagaggcgagcgcgctcgcgcccctgacttgcaaagttggggtctttactggcctccgggcttctgctcctggcgttgtctccaggctggtgatgggcaagccaggtgtgccagctccaggatgcacatgagcagcatttgtagccatcgctgaatcacctcctgactagcggggcaagcctcaaatgaaccgcaggatttcgggtagattggattgtggggttgctgtttgcactccaaagagttgctgtgatttccctgcgtctggctggctggctggcttcttagatcatctcatgtggcgtcctttcagcggagagttaaccaagacgtttggcctggcttccttgttttcctcctatcttttgcttagagctgctttcgaaaagaagtcttttctggcagtggtatcttttctttgggttacagtgttgttcatcctttctttgccaaaagaatgaatcccagtgcttcaggaagttaaagaaaagatctgctggtagtgttctgagctgatatgcgttagtagctttttgtttttaaattctattggtaaaatttcactagtgaaccagaagctactttttctattctgaaatgctagctttaagatttctgagaactttgcgtcaaagaaatcttggaaaagttactgaagtatacagaagttcacaattttacatgtgcaggtggcccgggcgcagtgatcacacctgtaatcccagcactttgggacgccaaggtgggtagatcacttgagcccaggatttccagaccagcctgggcaatgtggcaaaaccctttctctactaaaaatacaaaagttagctgtgtgtggtggcgtgtgcctgtagtcccagctacccggtaggctgagttgggaggatcaccagagcccgggaggttgagattgcagtgagccgtgatcatggcagtgcactccgacctggatggcagagtgagaccctgtctcaaaaaaaaaaaaaaaaagtaatgaatttttaccaagtgaaccaccacagatcaagaaattgaacattactagtctggggtatatttgtaggggtggcattgttggttttagaggtatatgaatgataaaactttagtattacatattgttgaacattttcccaaagtagttgtaccatttagcagggatatgctggttaccccacatcctcactgatacctgtcagttaaaaattattttgccattctagtaggggtgcagtaatatatcagtgtggtttcattgagattatcttttattgccatttatatgtcctcttttgtgacgtgcctgttaaatctttttatccagttttcattgatatgcttgttttcctgttgatctgtaatactttattctggatatgcctcctttctaggatttatatgtattgcatttcccttttttcaatctgtagcttgcgttttcactcttttatggtgttttttcatgaagggagattctctttttttttttttttctttttgagacaggatctcactccatcgcccaggctggagtgcagtggcacaatcacagctcactgcaaccttgacctcacaaggctcaggtgatccccctgcctcagcccccaagtagctgggacctacaggggagtaccaccacactcagctgttttctgtatttttagtagagatgggttttgccacgttgcataggctggtctggaattcctaggctcaagtgataacctgcctcggcctcccaaagggttgggattacagacatgagccactgcacccagcctgagattcttcattttaatgaaatcatactttatcaatcttttcctttatggttactgctttttgtgtcctgtttaagaaatcaatgcctaacctaagagtatgaacacatttttctgtgttaaccttataacgattttattttagtttttgcattttttttttcagacagggcctcagtctattgcccaggctagagtgtggtggcaggatctcagctcactcaacctccatctcctggctcaagtgatcctcccacctcagcctcctgagtagctgcgactataggcatgtgccaccatgcctggctaattttcatatttttgtagagatggggattcaacatatttcccaggttggtctcgaactcctgggctcaagtaatctgcccgcttcagcctcccagagtgctggaattacaggtgtgagccaccccacctggctatgattcactttttactacatggatgtgtctgcttgatccagcaccatttattgaaaagaccatccttttccttccgcaccatgtggcactttttttcataaatcgaatgactgtatggtcatctgatttatgaaattagtgtgggtctgtttctgtttctggaccaacttgggtaacatagtgagatcccatctctacaacaaataaaaataataaataaatgaataaaatttaaaaaataagtgcgtagagcagatggagtcataggtgataatttataaatgattgccagtttcttggctacatatgggtgttggtaattcagatgtgtcgggtgttcaggcaaaacgtattaagtgaattatatggtgttcagaatgattgctagatgttcattgtgacttgagttagatgttatttgagcctcacagagctacagttttgactcttttatttatttgtctttttaaaatttttacaatcttcctgtcaaggcagtaactcttttatacttaattgttcttaagtatacttaattaccagaaaagctttatggatcatacctaaataagtgttaagccatttaaagggctcacgtgatgtgatataaacaatagtattctacataatagttttaggactacatcaaataatttttttttttttcttgagacagtgtctcgctctgtcacccaggctggagtgcagtggtatgatcatggctctctgcagccttgatctctcaggctcaagcactcctcccacctcagcctccttagtagctgggtctacaggcatgcaccactgtgcccggctaattttctcctttttgtagacagggttttcctgtagtgcccagactggtttcaaactcctgggctgaaatgatcctcccaccttggcatcccaaagtgttgggatcacaggcatgagccatcacacctggccattttagttttaataatttttatatttttctaatttaaaagatgtactaaaatctcttacagctattatttatgaatatagtattcattgttgttattatgatgattttgtatgtgtttaatctgattttcaacataagctcctggcaattagagattttgtctctttgattcaccagtgtattctcagtacttgaccttgcctggcatgaaacagatattgaataaatatttcttaaatgaatgaatgaatgaatgaacatactaataccatattcaacaacctccgagtatcacagttttcaccatctaacaagtaaagtagcttgtatagagtagagtcacagtcaacctgccataaaaggacatgtcaatgaaaaataaaccttcgtatgtgcagctgctaagattttggggcttttgttaccgtagcataacctagcgaaagctcagagagacagcatatacaatatacgtgtacagatagaccagctagaccagtagatgagattccaaagataccttaataagcattaactaacgacacccacactctcttaattccctaacagaaataatggaattcttgttcactaagatctgcctcaaatattacttactttgtgaaaacttccctggctactctagtatttagtcaggactctttatttttttccccccaggctggagtacagtggtgccatcatagctcactaaccgctaactgaaggctcaaggaatcctcctgcctcagcctcccaagtagctgagactacaagtgtgcaccaccatgctcagcttatttttccttttttcttttcccagacggggtcttactatgttgcccaggctggtcaggactgttgattacatatgacagaaacccaaccacctctagttcccaccacctttcaacctgctcttccctgggtcttcccagtctccgtaaatggcagctccatccttcaagttaccgaagccctaaatctcaacgttaaccttgatttctctcttttatctcacaggcaatctgaaggcaaatcctgtttagacccaggcgaaggttcccggtgacccgggctctcaccagccaattgtcccttgccgtcctcctgagggtgcctggagcttaagcactgtgtgctcttggcctccacactggggatgccgctgactcccactgtccagggcttccagtggattctccgaggccctgatgtagaaacttccccattgggtgcaccaagagcagcctcacatggtgtgggctgacatcaagagctgccagatccaacaggtaaaaatcccgaggcattgccagctcagtggggtcagagagtcctctttgtattatgactcagatgtgaagggaagatgtcaaggtccctaaacatcgcagggccttgcttggcatgcaacagatattaaataaatatttgttaaatgaatgaacaaatatccacagcatgtgctgcccatgagctgcagtgccgtggtcaggtagaagtgattttacttcaggagaggacagtgttctctccaggacttttccttactagctagatctgcatccctctcctcactcttcccctctcaccccccattctctgcccccatttctctctgtttccaccctactgtcccctttcacctgctttctgctcttcagctttggtggctcaccccctccctgtccacctgcatcccccaggctaaggctcctacactgtcctgggtggggagatgtgtctggttttaggcagtgccctctggatgtgtccaggatggggaaacatggctcagttgccagtataatgggttaaaagtggccacttttgaaggcctttcccatctcccattccagaatcctgtagacttagaatttatgggccacagtggaattcttggttccccaggaccttgtggtggacgtcttctttcactgagcattcatggggtgactatgaggtagtaggccctgctctgggctagaggccccacaatgagtaaatctcaggtcactaccccatggaacccactactgcaggcattgagagggggagaaagaaaggggcatggcctgtttgtgttcttctcatgtggtcacccacaggtcctgggggagtaggagccagtgcaaggagagaagtccattgagaaaggcaaatggatgacatcagacccaggggctgaggtccccaactgcagctgggtagcttctggagtggacaaggagcaacagggaagttcgtggcctggtgttctgggatccactgtctcatctcattcttgtgggcaccagaacgtatccaaagacaagactcagtgtctctggcaacagtgagcc

SEQ ID NO: 8597 - DNA, 966 bp, Homo sapiens
ggagggacccagtgggagaaaactgaaccatgggggcagtttcctctattctgttctcgtggcagtgaataagtctcatgcgatctgcgggttttataaggggaaacccctttctcttggttctcattctctcttggctgccaccatgtaagacatgccttttgccttccctccccagacacatggaactgtgagtccattaaacctctttttctttataaatgacccagtcttgggtatctcttaatcagcagcatgaagaagaactaatacagagaggctgagtaaacaccatgtggggtgtttgcatcactgagtatcacacagccttttcactcatggttagagacggagcagaaaggtggacagacaccccagcacaaagccgagtgaagaactctgaggaaggatgcgtgcttgggaatgatgcctcgaccctggtgcctgaagccgtgcctggtgcgtggggcgtccctgtttgctgaaggaatgtggggacagagcacaggagcaaagactggctgggaccgtgtgaaagcagctctctgctgcctctcatccagcccgctgtgtccttccacagcactcatctcaatttgtggttatttgacttttctcctgtccctctgggccgtccgcccccttcgttagaatgtaaactgtgtggagtgcaggcctcgcctgtgttactgtgccctcatctcaagctcagcaccgcgtcctgccctgggggcccccatgaacatgtgccgaatgaacgagcggaggaatgggggttggggcatttttattagttttccattcgcccaatcatttctaatgtggatcattttctttcaaatgataagagcgatgtttacttttctatgtttgaaaataagataaaataaaacaaaagacgcctgttgttttctcgggcagggatctgaagggagccgagctccttctgcagaagggcgctgagaa

SEQ ID NO: 8598 - DNA, 966 bp, Homo sapiens; identical to SEQ ID NO: 8597

SEQ ID NO: 8599 - DNA, 966 bp, Homo sapiens; identical to SEQ ID NO: 8597

SEQ ID NO: 8600 - DNA, 366 bp, Homo sapiens
ctcccgagtagctgggactacaagtgcatgccatcatacttggctaatattttcaaaattttcctaaggctgggcgcggtggctcacgcctgtaatcccagcactttgggaggccgaggcaggtggatcacctgaggtcgggagtttgagtccagcctgaccaacatggagaaaccccatctctactaaaaatacaaaattagctgggcatggtggcacatgcctgtaatcccagctactagggaggctgaggcaggagaatcacttgaacctgggaggcagaggttgtggtgagccgagatcgtgccattgcaccccagcctgggcaacaagagcgaaactccatctcgaaaaaaaaaaaaaaaa

SEQ ID NO: 8601 - DNA, 366 bp, Homo sapiens; identical to SEQ ID NO: 8600

SEQ ID NO: 8602 - DNA, 366 bp, Homo sapiens; identical to SEQ ID NO: 8600

SEQ ID NO: 8603 - DNA, 6434 bp, Homo sapiens
  misc_feature (1915)..(1915): n equals a,t,g, or c
  misc_feature (2174)..(2174): n equals a,t,g, or c
aaccctaggttgttggatgatgtcagcttccatccttgtgttcgtttcaaacgctgggaatctgagcgcatcctctccttcatccctcctgatggaaacttccgcctgctgtcttaccatgtcagtgcacagaagtaagcagctcttataattaagaatggaatccgtgtatgtacatgtatgtggaaaccgtatctgtggtgattaagaactcaggctctagagttacctgggttcacattccagcttctgtggttactaattgggtaacctcaggtgagttgcttaacccctatgtatctcttttctcatctgtaaattgaaaataataaaagtgccttgttctgaaaattgaataagagaatctgaatagtgcttaacacaaagaagtgctcattaagtttgctgttatttttgttgttatgtgtctaaacaagaacattattttctcaaatcagaatctgggcatactgtgttcaatgtccctggtctaaaagaagcattaagttatgctatgaaaaagcataaaacgcagtgatttttggtcttgaacattctctttaatttggaatctaaaggcttttggaagcagttttgtatagtataaggtatgcagacagaagagagtcaggaggcctcagagccaccagtcccttcccgtgtgatgtggaatgaatcatttgggaaaatatctgagtgcttgaggtcaaagcctctggaatcagactccctggacttaaacctcatcttcagtacttagaaccttgggcaagttacttaatctcagttaagtataaggacatcagtattcatctataaaatcagtacctactacatagttacagtagcagtatctacttcatacttattgggaggattaaacacggtaggagttaaatggatagaaaccatttagcatagtgactggcaaacaggaagtactcaatacatgttaggaactgttattacttcagggttattccgtgacttctctgaatccttttcttctgtcaaatcatgacagcctaccctaccttatggggtttttgtaaggaccagatgatgtcagatgaaagcattctaaaaaaattatagagacaagaggatcacttgagcccaggagttcgagaccagcatgggcaacatggccaaaccttgtctctacaaaaaaaaaaaaaaaaaaaaaaaaaaaaaaagtaaaaattagcggggtgtgatgttgtgtgcctgtggtcccagctactcaggaggcagtggtgggaggatcacttgagcctggtatgtcgaggctgcagtgagctatgattgtgccactgcactccaaccaggctgaccgagccagaccctatctcaaaaaaaaaagaaagaaattataaaaggtccatgagctatgaatattatactccccagtgcaaatgatgactggtcacatgttacaagttaaaaacatggagacataatgacaatacatttttgtacattatgcctttgtcatagtagtgtactttttgattttgtttatattattcagagtcattagaaaagttaatttagttactagacagtagcttttcaaaaagaaaaaattagattactggggtttttttctgtttattttttcagataaaaagtaaggacatagttaagggagaagaagctacccacagggcagaaaaagcatcatgtgaaaggaagaactaccattttcccagtgcacgaatgaaatgactctttgtctctcatttccagtctggttgcaatcccagtgtatgtcaaacataacatcagtttccgggacagtagttcccttggacgctttgaaataacggtgggacccaagcagacgatggggaagaccattgagggagtgattgtcaccagccagatgcccaagggggtcctgaacatgagcctnactccatcacaggggacacacacattcgacccagtcacaaaggtagggatgagcaggacatcttgaattgctgatgttaagcagaaaccagtcggcaggttctctgtgtagactctagacctagtttggaaggtgagatgagtcaaagggaccttgttttctcctgccaggtaacttaacagtaacacgtaggattctcaatggaaagatacccagaggcagctcataatgttgtggacaggtgccctgagtttagatntcagccacctcaaatgcaggattttgctgtaattattttttggaaagaccacttctccatttttattttctttgaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggtaagtgacccagagctcaagaggctccaaagggaacaaaaacggctttctgccatatggcgcaggcaccaggaagcctttctgggcttcctgtttacaaggtttagtttcattacctgataaacaatctttagtaacatcttttctggcatgtttctggggaaaatttacaatccttcctttgaagttggcataagtgacctgaataaaagtgcctaagacacactgagaaagaaacagtattggtagaaggaagtattcactagccatttttggatcatcttagggttgttcatttcaggttcccaaggttttcagtatgagaatccatgtgcattctcagctataactgaagtgtaatttccactcctttcttctgttttcagaagactttcatgtttgctcttatttctattttggaaccactgggcctttccaggtcagttcactatagtctgtgccgaccttagcacggtagtcatcagttaccactttgggggcatttaccatgttccaggcactgttttaagctcttttcatgtgttttcttttttaatccttagaaactctgtgatgtggaagggagatgactttagctttatatgaagtttctgtttttctgtacaaacgggccttatacaatttaagtgattggaattcatttgatgtataagctcttcaatcttaaaacaataaactataaagctctataccatataaaatattcttggcttagtctagtgagaatacttaggaagcattcatttattaattactttcattgttaattcctttatttataatttacttcattattcatttgttttgttattcattttttcagtccaataatttgagaaaaatcatgcagtggtctaattttttccttatcctcattttagtctgcacattactttgtaccctttccacttcagggacaggtcttctcataggtagcttgtctgttggagcctttttttgctgtcagtatctgtcccaagactggagaatccatctgctctgcataagtggttccctgtcacagcaatgtcggtcccactgacctcagtgtattgaacagaaacagttaggcgacctgctccttttgaataatactcatgtctattttccctctctccctcctttctaggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccacccgctcccttttttccttagccttcagtgccatggaactaatcaagggaggaaaaggtcaccagggagaactggacagaactgaaacacagcaacaccagttctcaaggacaaggtgtgtgatgggggtaggaagcttggtgcttatgtaaccattttaaacgtggtttctataggaaagaccaacatttgtttagcttgcttggctttaattatctaaagccaatgaaagacttctttgttgattttttaagatagaaagattaaaaagaaagaaagatgggaagaaaatgaatgttagtcaaggaaaggccacttaaggatctgctctatgaaggagaagaaagaggaaaaagaagtaaaggagttaggaggagacacttaaatgaaagattggcaagaaaagcagtcggactctaccttaaggagggatgggaaggaaagagttgagttggtttctttctgattcctctactcatgtagaaaacacttgtacttctggaaatggactggagactttttaaatttgagtccactattgacatggaaaccccagtggaatcagattttccctcaaagaccatgatggtatcggactagttttcagacactgcctgttgctgtccatcagcacttggtctcttatcttcagtgagaaggtgacccgccttcttcccatggtggctgcctaaagtgcttcttttctaacccaaaacagttctactcacttccttttacagaattcaccggccattttcctgttacctgatccttctacaggatttttaaaaagtaagagagtttcagagaagccgatcccataatccccagtgcagccagggtttgtgtgtcatcgtactggagtagagggccgactcttcccatgaaggtgagcacagctgtgagtgagtgagctcatatctccatttgtcagtgctggactggtaccagatcgtaaccttcccgttggtcggaaacttttccatctgtcgccctagaaaaagagaaagcttaccatcgagggtgtggttgatccttgaagctgcttggtaaagttatcatttcctcagtcttttcttttgtactcctatcatgtattcattaatatctaccagtcccttttcattctaagacaaaacatttctcctaaatctctgaataaaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatttaaatatttatacaaaagggtttttgtttatagcttaaggaatgatactgtgctctgcttggtgcatggagaaaaaggaagacccatactctccacaccctagagcttttctctaaatattgtgcaaagtttttgctagttttatcttctgactttgggactagtttttgctgcagagttgtgttgctttgtgattttcctctgggatagtgtactgtacacaaccagatgtgttccacactccgtgactccgcagtttgtcctggagtgacatacacatccaccatggaaagggaagcatctctgcctgtggattctcaagtacttggaagcacctctcctgaggaacctacaggattctaaggtttcctaggtcactgaacaactaatcttggtccctgaatatttctaggtttgtaagtgcagcagttttatttcctctagaactcatcctgtttcaagggaagtacctaagaagatatagagtgtttctagggtaagggacctgcaggtgtaagcatagatgaaataactgtcctgtcacacgtgcagcaggccatggagtgtagcgggcatcgctgccgccattcctgcagcatcaccataagcagtgcagggtgtctccatcgagctgtttggttccatgtgtgtttaacatgtgcagaagtagcttctctgtttaagtttaataaagttgagtttcaccagtcttctatgtcctaagtggtttgttaccagaactaacaacagtgctatgccactcaaacctcagtagaagcagtgagtaaggaattcatcgactcaggaggatcttactgcttctgtcctgtctagccagcagacctaaagcatgtgttttgatcgattctttggtcacatctggaagatagcagatgctgatattaatgtcatttttagggttgtgagcataaggtccagatccacctagttatttttcaccagagttttaaaagacgaaatcgttgaagctgccggcatttagtctagggctttccgcattctcttgacctgcttctcttgtcttgttaatttaggcatgaaacggtgtcgcagtactctggcgtctttattccaggagaggcttcttacaagataaggcactgcgagtcgattgttacgccacacctgtaacaattttctataaacatctcatggccatcaaaaaaccttaaaactcaatgcgtactcactgtgagtgttcagtgccagctagtgctccaccccttctccctctcagccggcgttaactgtctcttcgcctgtgctcccgggtgctctgaccctggtggtgggacaggaagttggttgtatacatgtacttttctctgtggccggtaggtggggactccacgcc

SEQ ID NO: 8604 - DNA, 2930 bp, Homo sapiens
  misc_feature (1414)..(1414): n equals a,t,g, or c
aataatactcatgtctattttccctctctccctcctttctaggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccacccgctcccttttttccttagccttcagtgccatggaactaatcaagggaggaaaaggtcaccagggagaactggacagaactgaaacacagcaacaccagttctcaaggacaaggtgtgtgatgggggtaggaagcttggtgcttatgtaaccattttaaacgtggtttctataggaaagaccaacatttgtttagcttgcttggctttaattatctaaagccaatgaaagacttctttgttgattttttaagatagaaagattaaaaagaaagaaagatgggaagaaaatgaatgttagtcaaggaaaggccacttaaggatctgctctatgaaggagaagaaagaggaaaaagaagtaaaggagttaggaggagacacttaaatgaaagattggcaagaaaagcagtcggactctaccttaaggagggatgggaaggaaagagttgagttggtttctttctgattcctctactcatgtagaaaacacttgtacttctggaaatggactggagactttttaaatttgagtccactattgacatggaaaccccagtggaatcagattttccctcaaagaccatgatggtatcggactagttttcagacactgcctgttgctgtccatcagcacttggtctcttatcttcagtgagaaggtgacccgccttcttcccatggtggctgcctaaagtgcttcttttctaacccaaaacagttctactcacttccttttacagaattcaccggccattttcctgttacctgatccttctacaggatttttaaaaagtaagagagtttcagagaagccgatcccataatccccagtgcagccagggtttgtgtgtcatcgtactggagtagagggccgactcttcccatgaaggtgagcacagctgtgagtgagtgagctcatatctccatttgtcagtgctggactggtaccagatcgtaaccttcccgttggtcggaaacttttccatctgtcgccctagaaaaagagaaagcttaccatcgagggtgtggttgatccttgaagctgcttggtaaagttatcatttcctcagtcttttcttttgtactcctatcatgtattcattaatatctaccagtcccttttcattctaagacaaaacatttctcctaaatctctgaatanaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatttaaatatttatacaaaagggtttttgtttatagcttaaggaatgatactgtgctctgcttggtgcatggagaaaaaggaagacccatactctccacaccctagagcttttctctaaatattgtgcaaagtttttgctagttttatcttctgactttgggactagtttttgctgcagagttgtgttgctttgtgattttcctctgggatagtgtactgtacacaaccagatgtgttccacactccgtgactccgcagtttgtcctggagtgacatacacatccaccatggaaagggaagcatctctgcctgtggattctcaagtacttggaagcacctctcctgaggaacctacaggattctaaggtttcctaggtcactgaacaactaatcttggtccctgaatatttctaggtttgtaagtgcagcagttttatttcctctagaactcatcctgtttcaagggaagtacctaagaagatatagagtgtttctagggtaagggacctgcaggtgtaagcatagatgaaataactgtcctgtcacacgtgcagcaggccatggagtgtagcgggcatcgctgccgccattcctgcagcatcaccataagcagtgcagggtgtctccatcgagctgtttggttccatgtgtgtttaacatgtgcagaagtagcttctctgtttaagtttaataaagttgagtttcaccagtcttctatgtcctaagtggtttgttaccagaactaacaacagtgctatgccactcaaacctcagtagaagcagtgagtaaggaattcatcgactcaggaggatcttactgcttctgtcctgtctagccagcagacctaaagcatgtgttttgatcgattctttggtcacatctggaagatagcagatgctgatattaatgtcatttttagggttgtgagcataaggtccagatccacctagttatttttcaccagagttttaaaagacgaaatcgttgaagctgccggcatttagtctagggctttccgcattctcttgacctgcttctcttgtcttgttaatttaggcatgaaacggtgtcgcagtactctggcgtctttattccaggagaggcttcttacaagataaggcactgcgagtcgattgttacgccacacctgtaacaattttctataaacatctcatggccatcaaaaaaccttaaaactcaatgcgtactcactgtgagtgttcagtgccagctagtgctccaccccttctccctctcagccggcgtcaactgtctcttcgcctgtgctcccgggtgctctgaccctggtggtgggacaggaagttggttgtatacatgtacttttctctgtggccggtaggtggggactccatgcc

SEQ ID NO: 8605 - DNA, 1020 bp, Homo sapiens
gtgagtgagggctggcagctgctgggccacctcctagggaaccatagatgacgttggaccctaaatgtctatttcagtcttttctcttctgcttagtttcctcatagatggatccttcagccttctgcccaggggctgccagaactttgcttcatagctagagaccaagaccttttaaaatttgtagtagagacctcacttccttttccctaccctatccactgttgtgaatctagagccttttttgttcaatctctctagagagtaagcctttgctatttataactggaaggctctagtataagcatcttaagacttgatagacattacaagttatactctgatcaataatgtatgaatattcctgtcttacatcctctgtgtaaatacttggtattttcctttgaaaaattcaccagtgtaataaatggaaaatgatattttacatatgtttctttgattgttagagaggttgttttccatatgttttatgggatttgtatattttgtgaattttctgtccatgtctttctttggtttttattctcaagtgcttactgaattttgaattctcttgctggtgtctggaagcaaaggcctcctttatttttgctggtttggcatgattttgtctcctgacatggctctggtagtttcttgtgagggtggaggcacctgaaacactttatcaggcacatgatagacattgcctatcaaatggctcaacatcagttccacaaaaaacctaaatggccattcaagacctgtttctgcctgtttcaagttccatataggaattagatcagtagttggcaaatgacggcctgtgcgccaaaatctagcccagtctgtaaataaagtcatgctggaacacagctgtgctcctttgttgatgtgttgccgtgttgcctgtggctgctttcacatcacaatatcagaaattgagtagttgatacagagactacgtggacagcaaatctagaatatttaccatctagctctttaaaaaaaaaaaaaaaa

SEQ ID NO: 8606 - DNA, 371 bp, Homo sapiens
acacttccttcctgtgtcttttccacatgcaaacttgaggtatggcttcctgtctttagtcatttcatatagtttggtttgtgctatctttggtcatagaaattgttcttctaaaacctctccagatcatccttcatttctgtgttggacatgcatcctccatggctggttttactttacaaggggtgctccccctgaaaacagcactggcaggatggccatgcacagttgattgctgtgacagaggggcttgctgatcctgtggctttatctctatctggtgtctgctatgagtagagaaacatgggagagattgagctgcaaagcaaagccagtttatccagtgctttacagttgtggtttaaaaaaaa

SEQ ID NO: 8607 - DNA, 1786 bp, Homo sapiens
gattggatctttgggattgaattctccatcaatttccacatctcttttattccttctttttgcctcataaggggcttgtcctttttaattacacaggtgcttcttcttctttcttatttccttcctcagagctccctgcagagattttgccacagttgattgataagaagatattgattccaaggtcagagttcagaaatattcttataaatgaatcatcttgttaataaagggtcacccaaaaagttcgaggatacagatgttgctgaaatcagagctctcagcaattgtagcaagagagataaaatggcccaatgtcccctgctcaagaaagtaaattaaaggaaaggagagatagaatcaaaattaccatttatcaagcgtctataatatggatgcaagagtcctgtttctacaatacaaaccttatgaccttgggcgagcttcttaccatccccaaatcttagcttcttcaactgtaaagtggtatcattaacatcttcaaaggctgttgtcaggattaaatgatgtatgtaaagtgctttgcacagctgctgtcacataataaacaatatagaaatggtcgttgttaactagcattattggaattatttgtgcttttgtttaaccatcaccagtatcctaagtgataggcatcaactagaattctaggttggaaaatcataaagcaaagatattacacaactcttgcttgttgctagtgcaacagtgtttctctttatgatttacatatgaaaaacagaccaagtgatggctattagaaaagggagggatgtagaaaaataaagccagctgaggggcagaacttgtgcattttgcaaccatcctcagtttaatgtttggcattcaatcctcattactgactatgtatggcttcacaataaatcaagagtgtgctatatgagaaaatgaagatttatacaaagcgaaattgaacaaatggtgaataattgatttagctgacctgacaacacccacttataaataacacagaatgttttactttggcagtaatttagttttctgggcatcctggcttctagcaattctctatagcggcccagtgctttctgactttcccatacagaagaaaaaaaaacttagatcatgagctctgtcctcccagtatcaccctggcatgatctatagcaagtatggttcacattagacattccctgaagaatgtaccgatcctttatttagtcctctgatttaagaatatagtttggcctctacatagcaaaacttgagacatatttagttagctttaagaattacagtgtttaccagtcttataatacagtcttaagaaaaaagtaaaataaacaacataactataaaataaaccatattgtgtcattgtttaaaatgcctttgctggcctctggatataatacatttcatcttagagcacattagtgtaggaagcatttatttccaagtttattatcccaaagaatggtatagatgaatatacaaatccttgggcatatccacaccaaaggctatatgaattcagagatggcttactaaacaagatacagaagcaaatgaggacattttggcagacatctttgtagcattccagaatcatagaatattaggattgaaagtgtcctgaagagattattctgtttaacctcttgattataggctcagtttcattcaataaacatacagcgaacttctggaatgtgacagggattaggctgggattaggtgatgggtatgtttagggaggggaaatgaaaaggaaaaaaaaagg

SEQ ID NO: 8608 - DNA, 1786 bp, Homo sapiens; identical to SEQ ID NO: 8607

SEQ ID NO: 8609 - DNA, 143 bp, Homo sapiens
actgtaaagacacaggcacatgtatgtttattacagcactgttcacaatagcaatgacttgcaaccaacccaaatgcccatcaatgatagactggataaagaaaatgtggcacatatacaccatggaatactacgcagccata

SEQ ID NO: 8610 - DNA, 21982 bp, Homo sapiens; identical to SEQ ID NO: 7133

SEQ ID NO: 8611 - DNA, 98 bp, Homo sapiens; identical to SEQ ID NO: 7134

SEQ ID NO: 8612 - DNA, 110 bp, Homo sapiens; identical to SEQ ID NO: 7135

SEQ ID NO: 8613 - DNA, 1901 bp, Homo sapiens
gccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttaccgccactgctgccagcgagagccgcgggagagtgtgcagccgagtcactactgcctgcctgcctgcctgctacggtgagtgtggcccccacaatgggatggcgcagggcaggagggccatgggttcccccaccccagactaagggggcactaggggaggggccgagtcatgtgaagagggagaccctctcagacagtcgaatgtgctggtcccactaaggaaaccacctcaccctctccaacttcctgcctgaaaatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccatagcactgagtggtcaattggctcctacccttcttggcagcacagacctctgcccacacccagggacctggggaggagggcacagtgtttgtccctcactttccct

SEQ ID NO: 8614 - DNA, 6298 bp, Homo sapiens
gatagtaagccccacagtctgagaggtgactccataaaacaagaagaggcccagaaaagctttgttgacagctggagacagagatcaaacactcaaggtaccagaatccctgcttctcctgcaggggcctgcatggctctgagtaatatgcagaagaattgcccaggcctctgagaaccggtgccccgggcagtccttcagagagtccagggaagtcaaagtatgtggcttaagcagaagactttataaagtggaaagggccaagggcaggtatgtcccagagccttccgcacccacaggcatcttcctggggcttagtggcagcctagaggacagttggcatccaaagaatccttactgtttccttctgaaagccaccgaaaagatctcccatgtcagaaccttctagagtcatcttgtcttctgcaggttccattttgataaacctgctcctgaagcagcctttgatcccagggtcatccctaagcctttgccacctcctgagtagtagttctgagtctcctgctggcacccccctgcagccaccagggtttggcaggtaagcataagactcctggaaagcttgtttgggaaggagcttcctggaagcaaattcctttctggccctggccagcctgagaagtctgtgggaagggcaggcagcctggagaatttggcaggcaggctgtttggggctcttgaccttatctccatcccacacttaatctatttttctttgtgtttgttgccagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggtattaagctgcataggagtcatgattctttgtgggtctcacctgacctcttaaggtctaacccatggcacttgtactttgctcacatcttgacttatctacactagttagttctaaggcttggttcagggagttctgaagtgatgggaagtggggccaaatgggagaaccaaggaagtggtttatttgatttaattctgcctctgaacaacaggtaagcaaaaggcacacatgattaaaggaggctgctaacctctgtggaggagggccctgccccaggacaagggttaagacaaggggcctctgaacctgagatgtgggtaaggtgaagaccacacatcacaagcacgttgaagtttagtggtttccctaaggaagcagaggatgtggagagggtctgcagcccacgggctgaccttgctgggagtctctgcctgtcattgtgcccatctttagcatgcatctggggtggcctgttcttcttaaggtttgtgggtagtatattatagtgaacctagcgaatgaacactgtgatcataaattcctcccttgggattccagagccgcaagattggggagaactgtgaacacaaccagcccaccccctcatccagtaatccagtctccctcagcactctaccaaagggtcagtttctatgttggaatgattccactggctgaatatatcttaaatcatctcatctctgagctcagcactgctgtttcctagatctgtttccatctgaatatttttggttggtctggcccatgctaaaggtggtactcagctggacacagcactgcagtgtagtgtgggcagtgggatcaggcagactcaggactcaagtgcccagcaggggcccagctcatagtggctgtttttttttgttgttgtttatttgtttgtttttgtttttgttttgagacgaagttttgctcttgttgtccaagctggagtgcagtggtgcgatctcggctcactgcaacctccacttcccaggttcaagcagttctcctgcctcagcctcctgagacgctgagattacaggcacctgccaccacacctggctaattttttatatttttagtagagacagggtttcaccatgttggccaggcttgtctcaaatgccggacctcaggtgatccacctgccttggcctgccaaagtgcaaggattacaggcgtgagccaccgggcccagccttggttatttgtttaataattgttaaatgaatgaatcccaggctgggcacagtggctcctgcctgtaatctcagcactttgggaggccaaggtgggaggatcacttgagcccaggagtttgagaccagcgtgggcaacaaagcaagactcccagctctacaatttttttttttttaattagccaggcatggtggcagtgagctatgaccatgccactgcactccagcctaggtgacagagtgagaccctatctcaaagaatcccagaaaccatgtttttactggtggtagacacaccattattccactcctgttgagcttgtccacagggacattcaaaacacagccacagctgggcatttatctatttcatgtactggggctcttcataaaatttcatttaaagaggttcttaggggctgggcatggtggctcacgcctgtaatcccagcactttaggaagccgaggtgggtggatcacgaggtcaggagatcgagaccatcctggctaacatggtgaaaccccgtctctactaaaaatacaaaaaagtagctgggcgtggtggcaggcacctgtagtcccagctactcgggaggctgaggcaggagaatcgcttgaaccctggaggcggaggttgcagtgagctgagtttgcgccactgcactccagcctgggtgacagagcgagactcagtttcaaaaaaaaaaagttcttaacgctatcaaaaaataacttggaaaccactgtggtgtacataaaagtggattttccttgcagtaccttctgcaagtggcagatattggacatcttacagcccaataatgaaaccaggtaataaccatgttaaaattccagcttcccacaaagggctgcacaccctggcaactaaaaagcattgaactttttgtctgctgtgcaggatttgccctaaagtgagttcaccccacatagtgagaccttgcttcctaaggacacactgagggatatcttgaccttctgtgcttagaaactgcagatgtctgaaggggtacacacctggccagaccccatagagtgtttcagaattgccctcctccccacccaccaggccagtccatcgtgctcccccaggctatgtgggttgagcaaacagcagcagttgccttggggcttggtttattggggtaatagctttccttttgcccctgagacctggggcagtatgcccagaacccctccctcctgcacaccccacagtaggcacattctcccactggcagcagatgtgttttctggcaagtagagaaaatggctttccttgccctgtgagaggtctcataagatccagccatagccaaggccatgtttgtcacctctggaggcctggtcagtccttctgtgggcacagaacatttctctcccacctaagttaggacctgcatccctgtttgggagcatgtggaagccaggcatcccagatccaggaggtcatcccacttcctgggcgatgctacaccagataagggcctgtcctctcagctgcagcagtcttgcagtggaagtgcccacttgttcacatgaaacaagtttcatagcaagtaagtaggggtcaggccagcactgaaacccaagtctggctgaaccaactcacctgttcatactgacttgctcaattttctgttacctctagtggagtgtgaaggtaggttatggagctggggttggggagtgtcacgtctctctgggtccctgtcttttaggttccagtgtgtgttccaagtgctgccaaagtgcctcagcccagagacacccctgcctagcgtgctgctggctgttgagctcctctccctgctggcggaccacgaccagctggcacctcagctctgttcccactcaggtaaagcagggtggggcgggcatctagactgctcctgcagatcaagggaagggttggggtgggaacagggtcaagggcctcagagggcttctgcagtatgtagcccacgctctttatgagaaagggcaccctgagtgagaggtgcgctgtccttttcagaaggctgcctcctgctgctgctgtacatgtacatcacatcacggcctgacagagtggccttggagacacaatggctccagctggaacaagaggtaaaaactccagagccccttctggacactgtccccaccccatcctaagaaccaacagaatctcctttctttccgctgaggagaaacggagctttaattcattttagtaacaagagttgataaagcaactaaagaggtaaactcagtttgggggctgtgcaccacacagatgcaatgcagacaggacttggcagagttgcctgatgactgatcctgtcttggctttgggacgtgggggcagaatagggggctggaggcaggtgggttgctggtgacacatgagtgcttgtcctgggtcttccctgggaaggtcccacaccacttcttggaccccatttgtgcagacaaacagttgctgaagcaagtgaactcttatagaagcttaagaaaaccctcgcagggactggtctccttctgcccaggatggaaccactctgttcttgttctaggtggtgtggctcctggctaagcttggtgtgcagagccccttgcccccagtcactggctccaactgccagtgtaatgtggaggtgagtgggtaggggccaacagctggcagctctggtggtaagggggccccgtgcaaggactgtaggccccactgcaaaccccctcacgtgaggtggctaggctgagcggattgttagggtgcaggccatggtggcaccaggcctcagtctgcaccccccctctctcaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaaggtaagcctgccagaggccatcctgcccagcccccatggcttcttccagaggttccccaacaagtcagattcctgggtgtcccctcagcaggcccccgcccactgcagcctgttccagcactggggccattttcttttatcttcctgcctcagttcttctccaagcatattgggatgccttttgcatctatctgttgagtgtgcctggcagagccacggtttttccagaaatagccgtgtctgaattgcctttgtatcactttgtttgcagtagctgagggagcagggcctgggtgtggaagggactggttagttcctgcggacgttgggggaggagaggtgggacctgccctaggccctggcacctttgggccctcaccaggaacctctcctttttgtctcagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactgg

SEQ ID NO: 8615 - DNA, 2013 bp, Homo sapiens
ttccaattccagcagccgaggccaggaagaaagggggcagcagctccaaacgattgcatttattataaacaagtgtacagaccctagactcagaaacacaacagatttgagctaagacagctctggtgaaacagtaatagagggaggaggaacacgaggtattcatgtctgggccagagctgccatccagggccccacaccccacctttggtccagatggcccattggcccaggtgtccctgctgccagaacaccgtggactggggtacaggagttgttgcatattccatgaggctggtgtcgggaagcagggactcacagttgccaggttgtccatctctgagccaatttccctccacaacccaggggtttcagtctcatatcaactatcatgtttgaaacagaaaacaggcaaaatgtttggctaaaataaaatgaaaacactgcagggaagagaactgagtgtgctggtggacaggagccctgctcacctgtgggaagggcagggccagcaagggcagcagagctccctgggggcagctaggctgtgtgtgcatgtggccctccagctggtcccaggggagatgcggggacaggggacagtccaggcagacaggtacagctgagtagggctctgcctgaggtgttctggcatcaggaggctgcctgatccccaacaggcatgacaggctccagggagcaatgggacatctgcccaaaggatcaaagtccaacttggccagatcccaagcttcgcctgcatcatgtccctggctctgcaacgggtacccccaactccggggacgagccatggcctcaagcagcagctggctacgctgccgaaaccaggacacatctgcatcacacagaaagctgcgccaccctggtgtgacaggccctacttggtcaccctagggtaagctggagaagaactccagatgtgccctggagaggcccccacctctcaggggccacctcacagggtgccccccaccaccccattctttgagtttggcttgagattttaggaagcataatttcaggtgaggaagagaacaaagtctggtcccagcccactctggcaaggattgttccccaccttgtcagcatcagaggaagccacatatacaggcaggacacacacagcacacatggggcgtaaggaaccgtgcctggacacacacagcacacatggggcgtaaggaaccgcgcctgcacaccactcacgcacacacacaacataaccaagtggcagccagagaggccagggaatgctcagagggccgccttcggggcatccatgtaggccgggttgtaaggaggctggctggcggggtagggcgcggctgctcctcctgaaagcagagaggaccctggttggctgtgagcatggtgggctgccgtgtgagtggcaggcaagcagaaaggggcagaggcctgttgagtgatgtagtttgggatgggtgcccgagggatgctggcagagactcgggaagtcgggcagggctagagttggcaggggcactcaccagccagggtctcgtggtaggccggtgggcccatgggctgggctgggtaaggtggtgggtactgcattgggtagggtgctgctggcatccctggctgaggcggcatggtgtggtagccctggtagcttggtccagggtagctgggcggcacacttggaggctgaggataaggggcatgcaccacagtggtggatgtggtggtggtgacaaccgctgcaaagagaattccagtcaggaccctcctccatctccccaggtcttgagagccaggcttgccacccatccctccagcttagccaaagcagggcctggtcagcttcccttaccaccccagggggtcacagtggggcagggtgggcacgcttacgacgtggtcggcggcacgtcttgtaaaggcagcagcaggagcaggtgaagcagatgatgatagtgacgacagacagcacaaagatggtcaggccaacggccaaggtcgctccgaacc

SEQ ID NO: 8616 - DNA, 1901 bp, Homo sapiens; identical to SEQ ID NO: 8613

SEQ ID NO: 8617 - DNA, 6298 bp, Homo sapiens; identical to SEQ ID NO: 8614

SEQ ID NO: 8618 - DNA, 2013 bp, Homo sapiens; identical to SEQ ID NO: 8615

SEQ ID NO: 8619 - DNA, 1954 bp, Homo sapiens
ggtgaaaacaaatcaatatcacatggctaccagccagtcccgcgctcagggagtgccatagaaattcaagatcaggtactcaagattccaagcaagaattgggaaaagaggatttagatgctgagcttaagagaattccttatagtagaataagtaggttcaatctctcatgcattttctcttccttttttcctgtactttcctaccgataacaagaaaaagatgaaaaggaaggtatactgatttgtttacatttccaaaatgacaaaacagattatcaacatagaaataggttggcaacattgcaaggggtgaaggattctgattcgggaaaaggtggataactacaagacatgttggttgttgaaaacatagttttgggggcctttaccatcttcaggtacagctacatgtcagagctggctgggttgtgccaagcagagaaacctggcaactctagggggcaggtgggcagtggagataaagggggttataaaaaggtagggaggtgtgggcataaaaatcaacaagcaagaaagcccagagagagctgcaggtcaagagtcaggccaggcaagcacagatccctggggcatggcagaacaggagaggacagttcgccctgttcacgaaatctgctcaagacccaagctaaaggcctagcaaagaaaggcaggaaatagctgcaaagagaagtaaaggtgtcatgggcccaggcatcctttccggaagggtcgactcaactggatgagcatggatgtccactgctggggagagcaaagagcttgatattttaatgctttggtttctctcagaagaatgaggcaggaagacttaaccgggctttgtaaattagttaacatactatttttttttctccagttttatactcttctcagttttttttttcttttaaaaaatgtgcacaaactatttgttgcagccgtgataatattcgtagtaaagagccaaaggtgctgcgtggctgggtatgcatcaggcctgggcctccgactgcacggctccaactacacagttgtttatggagaccagtcccggcctcctctgctgagagtaaaaacaggtgtgaaaggtaaggcctaagggtttcttttgtaaacctgagctctgaggctgatggacgagttttgggctggcctgccctcctcaatacagcagaaacgcttggtaataaaagtggactcaataatttacctatagtatgtaacaaagaatgcattgtctgaattatactaggtagtatattccatcaatcagtcaacaagtgtttattaaacacctctgggcttccctggcttttgctatttggtgagaaacccaactcagtaacctaatacctgcctttgtgtgtgtgtacaaaaataaatgatgcaaaattgtaagtttcaaagacttgaataactttattggctaatattaatttagcattgttaaccatcagattaattttaggcttggggcagttttagtgattgggggagaacaagagatggacttttgagttttaggtatctgtatgtatgtactttcttgacctctgttatatttctccagataagtactgtttaaataacatataaagatgtcagatgagcaatagatagataagaatggtgcaaaaaaaaatcaaaatatgaagctactgagagcaatttctgagtctcagcatactgagttttggccccaaagtgcctggggaaaatggacatatcatctaaaaagctgtaaataccagccaacaacaggaagtcttagactcctgtcccacacttctgagctgcagggtgtgggggaagccccatgcctttatctcactgtctctatctctagcaaggaaacctgtttcctgactctgcagaatttcgctttccccctttttccttaaaagcagagttacaaaaaaaaaaaacaaaaaaaaaatcaaaaaaaaaaa

SEQ ID NO: 8620 - DNA, 1954 bp, Homo sapiens
ggtgaaaacaaatcaatatcacatggctaccagccagtcccgcgctcagggagtgccatagaaattcaagatcaggtactcaagattccaagcaagaattgggaaaagaggatttagatgctgagcttaagagaattccttatagtagaataagtaggttcaatctctcatgcattttctcttccttttttcctgtactttcctaccgataacaagaaaaagatgaaaaggaaggtatactgatttgtttacatttccaaaatgacaaaacagattatcaacatagaaataggttggcaacattgcaaggggtgaaggattctgattcgggaaaaggtggataactacaagacatgttggttgttgaaaacatagttttgggggcctttaccatcttcaggtacagctacatgtcagagctggctgggttgtgccaagcagagaaacctggcaactctagggggcaggtgggcagtggagataaagggggttataaaaaggtagggaggtgtgggcataaaaatcaacaagcaagaaagcccagagagagctgcaggtcaagagtcaggccaggcaagcacagatccctggggcatggcagaacaggagaggacagttcgccctgttcacgaaatctgctcaagacccaagctaaaggcctagcaaagaaaggcaggaaatagctgcaaagagaagtaaaggtgtcatgggcccaggcatcctttccggaagggtcgactcaactggatgagcatggatgtccactgctggggagagcaaagagcttgatattttaatgctttggtttctctcagaagaatgaggcaggaagacttaaccgggctttgtaaattagttaacatactatttttttttctccagttttatactcttctcagttttttttttcttttaaaaaatgtgcacaaactatttgttgcagccgtgataatattcgtagtaaagagccaaaggtgctgcgtggctgggtctgcatcaggcctgggcctccgactgcacggctccaactacacagttgtttatggagaccagtcccggcctcctctgctgagagtaaaaacaggtgtgaaaggtaaggcctaagggtttcttttgtaaacctgagctctgaggctgatggacgagttttgggctggcctgccctcctcaatacagcagaaacgcttggtaataaaagtggactcaataatttaccttagtgttttgacaaagaatgcattgtctgaattatactaggtagtatattccatcaatcagtcaacaagtgtttattaaacacctctgggcttccctggcttttgctatttggtgagaaacccaactcagtaacctaatacctgcctttgtgtgtgtgtacaaaaataaatgatgcaaaattgtaagtttcaaagacttgaataactttattggctaatattaatttagcattgttaaccatcagattaattttaggcttggggcagttttagtgattgggggagaacaagagatggacttttgagttttaggtatctgtatgtatgtactttcttgacctctgttatatttctccagataagtactgtttaaataacatataaagatgtcagatgagcaatagatagataagaatggtgcaaaaaaaaatcaaaatatgaagctactgagagcaatttctgagtctcagcatactgagttttggccccaaagtgcctggggaaaatggacatatcatctaaaaagctgtaaataccagccaacaacaggaagttttagactcctgtcccacacttctgagctgcagggtgtgggggaagccccatgcctttatctcactgtctctatctctagcaaggaaacctgtttcctgactctgcagaatttcgctttccccctttttccttaaaagcagagttacaaaaaaaaaaaacaaaaaaaaaatcaaaaaaaaaaa

SEQ ID NO: 8621 - DNA, 495 bp, Homo sapiens
cctgactcccccttggtgcagcccagcgctgccacctgggtggatggtccccggggccctattcccagttgctccagagccactatttaggatccaggttgtgccaccaagttcaaggctggttgtgatggtgagaacagctgctttcatagaaaaatcatcatgtcctagcacagatggccccaagcaggggaagtacaatactgcaggctgcaaatccatgtcacaggtggcaaccttggtcacagagatcgggggaagggtaatgtttacaaaggaaccttttaaaaaagattttgactggagcacattggagttctcgggagttcccaaagctaatttgtgtctcctctctgactactcacgtagttttgagcaagtgcctaccttgatttttctgtcttttaatagaattgaatcatacttgctacactttccctcatcatttagcattttgagaccttgaccttttaccaaaaaaaaaaaaaaaaaaaa

SEQ ID NO: 8622 - DNA, 495 bp, Homo sapiens
cctgactcccccttggtgcagcccagcgctgccacctgggtggatggtccccggggccctattcccagttgctccagagccactatttaggatccaggttgtgccaccaagttcaaggctggttgtgatggtgagaacagctgctttcatagaaaaatcatcatgtcctagcacagatggccccaagcaggggaagtacaatactgcaggctgcaaatccatgtcccaggtggcccccttggtcccagagatcgggggaagggtaatgtttccaaaggccccttttaaaaaagattttgactggagcccattggagttctcgggagttcccaaagctaatttgtgtctcctctctgacaactcccgtagttttgagcaagtgcctcccttgatttttctgtcttttaaaagaattgaatcatccttgctcccctttccctcatcatttagcattttgagcccttgcccttttcccaaaaaaaaaaaaaaaaaaaa

SEQ ID NO: 8623 - DNA, 36835 bp, Homo sapiens
aagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacacaaaaaaattaataaaacagaactctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagcgtaagtaatggaacgtaatagtacctgctgctaaatatatacatatatatatacacacacacacacatacacacacacacacacacacacacacacacacacacatatatatataaaatcatagatagtgctaaaggattgagtgtctattttgttgtctggtttctgtaatacaaaagtgcttctttgatgactatccgaaatggagaaatgaacataatatacccttggccagacagacctatagttgctgaatgatcgtgctgttctgctgttctataggatagacattcctgatacagattttccaatggtagttttgtgttagaagtatggaataactgagcttaaaacccttttttcatcagtccctcatttctcctccattaacttccagacaaaagccaagttttatgagtttatctaggaaataaggataatattagttaaatgagtaacagggtagtggaaacttcttgaacttaccagatgctgattgccttcagctaagtcattggtttccagaattgagatttcatgtaccagtaaaatatccagaaaaatctggcgatgatacaggtttaccagcgtgcactggttcttaaaatattctattgcctcagccagactgagtcataatatttggggtaagaggtcttggcatgtatatatatagagagagatttttaaagttcccagattattctgatttatacacagaaattaagatacatagtgtctaaagctagtgaaaccactgaggtaacaatagccaattaaaaaattgtgatatgcagggaaaataaagtttatatcaccgtctggttacttcagattgtctgagtcatcagaaagcaatgatctctaatatagactttatatatttttggccagcttatcctactcagtttagtgttcatcaggttcctcttccagcttcactttatcagtccaaatgatgtatgttaaatagttaataatttttgatgtttgcaatccccaaattggttagattgtccgtcattgcaaacgagtatataccactaattgtatgcagtcacattcccctcttcgttctgctccttcttattggtatttttagagaaaaatacaaataacctaatctgctaaatactgtaactccattctcactgttacattttgtaaatcactccttcccttccatttatgcaagattaaaaaggagcaaaggggataagatttcattacaggataaacatcagattatcacctctccagtccctctcccagcttttctgtgcatacagtgttaaattttgcagaaagtataacttcactcagaatgttttcttagagttgatttcaagtttaaaagaatattttcaagtgatttcaggtttaaagtgttcattgtatttgatagaatatgtactacaaataataaagaaaattactctctgatttctaaatcacttaggtgatgccacatattttcatggttttaaaaccaaatattgttgggtttccacttctacaattctctaaattcaggagggttctaacaactgaatatgatccttagtaaagagtatcttttgtattttgcttcagcttccttcaggcaaaagaagaactgaagctactaaaacttcctgggttcatgtacagtgaagttcctctgctggcatcctcagtaccttattttagtgtagaagaagaggatggttctgaagatggagtacatctgattgtctgtgtgcacggtttagatggtatgtgacatctatggatgtaacccagagcaactcaatatatttttttcctaatagatctcatttagtttcatttagtctttgaactaaaaaaagattttttaattgcttaaattaattgaatcttaaatgcattctgaaacagaaatatgcttaattttaattatcctaagtgtaatattagattccttcgtaagtaaattttccatggaactgacactcatgtgccaacattttgtttaatttgggattttttttttcattatactttaagttctgggatacatacgcagaacatgtaggtttgttacataggtatacacgtgccatggtggtttgctgtcatctacattaggtatttctcctaatgctatccctcccctagtcccccaccccctgacagtccccattgtgtgattgtccccctccctgtgtctatttgttctcattgttcacctcctacttagaagtgagaacatgtagtgtttggttttctgttcctgtgttagtttgctgagaatgatgatttccagcttcatccatgtccctgcaaaggacctgagctcagtggatttttttttttatcttctctcttattgttggttttgccagctgtcacctcctggcagttattttgtctccctttgatagtctttctggttcccttttacctggctgctttaaactttgtgtgctagaaaaatcggtatttctagaagttaaaatttcattaattaagttataaaaattaaattataaatacaggtacctggctttagtgctggggttttatgacagctgttttggttactcaacagtttttttttagatgtaggaactgttagaagatgccaaatatctctagaacaatgcaatattactgtattatgagattctatagcagcaaactagatttttgtggattatgaaaatattaaacaaatgtccctggtactaaattgtcataaaattggagatttttctttaaaaaaaaaaaaaaaaccagactctcaagaaataaaatattctcaatgctaacttttcttccctccctccaaacaataaagtcttcaaagaattatcccccaagaaagacttctggacccagaatctgccagaatctctggcaaattcttttttaaaaattttaagaagcaaattatccctatgttacataaattgttctagaacaatggagaaaaagatagaaagcagcccattttattccttaaagttaacctaaccttgttaccaaatccaataaagatatcacaccaacacctgccgccaaaaaacagtagaccagtctgacataaatatacttaatgggccgggcgctgtggcttacacctgtaatcccagcactttgggaggctgagatgggcggatcacaaggtcaggagatcaagaccatcctggctaacacagtgaaaccccgtctctactaaaaatacaaaaaaaattagctgggcgtggtggcgggcgcctgtagtcccagctactccggaggctgaggcaggagaatggcatgaacctgggaggcggagcttgcggtgagctgagatcgcgccactgcacttcagcctgggctacagactaagactacgtctcaaaaaaaaaaataataataatgaattcaaatatatttaaccaaactctagcacttggaattaatatattagagtaagttactataacaaataaggtttatttcccagaatggaaggataagtaagtataaggaatttcagtaataaaataccctacatcagcaaatcaagtaagaaacttcataaaatttaatatccattcctaattattacagtaagcacaaaactttgatctcaataggattagtctatttccttaatgtgattaagcatatatatttcgagcctatagaaaacttatagtttttggtgaatattagaggtacaacttttaaaatgaagaataaaagaattatctctgtcaatgcattaaatcataaaattctaaaagataaatatcaggtaaaataaaaattcagcagtttataacgacatgcttatattgttagtaaaccaaaggaatccactaaactatttttgaagataattatttttatatttatatatgagaggaattcagaaaaaatgtggaaaaataaatttgccaggcatggtgctggccagcctataatcccagctccttgggaggctgaagcaggagaatcacttgaacccaggaggcagaggttgtaatgagccaagactgagccgctgcactctagcctgggcaacagagtgagactccatctcaaacaaacaaacaaacaaaaattgtggaaaaatagagttaaaagataaaaatagaaatataaacttcatttctcagtgcaaactctgtctagttcaagacacttttgtaagcaattataccagccattctagtaaatttccaagaactgagggtcctgggaatttagtcatgtcagtgccttcttttttacacattaaaccaaagaaaaatggatcccctttacagagtttttaagataagaaaacaaagtagtcagaggaaccaaatcaggactgtaagatgaatgcctaatgatttcccatcaaaattgccctcttcatgagaataatgagtaggaatattgtcatgatggagaaggactctctggtgaagcttttccaggcatttttctgcaaaagctttggctgattttctcaaaacactctaatgataagcagatattatcattctttggtcctccagaaagtcaagaagcaaaatgccttgagcattccaaaacactgttgccttgacctttgctcttaactggtccacttttgctttgactggaccgcttctacctcttggtagctattggtttgattgtgttttgtcttcaagatgatactggtaaagccatgtttcatttcctcttacaattctttgaagaaatgctttaggatcttgataccatttgtttaatatttccattgaaagctctgctcttgtctgcagctaatttgagcacaatggttttgacacccattgagtggaaagtttgttcaactttaatttttcagtcagaattctgtaggctgaaccaattgagatgtctaagatgtcagctattgtttgtgctgttaattgtcagtcatttttaattagggcatgaacaaaatgaagtttttcctcacaaattgatgtgggtggtttactgctgtatgcttcatcttcaacattgttttttcccttctttaaacaagttacccatttgtaaactgctgatttctttgggggcatttcccaataaacttttttgtaaagcctccgttatttcaccattcttccgctgaagcttcaccataagtgtgatgtttgttcttgcttccattttagcagaatgttgtttgataaggtttctttttaaactgatttctttttttttttttttttttttttttgagacagaatctcactccgtcagcagtggcacgatctcggctcactgcaagctccacctcccaggttcagaccattctcctgcctcagcttcccgagtagctgggattacaggcgtctgccaccacacacggctaattttttgtatttttagtagggtttcactgtgttagccaggctggtcttgatctcctgacctcgtgatccacccgccacagcctcctaaagtgctgggattacaggcgtgagccaccgtgcccggcctcaaactgatttcttatccttcttagtgcctcaaactagattctgttcaaacatgttataacaaattagtatgtgtttattttggtgtaaaaaatttttgaaacccatacgtagttttttttatgatgcattttctatgaactttttgaagaacacttgtgtcttatatctgtattgtaagtatatgtgtagatgccttttgagttaattattattaaaataaactttcttagatatttaaatggatttttatttttctcagtctgtgccagtatcaccaaaggaaggtcaacagattaaatctaaaatgcattcacagtttgctgtatgattacctagaatggtgatggtaagacaccatttatagctactgtagccgggagtcaccaaagtgatgtgctaacagtttgataaataaatacactgttaggtagaaaagtgaaagccaccaaaaccacctaagaaacaaactgttggccaggcacggtggctcacgcctataatcccagcactttgggaggccaaggccagcggatcacaaggtcaggagatcaagaccatcctagctaacacggtgaaaccccatctctactaaaaatacaaaatattagctgggcatggtgggatgcacctgtagtcccagctacttgggagcttgaggcaggagaatcgctcgaacccaggaggcggaggttgcagtgagtcgagatcatgccactgcactccagcttgggcgacagagcaagactccatctcaaaaaaaaaaagaaagaaaaaagaaaacaaaaactgttgaattgacattgcctggctaatagaaatcagctttgacataaaaattgagaactctatttcattgtatattgtctgttcacaaatggcataggccataagcttgtctctaaaaactgtaaaaatatgtgatggtgtactttctaccttttactttatctcatcctttaaacatcatttttcattttttaggaaacagtgcagatctccgattagtaaaaacttacattgaacttggattgcctgggggaagaattgattttcttatgtctgagagaaatcaggtacaatatgacagtgttttcagtgaaaacaaacatttttgtaccagtttctacctaaattttgccttactacaaaatgcctgtaatagtagaaataatttttctgatttctatgaaatttaatataaatgtatatccaaaggaaatatatatgatttacattttgacttatgatctcttcacatatgaaatatttctagaatttcacatttctatagaaatatttcattaattaaaccattgtaaacatcttatgtttcatactggtagtgagctaaacaaacaaataatgcaagtattttaagaacactgaacctttttttcccctagaaatttactctctttgctcgttttaagataaaaaaattacactcactaacttctctataaaacattgaacttaaccatactttcagtacctaaattaaaaatgtttatattgttagtttttcatgtgattatacatattcccaaatataatgtatgtgctttgctttctttttagaatgatacttttgctgattttgatagcatgactgatcgtcttttggatgagataatacagtatattcagatatatagtctaacagtctcaaaaataaggtatcttctttaatattatgcaatttatttttatatttctatgaattgtataaaagttaaacagaatttgtgatagggttgtcctattctgaaatataggagactacaactcaaattaatttatagtgaaaaaaagtaaagattttagggaaagatttatatgaaatgtccaaaaaagtgtatctgtagagaagaaaataggttagtgtttgcttagagctggggaagatgggggatggtggggataactacaggatataggatttctttttgaggtggaaaaaaggtcctaaaattgattatagtgagagttaaaactctgtgaatatattttaaaacattgaattgtacactttaagtggaagaagtataggctctgtgagttacatatatgtatatgatatatgtatatgatatatgtatatgaagcaacaaaaatactttcaaagtttgtatactttttttttttttttttttttttttgaggcagggtgttgctcagtcacccaggctagagagcagtggcgccatctcggctcactgcagtctcaaacccctgggctcaggcgatcctcccacctcagccccccaagtagctgggattacaggcatgcaccaccatgtccagctaatttttgtagagatgggggtttcaccgtgttacccaggctggtctcgaactcctgagctcaagtgatcctctcaccttggcctcccaaagtgctgggattacagatgtgtgccaccttgcccagccagattttatgactgctgtatacttttgtgagtcagttttccacaagcaagacatgatgattacaccagtatgagtttcattatttaattagatcttgttaatagatgtaggagagaagagtctttgtttccaaaagggtagaataaactgactatattcatatcccaactaggttagaggaagaagctggttctgcatactgtaagcttttgggcagtttgtttccaactcgaagtatagggaataagaagagagataagcagtttctacctaaagtcattttttaaaaaacagaattctgttaaaatatgggagaaggttcaggtttgttgtttggaggaagagattattttcttgttgtaattattcatttgtggatcttaaaatcttgttagcttttattcatttattttatgatgagaaaaataatatttcaacttatttattcctcctcaaaagtattgtctttcaggttagattgtcagttataatcaatcattttccagaagtgtaatctggttgattgtagactgtcagctaccatcagaattcccacccccactactttaggaagttcagttcgggagggaagtttgtcctgagcgtctcgcaagatatacctgtaagccagtgtttagacagctctcaagctctctttcactgctaattgtccccagggaatcttataccatctgttgtaaaataacagtaagtaaacaggctattttgatttaaaccaggggtccccaaaccctgggccacagactggtacctgtctgtggcctcttaggaaccagacctcacagcaggagcactggggcgggtgagcaagcattaccacctgagctcagcctcctgtcagatcatcggtgagcattagatttgtgaacgctattttaaactgcccatgcgagggatctaggctgtgtgttccttatgagaatctagtgcctgagttggaatagtttcatcccaaaagcatccccacaactcctgtttgtggaaagattgtctttggtgaaaccagtccctggtgccaaaaaggttggggaccactgatttaaaccatttcataacaaaagtgaagtgctagctacataaatattattctttttgcataatcgaagattcatagtaggaaaatgcatatattttacctatgccttgaaaatattgttagtcaaaaactgtccatctttgaagtatagaccagagaataagagaaacagatatataatttccccaagttgtcgtttataaatacaatttcatcattttgtttgaaatgatgaattaagaagtaaataatttgtgtatgtacctaagaaggcaaatatgtaatctagtcattatattattatctttaatacgtacttatatctaagcagttacaaactatgagtaaaagttttcagattaatatgttgtttctataaacatttaaattatgtaataatgaggatcttctatacattctcacattttttccttcaaaatgtggtatatcatttcaaagtatcactatacttttacaacattagaaattttcaaattgttagtattcacatccattttatagtggatcagctttgatttttgtttctaaaactaatgctgtgagaaaattaatttttttttcctcttaaagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtaaaaagttttattgttctgtattaaaaatatggaatagggagaaaaatatgaacttagtattttctggtgtttattttagaaccagtttgtcacatactggaaatttcgtgaaataaaaaatgtagctaattttctgttttgttatgcacatgaaataagttgataaaagtcattttagaaaatggcttttcttatattgagatggtatttgtcaaaattcacaagagcatttttttctttttttcattaaattctaaatatttttagtaaagttttatcttataaacagttttgtcatcccattacttgaacagataacaaacacctacatttaatacattatcaagttataacattttatatagaatattagctaattttggttcaaaaagagtaaagagatatgagaatataatttttacgaaggtgattcagaatttctgaagaagttaatatgaaagttaagaccctaaatttgattagtatttatattctcatcaacaaatatttggtactttgattttttttttttttttttttaggacagagtctcactctgtcaccaggctggagtgcagtggcgcgatctcggctcactgcaacttttgactccctggttcaagcgattctcctgcctcagcctccggagtagctgggattacaggcatacgccaccatacccagctaatttttgtatttttagtagagacggggtttcaccatgttggccagaatggtcttgatctcctgacctcgtgatccgcccgcctcggcctcccaaagtgctaggattacaggtgtgagccactgcgcctggccttgatttgccttttgtttggcttggtttttcccttagatgtttgcaaaaatgatctataaattagtcaattgattcccactgtgagaataaattatatttaactctgtctcttttcattgatccctgaaaatcttattgctatttcctttaccacttccttttaatgacaaaccataccatttttcctgtatcccatttcaagttggtgatttaaaaatacagccagttctagacttctacagtttgaaaaagaggaaatgagaaaaatgaagtccttaaataatgtataatagaacccaacatgaatcgaatgtagtactttgaatttcattcttcactaaactttttcccagatatgtttccagctatcagttttaaccaattaaaggattgttttcctttaattttctcctgtttccctaatattagaagcaatgaaaatggaaaagaatatttcatagtcttgaaaaccaacttgagtgattgaaattttgcttaatttcctgaagagcaagatgcatttaaatatgggttactgataatataaaaaaataattaatataaaacaaatgatattcagctgttattagaaaacattaaacaatttttcattctaagatgtggtctgtttgcaattagtctattatgtcataactaaactgtaattatagactgatcattctgcataggcatttgacttactactgtatttgaagtttttcttcatcttcttctttatcatttgaacaaatatattgaaaggtataatttttccagtttgttcttcatatgctattatctgtttcattactgaatgaaatagaaatagcaagctgtccatcaaccaccattaattcataattaacctaagcatgcatgtttataaatgttatcggaacatggaaatattttccaaatatatttttgattagccaacaaaaatgctaatttaggcaatgtcatcttttgaagtgaaatatatattaaaattaataatcttggcatatgtttttatatatttcatttcatacttctatatcatatatgactctctaggtctctggtttatgcagaaatggaaaaaatcaggttcgcttttgcagctgacatgtcgagatcactcagaccctcgccaaacttttttatataagcttagtaacaaagcaggtaagtatataataacagtttggaaaatatacatgtgaaaactttttaaaaaataaacatttagcaaataaattatcaacatgtctttctagtggttaaaaaaaagtgtcattctactgtaatttcctaataatgaaacagcaaactcagaactgaaactaagcagttgaaagagatttctttagtctttttcacatgactgtatttctcttttgtgagctacacagctactttgaaattgccctaagaatttcaacatttgtaactcagtgccagttttgttagtctatgtttttagaccatgtttctgcatgtcctatccccgctgttctagctgtctcccaccccaatcctcacccctttttataaactgccacgtttttctaccttcatattatgttatgttatattatattatattatattatattatattatattatattatattatattatatggctagcaagcatttctgaaagtgtcagaaactaaactattaatgattatcctttctacaattctcactactggataaatcttattacttattttttattaactaattattaaacatattccccatcttgcatatatattccaggcctttacaacctaaagttcccaactgctcctttgccatttttactgtctataaataaccttacttctgaccttatgatctccctcaattcaccctcatacatcttcccagcatattttttccagtgtcctttgaaatcctcatttgaggggaacagactgcctttattttcttcgaagaatgttattgccgcttacttctgaaagtggagacgtaactgaaacagatttttttcttcccctcctcgcccccatgtcttcactcccctggctacagagtggagtttggcaaacttttttttaaaaaaggccagatagtaagtattttggttttgtaagccatacaatctctttgcaactacttaacaataccattgtagtatgaaaacaaccacagaaaatacagaaacaaatgagcatgactgtgtttcagacaaactttattaattcaaaaacagcagtagccaaatctcacaggccatgtcttgctaatacctgctatagaagctcagttcgtcgtttactaagtaccacctaaagtaaggaaaatagccctcttgctttccatttctaattgcaatcattactcctccactgttatataaaaccactttatttgaggcttgtatcatccaagctgtgctaccatctattattctttaatataatgacctcctggttatcccaggagaataaaagacattgacacggccgggcgtggtggctcacgcctgtaatcccagcactttgggagcctgaggcgggcggatcacgaggtcaggagatcgagaccatcctggctaacacggtgaaaccccgtctctactaaaaatacaaaaaaattagccaggcgtggtggtgggcacctgtagtcccagctactcgggaggctgaggcaggagaatggcgtgaacctgggaggcggagcttgcagtgagccgcgatcatgccactgcactccaggctgggagacagagtgagactccgtctcaaaaaaaagaaagacattgacaaatgtttgtaacatgattatgtttgggaaaagattctcctcttgggtcttaacgtacttagatctggaatcatttttggtaatttgatgagtcaaccctttagataattcattatgcatcaccatgcctttctcaactccagtgtcccttcattccactccatgttgaactcatacccacggctacactgtagtcctgaaatttcagccaacgttccattctgttactgtgatgtcttatccttctttttctctcactcccttctcatctgctttttagactcatttatgattcctgctacttttttttttttttttttttttttgagacggagtctcgctctgccgcccaggctggagtgcagtggcacgatctcggctcgctgcaagctccgcctcccgagttcacaccattctcctgcctcagcctcctgagtagctgggactacaggcgcccgccaccacgcccagctaattttttgtattttttagtagagacggggtttcaccatgttagccaggctggtctcgatctcctgaccttgtgatccgcccgcctcggcctcctaaagtgctgggattacaggcgtgagccaccgcacctggctaattcctgctacattttcttaagtctccctcccgttcatggttttactcccttcctgactcaagtctcagacttcatggattacttttgtctttcatgtattactctttgtttttctatcctagtcatcttgcaaatctatattactgtttttatacctagcctttgatctcttccaaaaaagatcacacagacatgcagaatcagcagcactgtaggtccacagggtccctatctagttatctttagttagcttcctatctattcccttagacactctcccaaagtttcacctttcctcaaacatcaggttttcactgctcccttcatttctcacagttagctttgcttttgctttctactttatctttgaagttcaagacatttctttctacctaccaacattaattaacctatgttttccttttagttcagtgaaagatttataatctgttcaagaataattaccctctctgttttggaactcataccttctcatcagtatctttaaactcttactctttcagtaattaatcctttaatagataaagttattcccatttcttccatcttaataataataataaatatttctgttgatctcttattctgtacttgtccccctttcccctttttctgagagtgttggggggtagggttgaaccttttgaaagaacagtcactttattactcccccctttttttcacttttttggtttctgtctgcaccactccactgaagcttgccaaatccagtgatctctttgcttttatttgaatattaagacatttaagactactgaaaactccttcttgaaatattttcctttctccatttttgtgggatccacctctcctggtttttttccatcttggctttttttctgcttcctatatgggtttcttttctttccttgcccctttatgaaagctgttcttgtgttttagcctctgtcttctgctcttctcactctgtacattcttcttggacagcatcattccatatccatctttaccattggtagctctcaaatattaatatatatctctagcttgtcctctgtgctgtgctctagacttatacacctagaggcttacttagcatcttcatggagatgtctcatgggtgcttcaaatctagtgttttcagacagtgcatctgtcccctgattacttctctggattccacatctactggaatggcatcatctgcctagtgagaaacttagaaagtgttcttgactctgctttcttatttataccccatatctacagaattgccaagttttaaaacatttaaccttcttagtggctgatggatgcttctcttcttctttgccactgccttagtttagccttcatcacttttatttaaattattgttcaaactggttaccctgccacatgtatacccccttctccccattctcacttcctcgttagacgaaatgatcatccagtgaagccatagattatattggccatctaatatcaaaccatattggtctcatttgaaaatctttcatgatgctttgtggtattcacagtgaagtttagattccatggataagagcatcaagtcctctataatctggtctctgattctctgttttctttttatcctgcacacacacacacacacacacacacacaccctttgctgtggtcatgctattcatggtttttgattgcttgcattttctcatgctttttgtatcacctcatgtgtttttgtatcatgtgtttttgtatcacctcatgtgttttgtacctcctcatgtgtttacccatcttttcagaactaattctgtttaccttctaaaattaaactctaatgccacctgctatcaaaagcttttcttgatgccctatctgatttaatgctcctctactctcagaatactcgctgtatacctttggggttttttgagacagggtctcatgctgtcacccaggctggagtgcaatggcacaatcatagctcactgcagccttgaactcgtggatcaagcaattctcccatctcagctgtcccatatatacttttatgtccccaatcttatgtctccaggactgattttattaatgaatttcaatcctcatttgcctgctagacatctcaatttacatatcaaactgaatatgtctaaaactgtatgtcttctttggccgcctctcctgttgtcctttttttaatggtactgttctctcaattactcctttgaaacaccttagggtcatctttgattgacctcacttctttgcctcccatgtctcaaaattgttaatattatctctgaatttccatagcattatatatcaaccttttaccatactcattatagtttatctcatgtcagttatttttatgtattaacttcctttccttaagtaggatctgtcatgactactcattcccatttcccacatacatattcagtatgtaccatagctcttctagtgtacaccgattgaattaacaaatgaatcaatgatatttttaatattattttcaatattcaaaaacagtttaaatattatatagtaagatgtaaatctagcccatatattcagcgactggtagttccaagtctgaagttacttgaatttgtgaacttaagccctggccatttaaacctacatctgttcttatcctcattcctatcacccatgtcttccattctactcttgaaatatttgatattaatagatttagttattgaaaataccactgcttttgagtcctgttttagctttttcaggattctgccttaaatgttgttcttaatatgagaaagagatttgggaatgattattacatgtactgtctactattagaatcagtgaaaggaaaattctcttatagattgggttttatgattttgtttgtaatgatacagagcatcaatggtaagtttcttacagtatacagaaatatatacttgattgatcaaattacaaaatattcctacaaaatgaaacatggcatatgcttcttatgtgagaaaaacaatattagctagaaccgttgtgtggagctatggagttcataccctttgctgacaggttaggaaatacgtgaaaggcaaagctgaacataagtgttcctgaggtctatgtctttatacagcattatacaaagtaacatttaattagcaataataatagcaacataagaatatctaaactgtaaagaaaatataactgtaaagattagttcaatttttttcttttaagttattaatttattatttgccttatagtgcgtgatctggttgtactagtctaaaactgttaagaaccaaactctgacatcacacataggtattagttatagttcaaacactgactaggctacctaatttaaataaactcgtttccttattggtcaatgagaatagtagtatctcataagattattaaaaggattaaatgagataatatgtgtaaagtgattctgtagagttcaaaacttagtaaatggtaaaaaaaaaaaaatgaataaatgacttaaataagctaggtgcggaaatatcataagctaggtgcggtagctcacacctgtaatctctccagtttgggaggctgaggcaggtgaattgcttgggcttaggagtttaaggccagcctggacactgggcatggtggctcacgcctgtaatcccagcactttgggaggctgaggcaggcagatcacctaaggttgggagttcgagaccatcctgaccaaccccatctctactaaaaatacaaaattagccaggcatggtggtgtatgcctgtaatcccagctactcgggaggctgaggcaggagaatcgcttgaacctgggaggcggaggttgcagtgaaccgagatctcgccattgcactccagcctgggcaacaagagcaaaactccatcccaaaaaaaagaagaccagcctgggcaacatggtgaaacctcatctctacaaaaaaatacaaaaattagctaggcatggtcatgtgtacctgtaatcccagccactccagaggctgaggcacaagaattgcttgaaccagggatgtggaggctgcagtgacctgaggttgtgccactacactccagcgggggatagagccagactttgtctcaaaaacttaaaaaaaaataaagcccactagcgctaggcacagtggctcacgcctgtaatccccgtactttgggaggctgaggcaggtggatcacctgaggaaaggagttcgagaccagcctggccaacatggtgaaaccccatctctactaaaaatataaaaattagccaggcgtggtggcgggtgcctataatcctagctactagggaggctgaggcaggagaatcatttgaacccaggaggcgtaggatgcagtgagccaagatcgcaccattgcactccagcctgggcaacaagactgaaactctgtctcaaaaaaaaaacaaacaaaaacaaacaaacaaaaaaaaccacgagtattatagattacagaaattgacttttacacaaacaatatatatctatcttaggaaaatttttttaacagaacttttatctaaatgctgatattactagctataaaaattatttgaatgacttaaaattgtttttatgttttaagatttctctttgtactcacgagtttattagtatatacctgaattgaattaatatccattctgggaaaaaacactaaagagtactattttctggctgggcacggtggctcatgcatgtaatcccagcactttgagaggccaaggtgagtggatcacctgaggtcaggagcttgagaccagtctggccaacatggtgaaaccctgtctctactaaaaatacaaaaaaattagtccagtgtggtggcgcacacctgtaatcccagctactcagaaggctgaggcaggagaattgcttgaacccaggagttggaggcctgcagtgagccgggatcctgccactatactccagcctgggcaacagagcaagactccatctcaaaaagaaaaagagtaccattttctagtaattgtgactaatgcattggttaatactaaaatactggaaaaataataatagctaatacacatgtaacatttaccacgttctaggtgtgatttaaacacatacatattagcttatttaaccctctagggtaggaatattgtccccactttgcagatgaggacactgaagcacagagagattgaatgacttgcctgaggtcacttagctttatgaaaagccagtaagcattcgtgcatggttcacactgcatcatgttaagccaataatatacattttcaggaacttaaaaagctacttctaatagcacttttaaatatcaacaagtatttcaattgattttaaaattacgttgtagagattgaaacaagtctctcgaactatttcatgtggggtgttgggttttggggtttttttttcgggggggcatatctagtgaattgtgagaaatgagtagtccatccctagaaagttgctatgcctgtatatttacatataattactttattcacaaaatagaatatataggttcacagcaaacaaataagttaaataaaacaggaaaacatagaacaaagaaaaagagtacttaaccaatatgctattctcaagtgttttaaaacaatcaaaagtgatcatttcttttttatattttattattctaaagctacagtcttggatgccctggtttgattattgcttcagtttcttctgaacagcgaattttccgttcttttggaaaagcctaaaattacttgtctaaatcaaaatccagccatttgcccttttgccttttttatttaagcaaagcctcttctgtgggtcttccttttgaaacagtctttttctatgcaacatatcattagttaatagctttccttttattgaaagctgttcattattttaaaatgaagaaagctttttaaaagcctaaaataatttgtgtgttttgtaaaacaattgagaaatactgtattttttataaaaatcataaatgtattgggtgagaaattaccttttttgtgaacacaatagatctggtaaagggttacagaaatgttacttttaaagggaaattatctattttgattaaggaattacaattataaacattcattaaatttttatagcaacttttgacaaaacctgtggtattctacagattgctaacagaatatgtaaataatttgcaggtggcatacaagcatctcagcattggatagcagggaaaagaaagatgaaggagctagagcaatgtggaaagtaaaataaatgtataatatatagacattagatgacagcagtgttgaagtagtcaagattatattactaaagcagagagaggaatcatggccactctgacattccataatgagggctcaaaatagccaaaaaagagtctattcattgttggaatttcaaaaacaatatatccttattttaagatcttcctaaaaatacctgcttagagtctttttaccagctgttgaattctgacaaataaagtatagaaattaaataaaggtcctgctgtcctactgtggcacaaaggactctttgtatccaggaggttacaaagggatttaatcttaggtatcacttttgatatgtaaataatatgtatattttgtttctgaaagtgcgggaaagaaccagcatcagctaacattattttaggaagaaaattcattcaaatttatttaaaatgagtaaaaataagaatagtttaatattgttaagaatatgttttaaaagtacagagttttcttagcttcagcactattgatattctgggctggagaattctttgttttcaggggttgtcttgaacattgtagcatgtttagcagtatctctggcctctgcccactagatgccagtagcacatacacttttccaccttcagcagtgatgaccaaaaatatcttcagatgctgcagaatattccttggagcagaaaatcaccagtttagaaccactgctttagccagttccagaaagtaaacacaaaatgactcaaagtgaattgcattaaaactctgaagttttagaacaaatgagtagccagaagaattggaaagactttagactatgaagatgaaagtttcaattaaggtgttcatatatcaatcatgttattatatagtccagagcaatatggaagatttaatctttttcttggtaaaaagtaacaacatacttacagatttttctggttaaaccatgtcatcctataaatagggaaatcttgtcactttcccaaattaaaggtaaccgttcaacaaataattagccacttgaggggctcagtgaagtattcacccacggactagttaactacgttgtctttgagaagctagaatcaaggtaggtgtagaaaagataaacctagaatattagctcccaaaatagacttcagacatttttgttggctgtacttcaactcagatgaagtactgctgtaattcctaccagcactgctcctctggagcttgctgtgcttcactttgagtttctgccttctgtagccaacactggtagacaagaaattgaagccaaaaggttcaaaaagggccataatatatttaactaacttggttcttggctaatataaaaagcaaaccttctgtgcaaaagcacaatatcagtattaatacactttttttaaataactagaaaactggttaccaagtttaaaatgcatttttaaagtacagtactgtcgtaagaatcacatttagaagtgtaacaacatagtgtatttaatcagtatcagaatttttaaatttattttatcatcatggaatctgagagtgaaagggtatctttgaaatcctctgactaatctttactgattttgcctgcttccactgagctgcgtgaacatgaggagccatagacaccctgcagggatctcagtctaaagcagtaattccaaaccttagtgttgtttctctagagaagtacatcagaatctctgtaaagagctattttgaaaaatgtctttaatataattttatgaagaaatatataatgccttttattcttacaaatatagaaatcttttaaaaatcttaatcagtgggaaatttgtgaggaagttttaatgatcatgtaatctggcaaatacataattcattcacagaccacacatctggaggtgacaggtaatattgtttatgcctgagtggtataatgtgtactgctgttcctaatacataacaacccaaaagaaaaaaatggacaaaagagaaaagaggcagttagctaccaaaaaataaaattaaaaattaaaaaatatatatatatggaaggccaataaacaataagttaatcatttttgccattaggttggtaaaatttaaaagatgctatacagtattgatgagtgtgtgaaacagaaaccttcatatattagtggtggaaggagaaattttattatctttttggagagtacatttatcagaattttaagaacatactcaacaattccacttttggaatttttcctacagaaatctcacacaatgaggtaaaggctattcattacagtgttatactttttttatgtcctctcccttctgaagtggaatcgacataaatgtcctttgctagggaaataggagacatactaaaagttaatcctggtaattccatgtagtagttaaaagaatgagataaatttatttatacaaacatgaaaagctgtccccaaaatattaagtgaaaaaagacataaaatagtataaatactataatctcagttatatttttaaaatgaaaaataaattgtgtgtataccaagaaaggaatttgggacaaaatacagacatgccttggagatactgtggatgtggttccagatcaccataaaaaaaggtgagtcacatgaatttttttggtttcccagggcatataaaagttatatttacactatactatagtcaagagtgtgtaatagcattatatctaaaaaaaagtatgcatactttaattttaaaatactttattgttaaaaatgctaatgattatctgagccttcagttaatcataatgtttttgccaatcagggtggtggttgctgaagatagaggtggctatggcaatttcttaaattacaacaacgaggtttgctgtattattgactcttcctttcacaaaagatatctctgtagcatatgatgctgtttgatagtattttacctgtagtagaacttctttcaaaattagaatcaatcctctcaaaccctgccactgctttttcaactctttatgtaatattccaagtcttttgttgtcatttcagcaatgttcacagcatctttaccaggcatagattccatctcaagaaaccactttctctgttcatctataagaagcaactcttcatctattcaagtttgatcatgagattgcagccattcagtcacatcttcaggctccacttctaattgtagttctcttgctatttccaccacatctgcagttactttcttcactgaagtcttgaccccctcaaagttatccatgaaggttggaatcagcctcttccaaacttctgttcttgtagatatttgacctcctcccatgaatcatgaatgttcttaatggcatctgtaatggtgaattttttccaaaagcttttcattttactttgctcagatccatcaaaggaatcactacctatggcagctatcaccttacaaaatgtatttcttaagtaataagacttgaaagtcaaaataactaatggatcacttgggctgcagaatagattttgtgttagcccacatggaaacatcattaatctccttgtatatctccatgagaggtcttggttgagtagggggattgttaatgagcagtaatattttgaaaggaatctttttttctgagttataggtctcaactgtgggcttaaaatattcagtaacccatgctgtaaacagatgtgctgtaatccaggctttgttgttccattaatagagcacagagtagatttcatataattcttaagggctccaggattttaggaatgataagtattgatttcaaggccccagctgcattaatccgtaacaagagagtcagcttgccctttgaagctttgaagccaggcattgattcctttctatctatgaagtcatggatggcatcttctttcaatagaaggcaattttttcaacattgaaaatctgctttttagtgtagtcttgtcatataccttagctagatcttccagataacttgccatagcttctccatcagcacttgctgcctcaccttccacttttatgttatggagacaacatctttccttaaacttctgctggcttccagctgttctgtgcagcttcttcacttctctcagccttgagataattgaaaagagttagggtcctgctctggattaagctttggctaagggaatgttgcagcaggtttgatctttcatccacgccatccaaaccttctccgcatcagcaataaaactgttttggtgtctcatcatttgtgttttcactagagtagcccttttaatttccttcaagaacttttcctttgcattcacatcttgactaactctttggcacaagaagcctgcttttcagcgtgtcttggcttttgatatgccttcctcactaagcttaatcatttctagcttttgatttaaagtaagaaacagagccaggcatggtggctcacgcctgtaattccagaactttgcaaggccgaggctgggaatctccgaatcctaggagtttgagatcagcctgggcaacacaatgagcacctatttctacaaaaaataacaaaaaaaatacccaatgtgctgtcgcatacctgttgtttcagctacttgggaggttgaagtgggaggatcccttgagcccaggaggtagaggccgcaatgagtcatgattgcaccactgcactgtagcctgggtcagagtgagaccctgtctcaaaaaataaaaataattaatgtgagagacgtgacttttccttttgcttgagcatttagatgccattgtggggttattgatcagtccacttcccatataattgtgtctcagggattagagaggcccaaggagagagggagagagactggaaatggccagttggtggagcagtcagagcatagtccataagttcactgtcttacataggcatggttcatggcattgcaaaacaattccaatagtaacatcaaagatcactgatcacagatcaccataacagatataaaaataatgaaaaagtttgaatattgtaagaattaccaaaatgtgacacagagacacaaagtgaatatgtactattggaaaaatggtgccaatggacttgctcaatgcagggttaccaccttcaatttgtaaaaaacataatatctgcagagcacagtaaagcaaagtatagttaaacaaggtatacctgtataaaactgattgctttaaaaatattgaatttgaaaaagttaaaccttttaagtgtacaatcttctggagttgtaaacaatactaacaaacatctggcaaaatgttatattactatgaattttcagaaagaacagacatcagtgacattaatttatacataatgtatcttatataagtaatccaaatacaattgagcctggtttctgctttatataaaccctttatataaaccctttatataaacctcagttaagaaaaatgcaaaaaaatgaggcatgcctgtacacaactgttagctgtgtccttagtgaatggcagcaggagcggcggggcgagggggaaggcaagaggaggtagtaaagggggaatagttgaagattctttttttttttttttttttttgagacggaggcttgctctgttgctcaggctggagtacagtggcgtgatcttggctcactgcaacctccgccttctgggttcaagcgattttcctgcctcagcctaccaagtaactgggattacaggtgcctgccaccgtgcccagctaattttttgtatctttggtagagacggggtttcaccatattggccaggctggtctcaaattcctgaccttgtgatccacccagctcggcctcccaaagtgctaggattacaggcacgagccactgcgcccagccaaactgcttcagttctaaaaataaaaaagggtagggagagagagagggaacacagttatatgtcacctatccagaacccttgagaaatacgcatttcaggagccacttacagaattattaaaaatcaaatctgttgttagccagcatatttgagagcctactgtttgttcagcactaagcactaacatatttttaattttttttaacttggagagaaattagtaaaatattttacatctttttttcaatatagagcactaaaaatagtttaacccagcctcctcttccaacctttttcacatcaggcatcaatagcaaatgattatatttttaaagcacaattggggaagccattattagataaaccagtgaaccaaccatgttgctccccccagcagaggagaccagcctggggacttcagccatgcccagtcatctgagaaagctaaccagatcagtttctggacccacctataactgcacaccatagaagttctcctttaacctgttgatttgtttacattcattaacaatagttccatactacgctgaaataaaatggtattctcagagatacagcattttaaccctaaactaatcagtctcctgatccctagtccaatgtgtcctttattctcaactagactgcctcaacttgataagttcctagttcccaccaaaagttagggccagattttgatgttacagactacttagctaaattgagtggaccttaatatgtgggagccaatattgatattttttgagggaagacacatactttctaatataaaaatttaatctgatactttaaacagggacagatcaaagatatggtcacttttttatccctcccagacatgttgcataacttaatttttataatggatgtgaaattttctaaacgttacaatgaaatcttttttttaaaaagaagcagatataaatttaaaattcttccaaacaattaaaaataaaatttaatttgaaagaaacatataaaataaaactctcaggaaagaaatttataatggaagtcatgagaccagcaagtagagaatagcagtgatactggtaagaggagaaagcaacatgtactacatatgaagcaagccaaacttgatgttgtagtatatatgagggaattaataattaaaggtggccaatatttctcattggactagaataataataggcttatagaataaagaatttaagaaagatagcaagcaaaattttggaaatagaatttggtgttaggcatagtgcgtattaaagtgacacaaagctttgtgtcaaggtatctggcaagaaaagcaggccagaaatttagatttgaggagcagatacaaaaatgataattagagagatgagtaaagaataaaatgtcatatatgcctgaaaacaaagtaagttttgttttctctcctaaaattacccatcagaaaagagagtgctgccttatattgaaatcactaacacaagatgatttctcagttactttatttggacttacttggagaagatatactggcctgaaataaccattgtatttcggatgtaaattcaggctaccaggtagaattaaaatttggtcaaataagatgaggcctgagaattgatccttaaatttttagcattgtctaggtcattggtgatcttgaaagagcaatttacatggagtaattaggaagaaagacttctgggaataggttcagtaaagaacaggaggaaaggaagagaagggagacacgtagaaaactcatgaagaattttgctacaacactgtgccaagaaatgggtaacagcagaggagtataaggtccaggtacaggttcatttatttggttttggggggtttttttggtttttgttttttgagacggagtctcttttgtcgcccaggctggagtgcagtggcacaatatcagctcactgcaacctccgcctcctgggttcaagcgattctcctgcctcagcctcctgagtagttaggattataggtggctgccaccatgcctagctaatttttgtatttttggtagagatgggtttcgccatgttggccaggctggtctcgaactcctgacctcaggtgatccaccctcggcctcccaaagtgctgggattataggagtgagccaccatacccagccattaattatattttcataaaatataacatctcaactcattctattggaattacagatttagctcattcaatttataggaaatgtgtgccataaaatccaattggcaaagccatttctcactgtcataaacagtcaagtcaaattgactttttgtcagaaaaagttagactttatattttgcttggttttccagagacttttataccctagggccatataccttaataagatctgaagtagattggagagataatatctttctcttgtaaagtgggaaaaagtcaagtcacttttagaaaaaaaacacatctggaggttgggatctggaaatcaattttctttttttcttttttatttttagagacaagctcttgctctgtcacctgggctggagtgcagtgctacagccatggctcactgcagcctgcacctcctgggctcaaggggtcctcccacctcagcctcctgagtgagactacagttatgcagcaccacacctggctaattttcgtagagacaggatctcacttcgttgcccaggctggtctcaaactcttgggctcaggcaattttcccccctcgacctcccaaagttctgagattacaggcatgagccacctcgcccagcctggaaatcagttttcttaaagctatacacacctatctacaccatagagagtcttagatgactccaggggtaaatgtatgaatacctgtgctctaggacacatagatgattcccaaagtagtactgataatgatgaagatattagtgttaaattgtgtcacgagatgtgagaatgaaggggggggagtcattttttcttaatattttatacaatattattttaaatatatgttcaattaacttctataatagatacttgattatttcatttatctccttaggattgtatacattcaaaatgtcacctcccccaaaaaagtggtataatctaaggatggccttatttttggcatagatagtatcatacggtcacacttggctgtgtgtgaatccatactcatctcatgattaagatccttaggccaggcatggtggttcattcctgtaatcccagcattttgagaggtgggcagatcactttgaggccaggagttcaagaccagcctggccaatatggtgaaaccccatctctactgaaaatgcaaaaattagccaggtgtggtggcccacacctgtaattccagctactcaggaggctgaggcacgagaatcacttgaacccaggaggcagaggttgcagtgagccgagattgcaccactgcactccagcctgggcaacaaagtgagactctatctcaaaaaataataataataatttaaaaaaagaaaatataaatcatattaagcaagtgttaaaaatgaaaagaaagtaaaaagctttaaatgatgtactgtgaggtgttttgtttgttttaatggaagagtataattttgtttctttggaaatagtcctaaatattgatgaataccttttggaaggtaagaatgtcatggaatactttctatagaacattagtccacatattctgttcccgcctatctccacaccactgagcaacagtgcctgctcccagtgcaaacacacattcttatatcagcatcaagactacataacagtgaggtgggtttttttgtagagaacatacagaaatttggagaaaggatcatcaagtattgacaaagtcagaaacttagtactgctaaggaaatttattttttggtcacttaatatgatactaataacttgtttaaaatctagttaactactgcattataatttattatattctattcacagggcttcattatttcaaaaatgttgtgctagtgggatccctacaggatcgctatgttccttatcactctgcccgcattgaaatgtgtaaaacagctttaaaggacaaacagtcaggtaatggaataaaattatttcaaagagttataggtattaatgagctctttccaaaatttttcttgtagtcactttctctcgtatctgtcacccttctctttcctgttacttcctttccacccacttatattaacagctgtcctttttccattcttctcacctgccacgtgaactgcctttaccaatgaagtaatactttcatctaattacaaatgcctctccattttgctgcctcagaagtagttcatactttgatttcctctgaattaatgggattgacaattgtagtcatccttgtcatatgttctgctgtacctcgcttttacgcaaaggtggcagcaaggatttgcccctctttactgatagtaaatgataaagactttatttgttcttttgctatttgtgaataacaaaataaatttaaagtatagccatttggagccagaaggaaacttgagtcctgtttactcattttataactaaagcccagagatactaagtggcttagcccgaatcagttaattacagacttaggtcaagaacctggtctccgggcgtggtggctcctgcctgtaatcccagtactttgggaggccaaggcaggtagatcacctgaggtcaggagttcgagaccagcctggccaacatggtgaaaccccgtctctactaaaaatacaaaaattagccgggcgtgatggcgggtacctgtaatcccagctacttgggaggctgaggcacgagaatagcttgaacccgggagggaaaggttgcagtgagccaagatcatgctgttgcactgcagcctgagagacaagaacgaaactctgtctcaaaaaaaaaaaaaaaaaaaaaaaaccctggtctcctacctctcaatattgcctcagatccgtttttggaatgaggctgattttaaactcttaatcctttatttttctacattgtgacggtgaacagctccttaaggcaagaactgtcttaagcacatttttattgacagtgcctaacatgctgcctgctacatggtaagtactcctttattgtacatttgtgacatcaaaataaccttttcttaacttctgttctagcaaaggctagagtccacctaaggaaaaaattcagaagagtcttaaccttcagatgagtagctgaaactagataaatgtcccttattttaatagtgaggttctgtgacattggggaacaaggggaatcaaatgatgaagacatgtttagacttcttcctgtattaacatatttttaaaatagcatggaaccacaaatccaacctgactcaaaatgaaaactaagaggagaggtgggagtaaaaagttttttgatgagtatgtattaagtcagtctttctcttaaacacctctcttttctatatctgattgtacttctgtgtacttttcccttcttgtcattcctcaggcagcatcctacctgtcttctgaaatttaatatttacctctctaaagctcacacgttccatggacactgttagtactcatttattagtatatagtaatgcataagcattgtaaacaatgttttgccccttagaaggcagtttatacatttatgtggatgtattctaatcgttatcttttatgtgcttagtatgacctcagtaaatccattgtaagaattagctaaacattgtttgggcgcagtggctcatgcctgtaatcccagcactttgggaggctgaggcaggaggatcacctgagtccaggactctgagactagcttgggcaacatagcaagaccccattctaccaaaaataaaaaattagctaggctaattaaaatggtggtgcacgcctgtgtggtcccagctacttgggagggttaagatggaaggattgcttgagcctgtgatgtggaggctgcagtgagttgtgatcatgccgctgcattccagcctgggtaacagagtgacaccctgtctccaaaaacaaaaaaagaaaacaaaaataaggagagaggaacacaagtactaaataaacctatagaccaaacagaagatcatgttacttgagccaagctcacgttgttcatctgactataggaggttgctgttctttcttaaaataatttggaaattttgactgccacagaaacatctttaaagtatttgctgtaggccaagtttataattttgccttatcaaaatgtctcaccatgtctagcttattttcataattgtttaatgagttataagtgacttaacattaaagaaaactatttctttgttataggcattgctttgagttaaaaataccaaatttcggctgggcgcaggggctcacgcctgtaatcccagcactttgggaggctgaggcgggaggatcgcctgaggtcaggagttcgagaccagcctggccaacatggtgaaaccccaactctattaaaaatacaaaaattaactgggtgtggtggtgcatgcctgtaatcccagctactcaggaggcggagacaggagaatggcttgaacccgggaggcagaggttgcagtgagccaagaccacaccattgcactccagcctgggcaacaagagtgaaactccatctcaaaaataaaaaaaaaaaaaaatcaaatttcaagaataatgtataataaatttgttatttccacttgactagataatgtgattacttacattttctataaacagaaccaaaaatgatagttgaaggaaaattaaacctttttaaaaagagccatttttctgctttatatggaaataatgtaactaaattttataacttatctaaaaattggcatagtttttttattttcagttactattgtgaactaattttccttttttctgttggttccataggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagctacaa

SEQ ID NO: 8624 - DNA, 1461 bp, Homo sapiens
aggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagctacaa

SEQ ID NO: 8625 - DNA, 171 bp, Homo sapiens
aaataaaaaaaaaaaaaaatcaaatttcaagaataatgtataataaatttgttatttccacttgactagataatgtgattacttacattttctataaacagaaccaaaaatgatagttgaaggaaaattaaacctttttaaaaagagccatttttctgctttatatggaaa

SEQ ID NO: 8626 - DNA, 2491 bp, Homo sapiens
gagaaatcttacaaatgtacaatttgtgacaaggctttcgtgcgtaattcactcctgtcaagacataccagaattcacactgcagagaaaccttacaagtgtaatgaatgtgggaaggcttttaatcaacaatcacacctttcacgtcatcatagaattcatactggagagaaaccttagaaatgtgaagcatgtgacaaagtttccatttggaaatcacaccttaaagacataggagaatttatactggagagaaagcttacaaatgtaaggtttctgacaagacttgggagtgattcacactctggaacaacatactggacttcacactggagagaaaccttacaagtgtaatgagtgtggcaaagcctttggcaagcagtcaacacttattcaccatcaggcaattcatggtgtagggaaacttgactaatgtaatgattgtcacaaagtcttcagtaatgctacaacgattacaaatcattggagaatccataatgaagagagatcttacaagtgtaataaatgtggcaaatttttcagagatcgttcacatattgcaggtcatcggtgaactcatactggagagaaaccttacaaatgtcatgactgtgccaaggtcttcagtcaagcttcatcctatgcaaaacataggagaatttatacaggagagaaacctcacaagtgtgatgattgtggcaaagcctttgcttcacgttcacacgtcattagacatcagagaatctatactggacagaaatcttacaaatgtcatcagtgtggcaaggtcttcagtccaagatcactccatgcagaacatcagaaaattcatttttgagataaccgttcccaatgaaatgagtatagcaaaccatcaagcattaattgacattggagtcaattcagcattgacttgagtttgtgttgacttaacattgagttcaagcctttatttgacattcaagtgtttatgttaagaggatggggccaggtgtggtggctccgacctgtaatcccagcacgtcgggaggccaaggcacataggtcacttgaggtcaggagtttgaaaccagcatggccaacagatgtgagccacttttctcagcctgttttttgtttcttattttctattatttttttgagccagtactttttaaagagatagtacttttttcagttagtactttttgaaagggatatatcatagtaatttttaaaagggatatgaggccaggcacggaggctcatgcctataatcccagcactttgggaggccgaggcaggcagatcacggggtcaggagatcgagactttcctggctaacagggtgaatccctgtctctactaaaaatacaaaaaattagctgggcatggtggctggcgcctgtagtcccagctactccagatgctgaggcaggagaatggcatgaacctgtgaggcggagcttgcagggagtcgagatcgcaccactgggctccagcctgggcgacagagtgagagtctatctcaaaaaaaaaaaaaaaaaaaaggatatcaaagcctcggtacgtggtggctcatccctgcaatcagagtactttggtcgacccatgtgaactggtcacctaaggtcacaatttcaaaagcaccctaacatggtgaaaccccatctctactaaaaatacaaaagttagccgggggtgttggtgtgcacctttagttccagctacttgggaggctggggcatgagaattgcttaaacctaggaggtagaagttgcagtgaaccaaaattgtgccactatactgcagcctgggtggcagagtgagtctccatctcaaacaaacaaaaaataacaaaaaaagacctcaaaaatgcttttcttctcgtataatggacttccttctttttctttctggttcctcttcatttctctctttattttttatttatttatttatttattttgcagtttgagtttgagataaatctaagttataaaagttgtatttcttaatacataatgacttctgaaagatgcctttgcagcatcctataatcagctcacatcattcgtttctgtacttgtatattttccagttattttccggttgaccccagaattcgttagatttttttaaaaaacaatttcaaaatagttgctgttttaaattagttgcatccagttcatatcaatgtctgcatgctttctagtctttgttatttattgaaaacctttggtacctaaacttaagtttgattgtttcagtgtgtacttggtaaatatgtcagtggccttttaactaaacatcaaaatgtactttaaccagttagtctgtttttcagttttctttccttatgtcctttgttaaaatcttgatctgggagctatttattgcgtgtttccctcaaggccctctggtccattctggaaaaatgttgaaacatgggctggattggcatagaacgctcctccaaaagcacccgtgtattcttttcttttcttttttg

SEQ ID NO: 8627 - DNA, 6742 bp, Homo sapiens
ggtctattgacattcagggacgtggccatagaattctctcaggaggagtggaaatgcctggaccctgctcagaggactctttacagggatgtgatgctggagaattataggaacctggtctccctgggtgaggataacctcctggggatgtgcccttgtgtatctttgtattttctcttgttgcctcttgggagccacatccttacttgactaaaatggaagccgtattgattttgaaatgaaaagcttcatgatgtagcatctggactttcactgtcccctttgtttagaggttctgcattcttcatgatagctcagtggagcttccagaagtaaagtaggcataaaactttatggcagcctggtcgtggtggctcacgcctgttatcccagcaccttgggaggccaaggcgtgtggatcgctatgggtgaggagttcaaaaccagcatggccaacatgcagaaaccctgtctgtactaaaaatacaaaagttagccgggcatggtgatgcatatgtgtaatcccagctcctagagaggctgaggaaagagaattacttgaacccaggaggccaagttttgcattgagctgagaacacaccactgcactccagcccggacgacagagcaagactctgtctcaaaaaacaaagacaaaaacaaaccttatggcagactttaaagatatccagttccctgtttgcttctcctgtgctttcgattctgtagttcttggaagagagctcgatgtccacatactacatattacagtgctccccaagcattcagaatgaggcagtcagtggaggaatttgtgaaatattttcctagattcatctgtaatgtcttctttcctacagaaacatagggctgggactctagaaaagctccagcatgttatggtcctttctttttataagcaggagtctctttctgacctgctgtctccatgttggagcaagggaaagagccctggactgtggagagttaagtgaaaataacaaaaaaatccagatgggtgggaatgtattacaggtgcaaacgcaggtaagagctcagatgggcagagtggaagctccaccttcaaatagtgtgtggggaaactctctgcaagtgggagaattctgtggcaaaagaaaagtttaaatcctcacatctctgaaaagatatctttctttgcccccgcttatctctctgctctttctttctattctttctttctctctttttttatgacagagtctcactctgttgcccaggctacagtgcactggtacgatcttggctaactgcagcctctgcctcctgggctcaaaggatgcttatgccccagattcctgagtagctggaactgcaggcgctcaccaccatgcccagctaatttttgtgtttttagtagagacagtgtttcaccatgttggccaggctggtttcaaacttctgatctcaagtgacccacttgcctcagattcccaaaacactgggaccgtaggcatgagctgccatgcctaaccattgttattattttaaatagttttgtcttgtagttctttagatatttgggcagaggttattgttgcaggtatgttaaacatattaaagttatagcataataaagaaacttaaaattaccataacctggacgtgtgcagtggctgacacctgtaatcccagcactttgagaggctgagatgggcatatcacctgaagtcaggagttcaaaactagcctggttaacatgttgaaacttcgtctctactaaagttacaaaaattagccaggcgccgtggtgggtggctgtaatccaagctactcaggaggctgaggcaggagagccacttgaatctggaaggcagaggttgcagtgagccgagatcgcaccgttgcactccagcatgggagacagagtgaaactctgtttcaaaagaagaaaaaaaaaattctgtaacctgcaaaaatgacttcttcttctccactagaacatttttttatttgtcagaattatttctgtgtatgttgcatttttgttaacatatatgtacagtgtttttcatgccttttattttaaatatgaaaaaagtttagttatgaaggtatacatatgccagtttctgtatctgtccttttattaattaattactttatgtatttatgagactgagttttgctgttgtcacccaggctgaagtacgatgctgcgatctcagcttactgcaacctctgcctctcgggtacaaccgattctcctgcctcaggcccctgagaagctgggattacagatatgcaccaccacacccatctaattttgtatttttagtagagactgtttctttttgttggccaggctggactcgaactcctgacctcaggtgatctgcccagctcatcctcccaaagtgttgggattacaggcatgaaccacgatgcttggcctatctgtttttactacctttactggagaactttatttatttatttatttatttatttttattattattatttttgagatggagtctcactctgtcgcccaggccggagtgcagtggtgtgatctctgctcactgcaacctccaccttctgggttcaagcaattctccttcctcagcctcccgagtagctgcaactacaagtgtgcaccactacacccagctaagttttgtatttttagtagagatggggttccaccatgttggttggccaggatagtctcaatctcctgacctggtgatctgccagcctcagcctcccaaagtgctgggattattggcgtgaaccaccacaccaggcctggagaactttatatatgcttgtgggttggagttactctttagccttctttcatttcttttttttttttctttgagacagattttcggtctgtcacccaggctaaagtgcagtggtgtcacctcggctcactgcaacctccacttcccaggttcaagcaattctcctgcctcagccttccaagtagctgggactacaggtgagtgccaacaccgcgggctaattttttgtatttttttagtagagacagaatttcagcttgttaggcaggatggtctcaatctcctgaccttgtgatcctcccacctcagcctcccaaaatgctgggattactggcatgagccaccgcacctggcctgtctcaagttttttaaaacatgttagtgctattagatggcttcaagtattgcaagttttacagtacagactcttaacttcctttgtttaataagatttgtcagcctttggtgatgttgatgatgagatgctctttctcctgtctctgtcatttcactgtcctgttagaaatagcttagactggccagctgtgatgtctcacttttctaatcccagcactttcagagaccaaggtgggtagatcgcttgaggtcaggagtttgagaccagtctggccaacatggtgaaacctcgaatttactaaatgccaaaaatgggctaggtgcagtggctcacacctgtaatcctggcactttgggagactgcgatcggttgatcacttgaggtcacgagtttgagacaagcctggccaatatggtgaaaccctgtctctactaaaaatgcaaaaattagctgtgtatggtggcgtgcgcctgtaatcccagctacttgggaggttgaggcaggagaatcactggaacccaggaggtggaggttgcagtgcgccaagatcacgctactctactccagaccgggagacagagtaagactgggctgaggagggagaatcacttgaggtaggagaatcatgccactacactccagcctgggtgatagagcatgactccatctcaaaaacaaacaaaaaaggaaattgcttaaactgggaggcttaagacaaagacattgatttctcatgaatttggaaagtgggaaatccaagagcaaggtgccagccaaattggttcctggtgacagccttcttcatgctttagaccagccatattcctgctgtgtcctaatacagtgaaaagaggaacaggcaacacgctctttaatgtctctataaatgcactagtcctattcatgagtagtcgacacccatgctaaattctctcaaggtctgcatctgcaggaacatcctattagagaataccacatctaccaaagcttatttgagaagtagttatttatcttattttatttttttgagatggagtctcatcctgttgcccaggctggaatgcagtggcatgatctcagctcactgcaaccttcaccttctgggtacaaatgttttctgcctcagactaccaagtacctgggattacaggcaccctccaccacacccagctaatttttttgtatttttagtagagatggggtttcaccatgttgcccaggctggtctcgaactcctgatttacctgcctcagcctaccaaagtgctgggattacaggcatgcgccaccgtgcctggctgttagtcaattctcattctttataatgctgtatactttcttgacctcatatatcagaaagtagtgatcttaacatctatttcagttcttatgttgtgtgctggtggtaagtacaagttttggcttttttcttaagagggaattgtttagaattcttcagtctgtataaatctacttgttattttcttgcttgttttatcatgggttgcaatatttgattaattgatttttatgactttatatgtgagttttcggtatgtggtatgcaatataactgacactcccctagataatgtcacaaagtgccacagggtgcagtggctcatgcctgtaatcccaggtcttgggaggctgagatgtgtggatcatctgaggtcaggagttcgagaccagcctggccaacaggtttcaccaaaccccatctctactaaaaatacaaaaattagccgggcacagtggcatgtgcctgcattcccaggtgctcagaacctaaggaagagactcacatgaaccccaaggcagaggttgcattgagccaagatcataccattgcactccagcctgggtgacagagtgacactgtatctcaaaaaaataaaaatacataaaattttttttaaaagtcggccgtgtgcggtggctcatgcctataatcccagcactttgggaggctgaggcaaggggatcacaaggtcaggagatcgagaccatcctggctaacacagtgaaaccctgtctctactaaaaatacaaaaaagttagctggacatggcggtgtgtgcctgtagtccaagctgctggggaggctgaggcaggagaatggcgtgaacccgggaggtggagcttgcagtgagccgagatcatgccactgcactccagcctgggcgacagagcaagatttcgtcgcaaaaaaaaaaaaaaaaagtcacaacgtgcctgttccacatggatataggtaattttgtaacagttatttggaaaaatatggtattaacattttcctttttttgagatggagtctcactctgtcatccagggtggagtgcagtggtgcgatctcaactcaccacaatctttgcctcccaagttcaagcgattatcctgactcagcctcccaagtagctgggattacaggcacctgtgaccatgccagctactttttgtattttcagtacagatggggttttgccacattggccaggctggtcaaactcctgacgtgaggtgatctgcctgccttgccctctagaagtactgggattacaggcatgagccaccatgccctgcctttttttgttgtttgtttttttgtttttttgagatggaggctcattttgtcacctgggctggagtgcagtggtgtaatattggcttacagcaacctttgcctttggcttaacgcaattcttgtgacacagccttcagagtagctgtgagtacaggcacgggccaccatacctggctaatttttataatcttttgttatcttgtcagtgctatgattgtttgacaatacagaatttccattgattttggttatccttacaacagcttgttttggattatttaccaatatagtatattgtgtggttctttagcatttatttgtatacactaaatacgctgtaaatatgaagaatatatatttttctttttttgatgtgatagtgatgtgttttttgcaaagtgtgatacactttagggtcaccagtggaaaaacactccttactttaggctcacacatgtttgtgccctgtcagtgttttgtcatgatataggaaatagactttcatggaattgatttgaaagacatataatcgccctttatttattaaagaatcttactccttttgtgttcttaaactttgaagatcatgtttgggaagtttaaaataagtattgttttttgtgtcatatttacacatttcagtattatacacatctgtacttcattggaaacctattggtgtttatattttgtagatatctcttccaaatgcatgatgaagacattcttctcaacagggcaaggcaatacagaagcgttccacacagggacattgcaaagacaagcaagtcatcacattggagatttttgcttccagaaaattgagaaagacattcatggcttccagtttcagtggaaagaagatgaaacaaatgaccatgcagcacccatgacagaaatcaaagagttgactggtagcacaggccaacatgatcacaggcatgctggaaacaagcctattaaagatcagcttggatcaagctttcattcgcatctgcctgaactg

SEQ ID NO: 8628 - DNA, 2034 bp, Homo sapiens
ggtttcatcacgtttgtcaggctggtctcaaatcctgaccttgtgatccacccgacttggcctcccaatgtgatgagattacaggtgtgagccactgctcccagcctcggttttttttttgtttttctttttgtttttttgggggtttttttttgagatggagttttgctcttgttgcccaggctggactgcaatggtgcgatctggtgtcactacaacgtctgcctcctgggttcaagtgattctcctgcctcagcctaccaagtagttgggattacaggtgccctccaccactcctggctaggtttttgcattgtcagtagagacaggctctcactgtgttggccaggctggtctcaaactactgacttctggtgatctgcccacctcgacctcccaaagtgctgggattacaggcgtgagccaccgtgcctgaccactcatgtattcttgattgaaacaatttgcttatgtcttagttgtacacctgaccttctttccctgtttccaaggtcaatagctatgtgttcacaactctgcattttataaatgttactgtgattttcttgtaaggaagaacaaactgtcaggagtcaatggcctcagaaccttgcaaaagaagtttgtttcttttttttcttttcttttttttttttggagacggagtttcgctcttgtcccccaggcttgagtgcagtggcacgatctcggctcactgcaacctccgtctcccgggttcaagtgattctccttccttagcctcccaagtacctgggattagaggcatgcactaccactcctagctaattttgtatttttatagagacggggtttctccgtgttggtcaggctggcctcaaactcctgacctcaggtgatccacccgcctcagcctcccaaagtgctgggattacaggcttgagccaccgtgcccggcaaaagaaatttctttagcccaggtttgtgaaagagccttctctaattttccaggatgggggtgataagatcaacccttcccattagtccctgcaggcccccatgtaagaattcaggcacacctcactcatctcagaccttctcagggcaacttggtgaaaatgtcttccaatctgagccccagtgagcctccttggaacttggcgatgaggggctacaccagaaaagctcaaccctagtgactttgacccctgaaatgattgacaaaatggagtgcgtgtgtgggtgtggctttttttttaaatttttttgaggagaggagtgcccagttgtgattagaattttcaatgggatgcagtgccctaaaaatgaaaaacaaaagcagaagaatggaagaaacagaggtagactcagacacagagaccatcttcggggcctttctctgtatgaggacatcacaacaaaatctaaagcaggtcatgtcagtccctgacagggaaccctccaccagcttcccgtgttccccaggacaaaagcccaacccctcactgtggctccacagccctgtgtccagggccccttccactgtccagcctcctcctgggagcttgccctcatctcatgactctctccgccccagtcatatttgcttttctcttttcccaaacatcaaaacccttcctgtctcaggtcgttgtccctggttttaccctacgtaccctgtcactttctcctccttcaggtctaggctcagagctgtcgcccatgccctcccacccccggctgtagttcccttgtccatcagtctgtatcacgttactcaggattcattgtctgcatcaatcacatcagaaatgcattttttttttttttttttttttgagacagagtcactctatctttcagcctatgagtgcagcctcttgatcttggctcactgcaacctctgtctgctgggttcaagcaattctggtgcctcagcctcccaagtagctggtgtgtctgccaccacacccggctaatttttgtattttaacttccatttatattatttttgagtctgtctgtcaccaagactggagtgtagtggcgccatct

SEQ ID NO: 8629 - DNA, 364 bp, Homo sapiens; identical to SEQ ID NO: 7112

SEQ ID NO: 8630 - DNA, 247 bp, Homo sapiens; identical to SEQ ID NO: 7113

SEQ ID NO: 8631 - DNA, 686 bp, Homo sapiens; identical to SEQ ID NO: 7114
  misc_feature (95)..(95): n equals a,t,g, or c

SEQ ID NO: 8632 - DNA, 364 bp, Homo sapiens; identical to SEQ ID NO: 7112

SEQ ID NO: 8633 - DNA, 288 bp, Homo sapiens; identical to SEQ ID NO: 7116

SEQ ID NO: 8634 - DNA, 288 bp, Homo sapiens; identical to SEQ ID NO: 7116

SEQ ID NO: 8635 - DNA, 1528 bp, Homo sapiens
tcctcctgcctgcagtaaaccactgcctgaaccgtgttcctaggtggtgctgatgctgggctgtctcaaaagcccttagtctgtttcaaagcttcctgccaatggcaagaatgtggatgatgtgattagaaatcaaatgaatgtaactgttacattgccaaaataccatttagctctcatttggctgctttttcactttgggtgggcattattatcagtttgctcaaaaacagtgcttatgaatctatccaatgtccacaatgctgttataggataaaaggccatttcttattagtccaaataacagagtgggagacttttattcttttaattgattgtgaggttctaaaagagataattgtaaaagcaacaacaacagcaacagcaatcatggctgtatgcttatttgaacaagactagaaatgagagcagaaatttgaaaagttaaagcatttgaatgaccaccagatggcagtgtggggccacctggaagctgaagccaaagtcgtcgttctgtctctctaggcagcctctgaaagtgtcagccccaaagaggcaattgctgtaaatgtataaggctaaagtatcttattaaatgattataaaatatatttaaatgcattttaaaaatgaagttcataagaattattttaggaaactgaaaggtttacatttactctaatacaaaattttagcccacaagtcttcaaaatataattaactcagagaagtctcataaatcaagacagagaattaatgaccacatagagaaaatttaagaaacaataattgatttttttaatagggaagagatcattaagcaaccacagccattacccaaataattatttttctcctaatggctacaaccattgtgcatgaaaatgatatgcataagtttcacttactctagaagaagtcaaactattttcacaaaatttctgcgtgttaaggtgaaaaatctgctgctgctttttaatacatcgtgacacaggtatggcaagcgaattcacaaggtaataccagagtattttggggtgtaaaaagagaaatccattttaaagtttgagaattcttagtttaaaatatactacaagaacgagcctctttatccctgctctgcccctgtcatagtgggagaatgtgccacaaaggccatattaatgagaggactggaaagaacacaaggagatacaaaacctcaagtcagtgaaaaagttacatgttacatgggattttggtaaattcaatgttctttccctttttccctctagaatcacaatttcaaagatgctttaatttcctccctccctccctgcctccctcccttccttccttcttccctcccttactttcttctgctctttcttgttttgatttacctccaagtggcagtaagtgctagctagcatttaaattctctacttgggtgttttatattaagttatttcatttaattatatctattcagtgaattagttatgattactggtaataataatgttaataaaatcaattttatgacaaa

SEQ ID NO: 8636 - DNA, 112 bp, Homo sapiens
ttttttttattattatactttaagttttagggtacatgtgcacaatgtgcaggttagttacgtatgtatacatgtgccatgctggtgcgctgcacccactaactcgtcatct

SEQ ID NO: 8637 - DNA, 1449 bp, Homo sapiens
ccacaacattgtcctcatgtgtgtcacattcttatctgcttgctgcatctatgccttttatttgttgttgttcagtcttttcatacaagtgacaaaaaggatgctggagcaggcttggtgagaacaggaagggaacccatcaaggggcagagacactagaaagggtgtgaaataacatgaataactttctgacttcaccatggaccatggaggggtggccatccaagagggtgctgtacgaagctttcatagggagagccactctcttgtagatctgcataggtaaaccttcccaggtgagggcatcatggccagctttgcagtcttggaaactaagtttttaaagagaggaacacaggatccctggtgtaaccctgtgtgggaatcacagctacttgctgatgtaccctaaagggaaaacctgtgattatggtagaggggagtttttttcctcgcagcgacagttttgccatgaatttccaggcctcacttgatttcaggtcagggtctcttgggcaatccagaagaaattgtacaaggcaggatgactgaacaggtacagcaaatcagctcaaaacatatgtcaaacaaggtggggcctgaataaataaatacagatgagtagttcacttggctggagcatacagtgtgttgaggagagtggctacaagtagagctgactctgtgggctggaaacagattgcaaagagcttggcacattagctcaagagttttgggtttgacttgcctggcaggtggaagcctttgcagggagaatattaaatccaagcagcactatctatatactgaaatcgtaccactttgcatttaggtaatatgtggaaacttgcaaggtactttctcatttgtcatctcatttgagttttataaaaatatccttgaagtaggtaataccgcttctatcttatggattaggacactgagactcagaatggttaagtggcctctacagatctcagctaatgcgtgcagagcagaaggtgaaccaggtcagagtccaagaccatggtcatacccaccacatcatgcttctctgttaacttcacctggcactgggtgcatcacgagtcccacaaatgaagttttctagtttgtcttctgtgatattattttcagagtatcatgtataccatatattatatttgcttgtatgctctagacatttcattgcattttatagggcaatgcttcccaaacttggctactcattagaattactgtgacatttgatgaatacagatttctaggatctttcctttgagattctgatttaataggtgtaggttgggtcccagagatctgtattttttaaacatctgaccattactattaattatgagatttccttcaactttgaaacatgcttatttagtatggtttctaacatatctgacttcttgtggttcctaatggtaaaaaaaaaaaaaa

SEQ ID NO: 8638 - DNA, 970 bp, Homo sapiens
tctcctcccttcagaccctggcaaccactaatctgctttctgtctctctagatttgcctatctggacattttatatcgatggaatgatacaacatgtggtcttttgtgtctggcttctttcatttagcattttcaagcttcatctaagttctagtttatgtaggtattgcattgctggataaaattccattctagagatagctaccacattttatttgtccattaatcagctgatggacatttgagtttctgttttctactttcggctgttatgaataatgtcactatgaaagtttgtgtacaagcttttgtgtgaatttgtgttcagctgtcttgggtacataccttggaattgaattgttaggtaatatggtaactccgtgtttaacatcttgaggaactgccaaaatgttttccaaggtgcctataccattcccaccaggaatttctccacttcctggtcaatacttcttaatgttggtcttttttgtagccatcaggtgggtaggaaatggtatctaatgattttgatttgtatttctctaatgactaataatctgataatctaatgactaataattgagcatcatttcatgtccttatcagacatttgtatgtatcttttttggagaaatattgatttatatccttttgaaaaattggggccgtgcatggtggctcacgcctgtaatcccagcactgtgggaagctgaggcgggcggatcacgagttcaggagtttgagaccagcctggccagcgtcgtgaaaccccgtctctactaaaaatacaaaagattaactgggcatggtggcgcacacctgtagtcccagctatttgggaggctgaggcaggagaattgcttgagcctggcaggcagaggttgcagtgagctgagatcacgccactgcactccagcctgggcaacagagagagactgcgtctcagaaaaagaaaaaaagaaaagaaaaa

SEQ ID NO: 8639 - DNA, 970 bp, Homo sapiens; identical to SEQ ID NO: 8638

SEQ ID NO: 8640 - DNA, 139 bp, Homo sapiens
aacgatttggcaacagtcaccatataagtattagctattattataccctttaagtcacagtaatgtcatttctagagacctaatctaagaacattatcagagatgttacataaagatgtgtgtataacagtttcatcac

SEQ ID NO: 8641 - DNA, 384 bp, Homo sapiens
gttttaacagttaggttttatattttctctttagatctcctcagtattggttttgtctattctgtttcacttaaattatatcttcatctataggggattttatattctatattgtgtgttcctttaaattgaccatgatgaattctgagtgtgtaggtatttgtaccatttaagtcgttaactctttagaaatgtatggacttatttatattttttataatattgacagtaaaaaatatgggaaatgtattaatatgttaaacatttgacaacacaagcaagttatgtgggctttttaattttttttaaagaaatgtaaaaagtctgggctacattatgtttcccaggctgaactcaaactcctggatttgaccgggtgcggtg

SEQ ID NO: 8642 - DNA, 139 bp, Homo sapiens; identical to SEQ ID NO: 8640

SEQ ID NO: 8643 - DNA, 384 bp, Homo sapiens; identical to SEQ ID NO: 8641

SEQ ID NO: 8644 - DNA, 5205 bp, Homo sapiens
gtggctgccacactcaacaatttggctgtgctctatggcaaaaggggcaagtacaaggaggcagagcctctgtgccagcgggcactggagattcgagaaaaggtacccatgccctctctcccttcttctcttgtcgctgtgacccttctctacatggctcctctggtctaaccctcctccttcactttttttttctcacccccatctctgctttgttctctcttccttcattccctttcctctgctttccacatgtgtgtgcctacatgcaaacacacgtgtgcttgtgcacacacatgttatcatagccatttatccactcctttgttccctttcaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggtatgggaggagggacaaagtaggtggaagaaacggagaggggggcacagaggtggggggagggggggcaggcggagaggccacttgggtcctagagtcaggaagcatcacagtctggcacactgctctcatcaactttgtgctcatgtctggggctgcctttgcggatgaaggatctgcttcattccagttatagaagttccacagcttcttgggagtgggctgggaatacccttgaccctacacctggagaaggaggtgtgagaaagatctctggggaaagtgagagagacactgagaagtggaactccctgagcctggtgaagaccttgtctaaaaaaaaaaaaaaaaaaaagaccttgcctccctccatgttttgttcctgtatttttgcctttctgtcctccaggcttcctgttacctgaaacagggcaaatatgctgaggctgagacactatacaaagagatcctgacccgtgcccatgtacaggagtttgggtctgtggatggtgagtggtgagggcctggggaaggggctgtggggaagaaaagaaattcagaccaaaggtcgggggttaggccacagcggttcccagggggagccagaccccttcagtccagcctgtcagcctctgggtcctggctctccgacactgtctagctcccatctctaacctccccaccccatgtatcacccctagatgaccacaagcccatctggatgcatgcagaggagcgggaggaaatgagcaaagtgagtggggggaaggggggccagcctggggagctcaaggctaccggggtctctgtcttactccttgcattagcccaactctcacttcccatcccagcaccagccccagatgcatggtgtcctccccagcccagcctgcaccctagccccatgccaccttgcatctcagcatctctgtattcttatatttggctctccctgcccttctttctggcctctctctgtcctgcagagccggcaccatgagggtgggacaccctatgctgagtatggaggctggtacaaggcctgcaaagtgagcaggtgagctgacagtgaaaagccagcttggcctccgatgccctccatccagtccctgctcccagcctcccagaccttttcccttcctcccgtagactttccctcagctttagctctgttccctctcctattttcttattttttttcctcttgtcttgcttggaagacaaatgttttgttttctgaactcattctctcttccttctctggtctctttctcaccacagccccacagtgaacactactctgagaaacctgggagctctgtataggcgccagggaaagctggaggctgctgagaccctggaggaatgtgccctgcggtcccggagacaggtcagaagcccagaggggaaggaggtcctagagggaagggccctggggatgagagagtgccgaggtttcttgggagtctcctaagaataagcggaaaggctgatgaagccaggagggagaggaaagtgaggcagtgttgtgattgtggttgtttttaagcatgttcttaccccccacctgcattttgtggtcaggactctagtttcaagattcactaaatggggatatgaaggagaaaccctgccctttcataaggaggggacctgggtggtatgggtgagaggagtgaggttggggagagcctaaatcaagaatttcttagattgtgggtctcaatagtaggttgtgaaatcaattcagtatgggccatggggataaaaatatatacagatctatatatagcaatgcattgcaaatagaaaaggtaagtattattccagtaggtataaactgagacatcacaaggaaaaatgttttccttccagtggctgatggtgaaaaaaatttgaaagccccatcctgaggagttaaggagtaggaagtcccaggtccttccttttccttccagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggtaagtctgatcattgccttttcatctctcctgcccactcctgctggtggtggtgagaggctcttggccatgctgtcccagtctaggtagtgtattccttcaggggtatctctgggagccagtttttgacaggacttttatttccagtcactgggccttgggggtgggggatgtgtgcagaataaatgctaggagtagactcagaaacccatctgtgtgggatccttgtagctttcattgctcactcctttctgccaggatggcagtgggaccctgcagaggagtggctctcttggcaagatccgggatgtgctccgcagaagcagtgaactcttggtgaggaagctccaggggactgagcctcggccctccaggtatacatggaagtcaagatacagtaaagtggccgggtgcagtggctcacgcctgtaatcccagcactttgggaggccgaggcgggtggatcacctgaggtcaggagtttgagaccagcctggccaacaaggtgaaactctctcctaaaaatacaaaaattagtcgggtgtggtggcaggtgcctgtaatctcagctacttgggaggctgaggcaggagaattgctggaacccaggaggcagaggttgcagggagccaagatcatgccattgcactccagcccaggcgacaacagcgagactccgtctcaaaaaaaaaaagaaaaaaaaaaaagatatggtaaagcaggcaagtaaagtaagcccttgcctccaactcctcttggctcctgatctctggagaagtatctcggagagaaacagggaggaagtcaacgggccagccatggagagagagtttgggtagaatgggtgccccagtgtggcagtgctcaagaggcccacagccttaaggccactcaggaggaagagaggaggcctcaattcttccgttttccattgtagcagcaacatgaagcgagcagcctccttgaactatctgaaccaacctagtgcagcacccctccaggtgagagcagtgcttgtgagcatattggtgggtgaggaaaaaaggacagccagtgagcaagcccagtggagtaagggaagagggaagggagaggagtcatctgggatgaagatgagccaggggattgcagtcattaaggaatcaggcagatagcttgtggtgagtgctgaccaccaagggacagtttcaggccagacatagtagcaaataagttaataaggagggaaataggaatattctgtaaactggtactttggaattatgaataatttaagaattatttggagatacgaattattttttcatcctgcagccgccttagtagtagatgagaatggaaaaagaaaagtattaaataatccccatctgagaaaacactagtgatattttaatggcaaatgacttcttgtatcaacacacaagtatatgccagtattcatgtggttcttccaggtagcttctccaccagattgtggccttctggaaaaccctagcagaggctaaacaaagtcccaggtccagagatagactggtccagagacagatgtgatcctaggtccagagatacactgtgaccatgggatggatggactctaggagccagtctttgggaggccgaggtccctgagctgatggggtagtgttgtctgtttcaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttctgtgacttgagtcctgattgaagagggtatgaagcagggcttgtgttggggcccttcacagaaggtgaggggcagtgatggatggagcagcaggaggagtgttgattcttggatctctcctctcttcctcccgttgtttgtatcatctccagcagggcctgtaggaaggcatctgggggatggggaagaaggaggctcacaacccaaggagaaggtgctgtggactgggttgtcagggacatgtggtggccatgtggcaggaccctggagtcctggcgccacttctcctggctgtgaggccctctgtggctgccattcctcctcccagctgcttgggggaagggaggtctaaacaggcctggggggccctccggaaccagaggggagacaaggcactatccatcccctctcagcatatcttggaggcctgagcagcagctggggcccatcttctaaagcttga

SEQ ID NO: 8645 - DNA, 974 bp, Homo sapiens
gagaaacaaccttaagtagagatattatcgccaaggcaaatgatagagttgtggatgtacagaaaatgaaaaatgaaaagtttgtttgttttgttttgttttgttttgttttttgagatggagtttcgcagtgtcacccagcctatagtgcagtggtacaatctgggttcactgtaatctctgcctcccaggctcaagtgatcctcctgcctcagcctcccaagtagctgggattacaggtacgtgctaccacgccaggctaatttttgtatttttagtagagatgggttttcaccatgttggtcaggctggtcttgaactcctgacctcaagtgatccacctacctcagccttccaaactgctgggattacaggtgtgagccaccacacccagctgaaaagttatttattttttgttgagatagagtttcactcttgttgccaggctagagtgcaacatggcacgatcttggctcactacaacctccacctcccgggttcaagcaattctcctgcctcagcctcccgagtagctgggattacagacatgccactacgcctggctaattttgtacttttagtagagacggggtttctccatgttggtcaggctggtctcgaactcctgacctcaggtgatccgcccacctcggcctcccaaagtgctgggattacaggcgtgagccactgcgtccagccaaaaagctatttttgaatgtgatctgtgtgaaaataattccctatggtatgacatatgataggcagggatgatgtatctcagaaatcatactcctgtcttgatatcccatcaaatatcaatgtttacatttagcgtttggatgtctggcaggacattaaaaaattggcagagctgtcccacacatgcagaacatctatagcgttcttgcctcctcaaaggtaatcttcatggtgacaacaccaacaacaaaaaaaaaaaaaaaagaaagaaaaaa

SEQ ID NO: 8646 - DNA, 2401 bp, Homo sapiens
gttgggcagagagggggcttaaggcccctgggcacaggctgggatcagggcagtgagcgaagggcagctgtgtcctgccctcccttctggaggctggaggggagaggccaagcccttggaaaatgtagcaaatgtctggatgtcgcataagtgcgtgtatgtgcgggacaggccccgagaagctagtgactcctgcacacccccattgcacaaatgaaatcacagcccaggagggagggtagcttggcactggctgagaaatagagctctctccccgcccctccccctaaccacaagggattgtcctgacaacttgtggggatagaagggctcacagggcaggggtctcagctgcccccatccttagggcaggggagttagtgtggagccgagagcaggtcccagctccccctgccagccgcactgtcccaggcccagggacctctgccgggtcctcccagcccttgccacacagcctagacgtagtagcctgggcttccagcaggtggcgagctggttcgtgctggaaatttctcctgggtttcttggggtcaaacatgccaacctccaagaccccatcctcacgtctcccacttttctggcgctggagtgtgcagggcgtaggacctgcatgtgtgggtgtgagaatgggggcggtggacaccagggggcgagtgtgtgactaggtgtgtgtgcacatgtgtagggtgcagacgcatgggtgccatcctttgcgttcagtgactgtgcgtccagacccctcaccagcggcccccccaccacaccctggtcctcccaggcagctgtcccagggcgcccaggcctgccttgcaccacagccctcaggaaatccggcaaggaggcccctgcaggttggttcaggcccccaggtagcaaaacagagacaacagcagccccgcctgaccccctgcccctctctgtggaggcccgggacccccgcaataagcaccacatgggtgaggctgtccctgtcagggtcccctgccagggtccctcctggggttctgggccatttgaggggctctttgatgggccaggccggccagagtgaactccgagcactttctggctggtgccccaacctctccactccccactcattcccaccttgaaaaagggctataggtcccctgccctgcccgggtccagtttacaaacagtgtggggtggccccagggcctggccccactctccctgctgtgcccactcctctccagactccacctccccagtgggtatgggccctccacatgccaggtaagtagcaaacccccactccctccaaggaccaggtctcagagaaggccctggtcactgcccccggcccacctggagcccatcggggctgcctctcccagccgcgacttctccttttgccttaggcctcgcgacatcctgatctctcctgcaataactaggaatcgagattccacagtagacgtcccttgccgtgctcgctctctctctcgcgcgctctctctctctctctctctctctctctctctctctcctctctttctctctctccctctctctgttaagatcctgttcgggagtttccccagccgttgtagtgtatagtatgttagagttgggaggggaccaatagttatgtagcccagccccctcattcccagaggcacccagagggccagcctccagcctgaccccagagcagaaccggaacaccaggttggggccctggtgctgccacctcctctgctggtcgggctgggaccctttgccccttaggagaggtgttggtcacagatgtttacctcagtttatgtcactgtcgaagaaacaaaaaataatagcaaaaaataacactgtagacatgaagacttagaagacaaaaaaaaaaaaatcacacaaaaaatctcccttgttgcgattcttctgtgaaggtacagtgtgtatgtgtgtatgtgtgtatgtgtgtgcgtgtctctgtcccagaccctgtgtcccccacactgccccctgtccttcggtgcttcccagagacccctctgagctggcctgtggggcacgggaagccccctggatgggaggcggggccacaggtcggctagagggtctccaccaggcccactgaacagaaccccacggctgccagaatgttccctgagcccacactgtggccagtgggacagtcctggtggctgacatcagcgtccatgcttggctcagggcctggggcggggtcctgggtagagtcctagccccagagccccagcccctcatgtcttgccgcccttcctccatgtgtttgtaaatactctggcatcctttggccctgagaaggtttttaaatgtgttatttacttctctaaacatgacgattgctataaaaataaacaaaagtttagaaaaatga

SEQ ID NO: 8647 - DNA, 4692 bp, Homo sapiens
attttggtttccaatgcctctttgaccacatcagtgcccacccctgttataaatagtacttttacccctacaaccctgcagactatcttttcagtaagcacttctgaaaacagcacttcagctttagctgatgtatcatggacccaatttaacatcatcattttgacagtcatcatcattgttgtggtgctgctaatgggatttgtgggggctgtatatatgtaccgcgagtaccaaaaccggaaactcaatgcccccttttggaccatcgagctgaaagaagacaatatcagtttcagcagctaccatgacagcattcccaatgcagatgtttcgggattgttggaagatgatggcaatgaagtggctcccaatgggcagctgaccctgacgacgcccatacataactacaaagcctaaggagctagaactgttctgaattgttaaaccacagtgcttgctaagacagagtcagcccctgggccagacaaagcctggctagagtttgctgagaaagcaaaggcaaatagtgcatctgaaattttcaggtacaaatttgtaatgcgcttagcctatctattgctcttagttttcccatgaagatctgaagcgttcactgtcattaggacttgaagtaaagtatatttttgtaccaaaccacatgggagtatggaaaggctgaaccccatagtgcagcccaaaaccactttgacctccagatagactcctggggaagcattcaccaagccagtggtaacaagatgatgaatgtggagggggaaaagactgctggaagacttcatctccattcctgaaacattttttttaaaacagtgtcagggattatattcgttttactatacaaaaggacatcattgaggaaaagcttgtttctaggctgtatcacagtaaataatcttgattgtttctagaacaggggtagaaaagtcccaagatcttcagaagggcttggttttttcctcccaggattcttgctcagtgatgagttgaaagcacaggataagcttctaagggaggaaggcagcattggggagcaggaggctgatggtcctcctcagggtctcagtgtaaatgataaattgtctaaaaataaggaatattcctgcctctagagaaataaggtgtacatagttaatgtagcatatctggtcgacgttgtatttgtatctatttgtaaaaaaaaaatcatgtcatattttatcatctggaatttatttgtacagcagttaatggtgttgtaaaaagaaaaatatggggattgcttaaaatactgtaaaatagatggcaatattgctagagctgggactctggtgagcatccgtcatttttagtccttcttgaggacattgctgaaatttataagaggtcgaatgtttctttctttcctttctcagtctaaaagtagagttatatgctctttgacttactatgattcaagcaatagattttgaagtcagtaatcgttaagctgggacataggatgcattctccaaaaacattaatctaattagacattagccaccctatatattttacatagattaatataaaacatatcctcattaaaaaatgtttttcttgaatgtaaaagatagtcttccaaaggatagaaatattttagttccaagagaaaagccatcatattacttgggatctgtagttttcatgcctatgaaatatttataatcctccctcaccccaaataaaaaatctcctacatgtgaacatagcctgtcactcatttgccatgaggtatgtgccatctccctgcagtgctatagttctcccattgtcttcctgtctggttaatgagcagctttgtagatgggtgtgtctagttagttcttgctttttgatggagttttttcctagaggccaactactgttgctctcgtttattatgatattgacattttgggttaagcaaggtgggtgggaaaggtggtcagatgttaaatataacttattaggaggaacagtgaactgtgaagtggttagaaaaaaaataaaaacttcttattagattagacctaggaaattcaagctgacccctttgcctaacttccctagagaaaaacctagaacttggtcatccctttataggagacccctaagttgttctcagggtttggagatgatgttctggagggagtacaagcaaataatctacttctggtaatctgagggtgctttgcgtatttggccattgctcagaagaatagaggttacattatattacattatatgaaaattatttagtttttctatagccctttgtagtttgcaaagcacttttccatatgtgtgtcctctcttccacaccatagccccctgaggaagtaattgttgtccccattttatagatgaaaaggctgaggcacagaggagctaaatatcttgttcaaggctatacaatgtgtgtgattattaggcttggaatcagggcctctaactctaaagcacatgttttttcaactatatgcagaaattgcctagccatggacacaagaaagctgggaggaagagttctacttgtggatgtttttaattttttttaaatatcaggagcaatccagggccatacagctatgaagcacttagtgaaaagaacacaagaagatttactaactgaagttagtattagtgattagaaaacaaaactgccagtttgtgcttcattaaggtgaactcatctctccaagcaggaagggaaaatttgctttccctagcagttgctgcatatgtgtgtacagactgcacaattctaagaaattgtgcaaaatggcatacctgtctttctcccagatacaccgccccctgccccccccaaaaaaggtcaggattaaaggtggtgagaagtgaacatttattaaacagaagttaaaccaatagagagaaaggaggtttgttggagtctaagaggattttgaccatgtagaaattccttgaaacagaccttaaaaggtattgaaaaattgaatcacaaagaaagtttacctttaaatacttgttaatggctcctagatcatggttataatttttctcaatgggaaaaaaagtcttaaaatttgttttaaataagatcctctaatgtctcgagctttttgattctggaaataatttgctttaaaatataaatcaatcagaaagtgatctaccactgaaatcattctaggaaactagcatgggatgcactgcacaatgttctttcctctaaaggcatgggccccataaactgtggcatctggcagcaggatgccatcagtcctttagaaagcctaattttgggccgggtgcggtggctcacgcctgtaatcccagcactttgggaggccgaggcgggtggatcacaaggtcaggagttcgagaccagcctggtcaacatggcgaaatcccgtctctactaaaaacacaaaaattagccgggtgtacgtgcctgtagtctcagctacttgggaggctgaggcaggagaatcacttgaacctgggaggcagaggttacagtgagccgagatggcgccatttcactccagcctgggcgacagagcaagactctgtctcaaaaaaaaggaagaaaaagaaagcctaatattgggagaatgtttgtgtaaggattggaaatctgtttatttttaaataagatagcactgatgtgaatcttatttggaaattacagatactgccattaagcgatgcttttatcttcattaattcattttggtaagcgcctatgcatttctgatggttaggtgccctaggtagtgttaagtatgtccgtgtcctcccttactcccctctcgctccctctaccctctatcccctagggttcttttattaatggaatttctccagttatagagaaaaaaatgacatttgaaaactaaagctcatttatattaatactaaggtcctgtgggcctagtgcgttactcttcccagtgatacctagattttaagagtagagaacagaggaaacatgggatgagaggagagaggttttttagacaacatttgtagacacctcaaattatatcactgttctctagcgccaatattcccaggtaaattgaccattaaagcaatactcactgacctactagtttattttggtcagctgagtaccatcaggatatttaaccctttaagtgctgttttgggagtagaaaactaaagcaacaatacttcctcttgacagctttgattggaatggggttattagatcattcaccttggtcctacactttttaggatgcttggtgaacataacaccacttataatgaacatccctggttcctatattttgggctatgtgggtaggaattgttacttgttactgcagcagcagccctagaaagtaagcccagggcttcagatctaagttagtccaaaagctaaatgatttaaagtcaagttgtaatgctaggcataagcactctataatacattaaattataggccgagcaattagggaatgtttctgaaacattaaacttgtatttatgtcactaaaattctaacacaaacttaaaaaatgtgtctcatacatatgctgtactaggcttcatcatgcatttctaaatttgtgtatgatttgaatatatgaaagaatttatacaagagtgttatttaaaattattaaaaataaatgtatataatttgtacctattgta

SEQ ID NO: 8648 - DNA, 4692 bp, Homo sapiens; identical to SEQ ID NO: 8647

SEQ ID NO: 8649 - DNA, 4692 bp, Homo sapiens; identical to SEQ ID NO: 8647

SEQ ID NO: 8650 - DNA, 1682 bp, Homo sapiens
aagctgaattggccgggcgcggtggctcacgcttgtaatcccagcactttgggaggccgatgcgggtggatcacgaggtcaggagatcgagaccatcctggctaacacggtgaaaccccgtctctactaaaaatacaaaaaaattagccgggcgtggtggtgggcgcctgtagtcccagctactcgggaggctgaggcaggagaatggcgtgaacccgggaggcagagcttgcagtgagccgagattgcgccactgcactcccgcctcggccacagagcgagacttcgtctcaaaaaaaaaaaaaaaagttaagctgaattaaaaacgtttttcatgagatgatagcattaggagtgttgacaggctgaaaatcaacattctatctaaatcaatgttaaaattgcagttttacctataagttagtctttcaaggcaattttatgaggaattattgtagtaattgtacaggctttctagtacttccgtgtacaaaatgaaagccatcagacaatgttaaatttacaatgtgctgcttgtttgtattaataataagtagattttaaaccttgtctgttgaatggaacactgcacttcaaacagttgcaaaagaaaacaggcaaaatgttttctttgtatgtaataagagtaggtttgggtaataaaagaagtatttgggaggaaatcttcttttgtggtttcctttgtgttgttagacaaactgctgaaattgtatatgtcagtattggttctttcaatctttgacccaaagaaggaaaagtctcagctcttgccacgttaattactattccaattcaaccatgttaaactcatacaatttcctacatatgccaggttatatgatgtcttcctcctttgctggtactgtttcccctacctataatatccttgagaatgctcattcattctttgcaaacctttgataaaggaaagttgatcaattcttaaatttgtacctccattttgcctaatgaatacttctactactgcatatattttattataaatacttgttagtttgtgccttccccagtgaactctgtattccttgaaattaggagcgtttattcttctgcctctggcatctggcatgttgctggtacattgtgggtgctcagtaagtgatggtttatgtacaaaaggtagttgacaatacaagagttggtatgtgaacttatttgttgaagtatggcaacaaaacttctattcagtggatacgataatatttcttattcaagagaggtgtcaattttacataggcttcagaggttctgagaaacccttgaaatttcatgccgttttgtttattgatgcaattgtgtttctttttttctggagagaagacccatactttaatcattgtctcaaaaggatccatgatcggcccggcacagtggctcatgcctgtaatcccagcattttgggagaccgagatgggtggatcacctgaggtcaggagttcgagaccagcctggccaacatggtgaaaccccatctctactaaaatacaaaattaagccaggcatggtggcgggtgcctgtgatctcacttactcagggggctgaggcaggaaaattgcttgaacctgggaggcggagtttgcagtgagccgagtttgtgccagtgcactccagcctgggtgacagagcaagactctgtctc

SEQ ID NO: 8651 - DNA, 2931 bp, Homo sapiens
aagctgaattggccgggcgcggtggctcacgcttgtaatcccagcactttgggaggccgatgcgggtggatcacgaggtcaggagatcgagaccatcctggctaacacggtgaaaccccgtctctactaaaaatacaaaaaaattagccgggcgtggtggtgggcgcctgtagtcccagctactcgggaggctgaggcaggagaatggcgtgaacccgggaggcagagcttgcagtgagccgagattgcgccactgcactcccgcctcggccacagagcgagacttcgtctcaaaaaaaaaaaaaaaagttaagctgaattaaaaacgtttttcatgagatgatagcattaggagtgttgacaggctgaaaatcaacattctatctaaatcaatgttaaaattgcagttttacctataagttagtctttcaaggcaattttatgaggaattattgtagtaattgtacaggctttctagtacttccgtgtacaaaatgaaagccatcagacaatgttaaatttacaatgtgctgcttgtttgtattaataataagtagattttaaaccttgtctgttgaatggaacactgcacttcaaacagttgcaaaagaaaacaggcaaaatgttttctttgtatgtaataagagtaggtttgggtaataaaagaagtatttgggaggaaatcttcttttgtggtttcctttgtgttgttagacaaactgctgaaattgtatatgtcagtattggttctttcaatctttgacccaaagaaggaaaagtctcagctcttgccacgttaattactattccaattcaaccatgttaaactcatacaatttcctacatatgccaggttatatgatgtcttcctcctttgctggtactgtttcccctacctataatatccttgagaatgctcattcattctttgcaaacctttgataaaggaaagttgatcaattcttaaatttgtacctccattttgcctaatgaatacttctactactgcatatattttattataaatacttgttagtttgtgccttccccagtgaactctgtattccttgaaattaggagcgtttattcttctgcctctggcatctggcatgttgctggtacattgtgggtgctcagtaagtgatggtttatgtacaaaaggtagttgacaatacaagagttggtatgtgaacttatttgttgaagtatggcaacaaaacttctattcagtggatacgataatatttcttattcaagagaggtgtcaattttacataggcttcagaggttctgagaaacccttgaaatttcatgccgttttgtttattgatgcaattgtgtttctttttttctggagagaagacccatactttaatcattgtctcaaaaggatccatgatcggcccggcacagtggctcatgcctgtaatcccagcattttgggagaccgagatgggtggatcacctgaggtcaggagttcgagaccagcctggccaacatggtgaaaccccatctctactaaaatacaaaattaagccaggcatggtggcgggtgcctgtgatctcacttactcagggggctgaggcaggaaaattgcttgaacctgggaggcggagtttgcagtgagccgagtttgtgccagtgcactccagcctgggtgacagagcaagactctgtctccaaaaaaaaaaaaaaaaaaaaaaaaaagatacatgatccccaaaggataaacaactaattgaaggattattacttcatttttcagcaatcaaaatcctcccactgaatgcaaattggcacaattggtaaattggtctttatttcaggaagtccacttctaggaaatcttcataaggaaatgacctaaaaagcagaggctccacaaaattttttttcagactggtgtataaagtttcaaaacttgggaataaattctagatgttcaagaacagagatgtagcctggcacggtggctcacacctgtaatcccagtactttgggaggctgaggcaggtggatcacttgaggtcaggagttcgagactagcctgaccaacatggcgaaaccccgtctctactaaaaatacaaaaattagccaggtctggtggcgcatgcttgtaatcccagctacttgggaggctgaggcagaatggcttgaacctgggaggtggaggttgcagtgagccgagatcatgccattgcactccagcctgggagacagagtgagacgccttctcaaaaaaaaaaaaaaaaaagaatagagatgtagtttagtgcatatacttcatgagataacatacagtcactaagagggattagggagaattattaaaaactgaatcaaagttaaatgaagaaaaatggtttgttttgaagatgtgcatgtaatttcactcctggtatatagtttagagaaactcatatatgtgcaccagaagctgcatttcaaattcttcactgcagcattatttattatagcaaaataattggaaacagtccaaatgtctgtcagtagaagaactgtggtctatccatatactttgaacagaattttatgcagccgtggaaaatgaatgaattacagctatatacatcaatgtggatgaatcacaaaaacaatgttgagcaaaaaaaagtaagtcatagaggccaagtatgtaatcccagcactttgggaggccgaggtgggcagatcacttgaggtaaggagttcgagaccagcctggccaacatggtgaaaccccatctctactaaaaataccaaaattagccaggcgtggtggcaggcacctgcaatcccggctactcgggaggctgaggcaggagaatcgcttgaacctggaaggcagaggttgcagtgagccgagatcatgccactgcactccagcctgggtgacagagtgagactctgtctcaaaaaaaaaagaaa

SEQ ID NO: 8652 - DNA, 161 bp, Homo sapiens
attggccgggcgcggtggctcacgcttgtaatcccagcactttgggaggccgatgcgggtggatcacgaggtcaggagatcgaggccatcctggctaacatgcagaaaccccgtctctactaaaaatacaaaaaaaaaaaaaaattagccaggtgtggtgg

SEQ ID NO: 8653 - DNA, 9139 bp, Homo sapiens
agaagaacggaaggaacagagggggcaaagccaacaaccccccgtatttgccccccgaggtgagcacctgagaagtggtagggcgggaagaagccactctttccggcccaggactctagggaggcgggacccagataattaatctccccttccggtgtcgagaccccagggaggaggggcacgggaggagaacacctctttcaggtcccgggaccccagggaggaagggcagagactggactctcaggtgacaggacctcagggaggaagagtggagagggaggactcccccttctgatctagattaccccaggagagaagtagagaaaggggatcccaggaagagcaccccgaccaactgcgtgtgccgccatagggcaagagagactgcatcctgggacgagaggcagacagtaaccaccacttcttctaaacttgttccacagggagaaggggagtacccgggaaaagagcaatatgttccacacggacacacacacagtactcgggaaaagagcagtatgttcactacacacacacacacacacacacacacacacacacagcctaagccagtggttatcaaactttggcatgtatcgaatcacccggattgctggcccccaacgcctggccaattttatttttttattatttatttatttattttttttgagacggagtctctgttacccaggctggagtgctgtagggctatctcagctcactgcaacctcggcctcccgggttctcaagcgattcttctgctgcagcctcccgagtagctggcattacaggtgcccgccaccacgcccagataatttttgtatttttagtagagatggggtttcaccatgttggccaggctggtctcaaactcctgacctcaggtgatccacccgcctcggcctcccaaagtgctgggattgcaggcgtgagcctccgtgcccagcctagaatttctgattctttcttactagtgaggatgggcctgagaatttgcatttcttataagttcccgtgtgatactaatgctgctggtcccaggacctcactttgggaaccattggtctgggccctagactgtcattcttgtaccacattttttgaagccacccatccccagaaaaatgattaaaaggtttttattgatggggaaaaaaaataatctccttaacacaccatgaagtggagattatgagtgaagacctgttagggcctgggagccagacagccttgaagggatggaatgataggaagggaagaggaaaactaaaatatccagagaggcgggtagaaaaatgcagactggccaaacaggcaaatcccatatccctttgtacctgggaggggaagcctcaggtaacagggtgcttctgtgctgtgctacccactggagctagaagagactgtggggtggattcaggatttcacctccactgaggttagggggcaagaggtaaaggccatagcgagtctgtccgcttcattacattttctgagtttttctgttcctctcagccccagctttggagctcttctcctctctcacctagatcttctcggtcatcaggcttgtagtgaccattgctgagctcaccctttggctctgatccagaacctcttgcagcctcttactctagatgacatcagctgaaaggggcaggcagggaggaaatggtgtttcctagaccagtgacaaagaaaggttttaacagcctgggcacagaggagacatagacttctgggaaaagcaggtttgaggccctggaggtggggaggaagggatgatcttgcatctaggaagaacgtgctgccagtgatcaaagaatggattgattcagtgttctgttcctggcttaaatgggtgactccttgtgtccttataggccttcccttcatagaggctatgctgggggtgaatagaggatcttgtctgccactgacctttgacaggcacttgcctaaccaagtgccagtggggcttcctgctttctcaagttagctacctggacccagtgggaattgaggggaagtagggattgggtctgtacagtgtatggtaactgctcactgtttcttttcaggctgaagatggaaacattgaatataaagtgagtcctaggctggggaaaagcaggggctggggtaggttgtccttgccagtgtgggataatttcttttttctttctttcttttttttttttgagatgaagttttgctcttgttgcctaggctggagtgcagtggcgcaatctcagattctcctgcctcagcctcccaagtagctgggattacaggcatgcgccaccatgcctggctaattttgtatttttagtagagatgaggtttctccatgttggtcaggctggtctcgaactgctgacctctggtgatccaccagcatgggataagttctctgagagccttccaacttcataattatagcagtttaaggatatggttcaggttaagggctctgtacctcgttctgttggagggggatcaggtatgagtttaagtggaaagagaaagtcctggtccttgcagcagaacaggtggggaccatgtaggtttgggaggaacacctctgatttcaccttatgataccccacttgccctaagttgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaagtatgcttccccttccccaccagttctcctttacctgacttggggggacccatgcatacccagttacctagggcctgaggggccaaggtgggactttccttctcttgacaaagggctgaagtggggagggttagtgttttggtcccctcctcactggacctaggctgttttgctccttgaattaagatatgtatatttgttttaaagggaactgtgaatgaggaatagattggagggtggtaggaagtgcactaaggtattgggagctctgtgggaggtgcaggaagtctgtaggtccagagcgagcctggaataggagaaggacaggtgagatatggcagctgtggccttgctgtgacagggttggggcagacataaccgttcttcgagagcgagaagtggattatgatagcgacatgccccggaagatcaccgaggtgctagtacgaaaggtccctgacaaccaacaggtgagcacacacccatccctgtctctcatgtccacactgtggaagggccctgtggtggcaggctgtctcctggcctgggatcctgggggcttccagttcatcacttgctccctagggagcgtcactgcccttgacccagtcttcagttagaggggtgagagattggagttcttatctctggcaattcatccacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtgcatgggatcaatgggacccaatggggccagactctgaggatgggatggtagtagtgaaggacataggatgggggtagagtgtggagactttttgaaatagtatagatgaatgccctgaggggactgtgaacaagctctgcccctcttaggaaatcaatggggaatcaactaaattaaataaaaaatggggtcaagattaagaggcagggtcacccagggaatggtttaggtcctggcaactctgaaggggttggaagggctggcaggaggcactgagggccctgggccctgggccaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattggtacgaggcattagggcagggacagggctgaaggggggtgctgactctcctaccctgggcctcaaatcttggagacagaccaatgctcctcttcttccctctcctccctcctgcattctcactcttctctcctgctgcttgctgtccttatgaggcagctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaagtaagcccaccttactctaaagccctgatccactaggaaggctgccacagagcccagggcccagaagcatgatatcctacttctccagggccagaccagttctggcttagttctgcgggtgtttcagcttgggattgtggaggggcatcttgctaaagggcttgaccctcctcccgagccaacctggagcactgctgatgcctgggaccatggcgatgaagtgctataccaggcatttgctgtttcccttgggctcggatgggctttttgtgtgacattgctcgactggctcacaagaaggcccagagttcctgagccatttgcagacaggagagaggggcccccagccagaacaaagctcacctttccatgtatggggctctggcctctgcctcctgtttggactgtcttcatctgtccattccatgcctccctctacagtgtcacccccatcttcacattgtccagtgtgtctggagagagtctggacctcctcaaagtctttctgaatattctgccgccactcaccaacagcaaagagcaggaggaactcatgcagcagctgacggagttccaggtagttgactgcccaaacatctaataggctgggaaacagggaggggctgcttcagaccaaacccagagtctgtttagagattttggacccaccagccctacttggcaggccattgatagcgttttctttggcttcaggtggatgaaatctacacagtaccagaggtggggactgttgttggaggaacactttccaggtaaattgtcttgcttgctaccctccccactcagccctcacctatatactcaaagacatcctggcccaaaggaggagaccctggaattgaacggaacccatttaaaggacatgcttatttgcagattaggctttcactatcagaagagctggagaacggtagtctgttggctttggagggaagaaacagtattgctgcctattggggaatctccaggcccctgagagagaagtgtgggtcttgagctccaggaagaaaactagagtgtattcaactgacttcatctcacacagggaaatgagagacgtcacttaagactcttctttctttctttctttcttttttttgagacagagtctcgctctgttgcccaggctggattgcagtggagcgatcttggctcactgcaacctctgcctcctgggttccagcaattctcctgcctcagccttgagtagctggaattacaggcgcctaccaccatgcccggctaatttttgtatttttagtagagatggggtcgtcaccatattggccaggctggtcttgaattcctgacctcaagtgatccacctgcctcagcctccccaagtgctaggattacaggtgtgagccaacgcggctggcctaagactctgcaaagcagagaatgaaacccaaggggataacttgctccttcagtgattaggtgttcggtgttgttaaaccagcaagtgtctctctgtccaccatcactgctggccttttatgaaattagtcttctgattctgaactctggcagtgagccctgttacatccaagtcagaatttagggttcttccccacttgagggactcaaccctagaagggaaggaatgctctgggtgatcctaatagagaagtaggtatggggaccttggctgacactgtgccacctgccctctgggctgcagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaaggtgaggtgggtgcatgggttggggagggaacgctaagagaagtgcctaggagactggctactgaatgagcacctatctaaggtgcttcagagaaactcagaggaaacacactctctgacccaagaagcttctggtctagctacgtagactataaaaacagcttaacgtactcatgaggtacagataactaaatatgaatcactatgttacactgtttttaatgaacactatttttagtgttcaggaccctaaaaatgtgaagcgttagatgggctagaggacgtaggaggtgggtaaagactcattccctctgagagttttgattattgtcttttgaggtctttgtgtttagagttgtgtagaggaagaggaaattcaggagctataaagggtgtggggtggctggggagggagagtctgatgttagagctgcccttcctgggcctggggtctgttcctccccagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggtgagagggacctggccttccatttctccagaggtcagaaaagagggaggcctgccccagactggcagagaactccttgatcccacaatgggaataaaaccccacttagggtgggtagcggcctgataggcctctggagggtggagagccacggctggcagagaatgggacagaaggcactggccaggggagtgaccacttatttgctgcaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgcttatgcgttagctacaggctcagcttccttccagggctagatacctcttcaggattagagacaagtgaaaccccaacactgctgagccctgaatgtggaaagagcccagctggtatctcgttcaccattgtttttctctcctccacataggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcatt

SEQ ID NO: 8654 - DNA, 7210 bp, Homo sapiens
  misc_feature (1157)..(1157): n equals a,t,g, or c
gatcttgtctgccactgacctttgacaggcacttgcctaaccaagtgccagtggggcttcctgctttctcaagttagctacctggacccagtgggaattgaggggaagtagggattgggtctgtacagtgtatggtaactgctcactgtttcttttcaggctgaagatggaaacattgaatataaagtgagtcctaggctggggaaaagcaggggctggggtaggttgtccttgccagtgtgggataatttcttttttctttctttcttttttttttttgagatgaagttttgctcttgttgcctaggctggagtgcagtggcgcaatctcagattctcctgcctcagcctcccaagtagctgggattacaggcatgcgccaccatgcctggctaattttgtatttttagtagagatgaggtttctccatgttggtcaggctggtctcgaactgctgacctctggtgatccaccagcatgggataagttctctgagagccttccaacttcataattatagcagtttaaggatatggttcaggttaagggctctgtacctcgttctgttggagggggatcaggtatgagtttaagtggaaagagaaagtcctggtccttgcagcagaacaggtggggaccatgtaggtttgggaggaacacctctgatttcaccttatgataccccacttgccctaagttgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaagtatgcttccccttccccaccagttctcctttacctgacttggggggacccatgcatacccagttacctagggcctgaggggccaaggtgggactttccttctcttgacaaagggctgaagtggggagggttagtgttttggtcccctcctcactggacctaggctgttttgctccttgaattaagatatgtatatttgttttaaagggaactgtgaatgaggaatagattggagggtggtaggaagtgcactaaggtattgggagctctgtggnaggtgcagaaagtctgtaggtccagagcgagcctggaataggagaaggacaggtgagatatggcagctgtgcccctgctgtgacagggttggggcagacataaccgttcttcgagagcgagaagtggattatgatagcgacatgccccggaagatcaccgaggtgctagtacgaaaggtccctgacaaccaacaggtgagcacacacccatccctgtctctcatgtccacactgtggaagggccctgtggtggcaggctgtctcctggcctgggatcctgggggcttccagttcatcacttgctccctagggagcgtcactgcccttgacccagtcttcagttagaggggtgagagattggagttcttatctctggcaattcatccacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtgcatgggatcaatgggacccaatggggccagactctgaggatgggatggtagtagtgaaggacataggatgggggtagagtgtggagactttttgaaatagtatagatgaatgccctgaggggactgtgaacaagctctgcccctcttaggaaatcaatggggaatcaactaaattaaataaaaaatggggtcaagattaagaggcagggtcacccagggaatggtttaggtcctggcaactctgaaggggttggaagggctggcaggaggcactgagggccctgggccctgggccaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattggtacgaggcattagggcagggacagggctgaaggggggtgctgactctcctaccctgggcctcaaatcttggagacagaccaatgctcctcttcttccctctcctccctcctgcattctcactcttctctcctgctgcttgctgtccttatgaggcagctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaagtaagcccaccttactctaaagccctgatccactaggaaggctgccacagagcccagggcccagaagcatgatatcctacttctccagggccagaccagttctggcttagttctgcgggtgtttcagcttgggattgtggaggggcatcttgctaaaaggcttgaccctcctcccgagccaacctggagcactgctgatgcctgcgaccatggcgatgaagtgctataccaagcatttgctgtttcccttgggctcggatgggctttttgtgtgacattgctcgactggctcacaagaaggcccagagttcctgagccatttgcagacaggagagaggggcccccagccagaacaaagctcacctttccatgtatggggctctggcctctgcctcctgtttggactgtcttcatctgtccattccatgcctccctctacagtgtcacccccatcttcacattgtccagtgtgtctggagagagtctggacctcctcaaagtctttctgaatattctgccgccactcaccaacagcaaagagcaggaggaactcatgcagcagctgacggagttccaggtagttgactgcccaaacatctaataggctgggaaacagggaggggctgcttcagaccaaacccagagtctgtttagagattttggacccaccagccctacttggcaggccattgatagcgttttctttggcttcaggtggatgaaatctacacagtaccagaggtggggactgttgttggaggaacactttccaggtaaattgtcttgcttgctaccctccccactcagccctcacctatatactcaaagacatcctggcccaaaggaggagaccctggaattgaacggaacccatttaaaggacatgcttatttgcagattaggctttcactatcagaagagctggagaacggtagtctgttggctttggagggaagaaacagtattgctgcctattggggaatctccaggcccctgagagagaagtgtgggtcttgagctccaggaagaaaactagagtgtattcaactgacttcatctcacacagggaaatgagagacgtcacttaagactcttctttctttctttctttcttttttttgagacagagtctcgctctgttgcccaggctggattgcagtggagcgatcttggctcactgcaacctctgcctcctgggttccagcaattctcctgcctcagccttgagtagctggaattacaggcgcctaccaccatgcccggctaatttttgtatttttagtagagatggggtcgtcaccatattggccaggctggtcttgaattcctgacctcaagtgatccacctgcctcagcctccccaagtgctaggattacaggtgtgagccaacgcggctggcctaagactctgcaaagcagagaatgaaacccaaggggataacttgctccttcagtgattaggtgttcggtgttgttaaaccagcaagtgtctctctgtccaccatcactgctggccttttatgaaattagtcttctgattctgaactctggcagtgagccctgttacatccaagtcagaatttagggttcttccccacttgagggactcaaccctagaagggaaggaatgctctgggtgatcctaatagagaagtaggtatggggaccttggctgacactgtgccacctgccctctgggctgcagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaaggtgaggtgggtgcatgggttggggagggaacgctaagagaagtgcctaggagactggctactgaatgagcacctatctaaggtgcttcagagaaactcagaggaaacacactctctgacccaagaagcttctggtctagctacgtagactataaaaacagcttaacgtactcatgaggtacagataactaaatatgaatcactatgttacactgtttttaatgaacactatttttagtgttcaggaccctaaaaatgtgaagcgttagatgggctagaggacgtaggaggtgggtaaagactcattccctctgagagttttgattattgtcttttgaggtctttgtgtttagagttgtgtagaggaagaggaaattcaggagctataaagggtgtggggtggctggggagggagagtctgatgttagagctgcccttcctgggcctggggtctgttcctccccagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggtgagagggacctggccttccatttctccagaggtcagaaaagagggaggcctgccccagactggcagagaactccttgatcccacaatgggaataaaaccccacttagggtgggtagcggcctgataggcctctggagggtggagagccacggctggcagagaatgggacagaaggcactggccaggggagtgaccacttatttgctgcaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcaggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcaaggatttgttggctaaggtttctctgtgcatatatatatatatacatatgtatatatatttaaatacacatatatattgtacagcccaaaaatgttttattgaatacactgtgcttatgcgttagctacaggctcagcttccttccagggctagatacctcttcaggattagagacaagtgaaaccccaacactgctgagccctgaatgtggaaagagcccagctggtatctcgttcaccattgtttttctctcctccacataggttcagagttccagtattgtaaccaagtattgtggcctattttccgtagttcaagtgagcagaatactgaggcctttcacgtgaaataggtagctaccctgtatttgaagagttggccacttgctagtggtcagaatagtaaggagcccacttctgtgccctggcagagatacagtgccagctacttaaagaagagtagaatttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcatt

SEQ ID NO: 8655 - DNA, 9139 bp, Homo sapiens; identical to SEQ ID NO: 8653

SEQ ID NO: 8656 - DNA, 502 bp, Homo sapiens
ttttgagacagggtctcaaactgtcacccaggctggagtgcagcggcacaatcatggcttattgcagccccaaactcccagattcaggggatcctcccaacctcagcctcctgagtaggtacgactacaggcataagccaccatctttgtattttttgtaaagactgttttgccatgggggctaggcccggttttgaactccagggctccagtagtccacccaccctcagcctcccaaagtgttaggattacaagcatcagccaccgggactggctaaatattgtcttttattagatattcaagtatcataaaagcagaaaatatttttgaagaaaaaaattaaaaggtaaatctagtggttttcaaatcttccccacctcttcaaactaaatatagaaccccccccccaatttataaataaaataaaaagtagaagttggggctggcctggtggctcaggcctgtaatcccagcactttgggaggccagggcgggtggatc

SEQ ID NO: 8657 - DNA, 123 bp, Homo sapiens
ggactcgcgggtatcggagctgttcggcggctgctgccggcccggagggggcccggccgtgggcggaaccctcaaggctaggggggccggcagcagcagcggctgcggggggccaaagggaaa

SEQ ID NO: 8658 - DNA, 132 bp, Homo sapiens
atttttgtatttttagtagagatggggtttcaccatgttggccaggctggtctcaaactcctgacctcaggtgatccacccgcctcggcctcccaaagtgctgggattgcaggcgtgagcctccgtgcccag

SEQ ID NO: 8659 - DNA, 602 bp, Homo sapiens
ttttgagacagggtctcagactgtcacccaggctggagtgcagcggcacaatcatggcttattgcagccccaaactcccagattcaggtgatcctcccaacctcagcctcctgagtaggtacgactacaggcataagccaccatctttgtattttttgtaaagactgttttgccatgtggcttaagccggttttgaactccagggctccagtagtccacccacctcagcctcccaaagtgttaggattacaagcatcagccaccgtgactggctaaatattgtcttttattagatattcaagtatcataaaagcagaaaatatttttgaagaaaaaaatttcctggtaaatctagtggttttcaaatcttccccacctcttcaaactaaatatagaaccccccccccaatttataaataaaataaaaagtagaagttggggctggcctggtggctcaggcctgtaatcccagcactttgggaggccagggcgggtggatcacttgagatcaagagttcaagaccagcctggccaacgtggcgaaaccccatctctactaaaaatacaaaaattagccaggcgtgatggtgcatgcctataat

SEQ ID NO: 8660 - DNA, 123 bp, Homo sapiens; identical to SEQ ID NO: 8657

SEQ ID NO: 8661 - DNA, 602 bp, Homo sapiens
ttttgagacagggtctcagactgtcacccaggctggagtgcagcggcacaatcatggcttattgcagccccaaactcccagattcaggtgatcctcccaacctcagcctcctgagtaggtacgactacaggcataagccaccatctttgtattttttgtaaagactgttttgccatgtggcttaggccggttttgaactccagggctccagtagtccacccacctcagcctcccaaagtgttaggattacaagcatcagccaccgtgactggctaaatattgtcttttattagatattcaagtatcataaaagcagaaaatatttttgaagaaaaaaatttcctggtaaatctagtggttttcaaatcttccccacctcttcaaactaaatatagaaccccccccccaatttataaataaaataaaaagtagaagttggggctggcctggtggctcaggcctgtaatcccagcactttgggaggccagggcgggtggatcacttgagatcaagagttcaagaccagcctggccaacgtggcgaaaccccatctctactaaaaatacaaaaattagccaggcgtgatggtgcatgcctataat

SEQ ID NO: 8662 - DNA, 1756 bp, Homo sapiens
gcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacgagaagatgatgaccaaagaggagctggaggaggagcagagaactgaagaataacgaagttatccttagcgtcctcctaaaggcttttccttttggcatcttaaaagcttgagagataaaatggaaaccccagagaggagtctgggcaggcgcccagggtgcatgctgcctccataaatctgctgagctctagaccctcaatcaggacttgtcccttggctagcaggatcctgagaacacctttggccctgccctgtgtagagatgttcatgtctgttcctgtgggtcactttgttaagctgaagagttttaagagttagagctcagaccctggactgggatttttcttaccactcaaacttgctatccacacaccctgcacaccttagataaaacgaacattttaaaagcagagttcactttcactccagtcccccctcttttgccctcactgaagccaaaccacagaagactttgaggaatgagagacaaatgaggtagagctcacctgtgctcaccagctccgtcagggtggtcagccgacccttttccctgggaaccccacttctctctctggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgcgtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccagtggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgatacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaaaaaaaaaaaaaaaaaaaaattcattaacaaaataa

SEQ ID NO: 8663 - DNA, 359 bp, Homo sapiens
aagatgtatactataaaccctaaagcaaaaaataaactaacaaaacaagttatagctagaaattcaacaaaggggatataatggaatcattacaatatccaattaatctcaaaggagtcagagaaaggaaaaaaatgacaaaagaacaaatgagaaaattattaagcaaacagcaaaatgaaagatttaaacttaacgacattcaataattttgtgaaatgtaaattacttaaatatctgaattaaaaagctgagactatgactggattttaaaaaaaaaaagcaaaacacaacatctcaaaatctaactacacgctgcctacaagaaacttatttcaaataggttaaataaagatcca

SEQ ID NO: 8664 - DNA, 893 bp, Homo sapiens
aaaatatctaccataacactttacattttttcttctgtaattagaaaatatgataattttttttcaccaggcactgtgtagatgcctccaaatgccctcctgttgtccagtgtgctaaatttttttttgctgacaagttttgtttgcaatgttaaaagggttgagaagcatcattctagtcaaatgtactcattttgtatgaagaaaactgaaatctacatagcaggctcagggatttgtccagtgtcctacagttggttggtgtgaggctggatttgaaaattggggatcttggatcttgactcttcagctctcatcacctcacactgaccccctctccccccgaaacatgagggaatattggaggaaggcattgatgataattgaaagacaaaaatacagaacctcagaggaattattaaaagaactgcacatatgtagttcagaaatctttgagaccctactgtatctaatagtgcttagaatcttcttatataataatattattaatattctataatctagaatagattatagtaggattcgttttatgatgacttgggctgtatctttaagaaaacaaaagattatagcaaaaggagtttagggcaaacataaataaaaattgatactaaaatcgtatgtatgctatttccaaaaaagggaggagggaatatatgagacctttcaagttcctctggtactataattacattttctctcatcttgcttttgattggattagaattcacgcaattaaagataatctagggccaggcacctataatcccagcactttgggaagcagaggcaggaagattgcctgagcccaggattttgagaccagtctgggcaacatggcaagaccccgtctctttaaaaaaaaaaaaaaa

SEQ ID NO: 8665 - DNA, 2152 bp, Homo sapiens
gacgttatgccactgcattccagcctgggcatgacagatcgagaccctgtctcagaaaaacagaaaagaatcttgtttgtaatactttaaaatactgtaaatagtatataaatagcaagttttgtttttatttctaattactgaaagtaattgctattttatcttttctatagttttattagactcctttttagaattatgtgattaaaattgttacttattcaatattgaatatctgtgttcaatacaatattgaagccagcctctgcttgactaggagaaaaaaacatccttattcactgtcatcgagtttgtagctttgtggtaaatacagataaaaacagcagttacaatataatgattgtaatgttcttgtcttatttcactttatttcataatcttattctgtagaaacatagtgatttcattggaattattttcctttatgggttttttgaaccaaaattagcacacattggattataatggaattgtttctaggtttattttctccactagattagaaacaagaaagcccaggcctttttctacaactaaaaatactcagatttcattgaatgtttgggtaattgaatttgagtggttttgtttctttgttttattgatgaatttattattgagtaaggacacttcctttttaaaaattacttggtatcctacatagattactatattaaagcattatttggctgttctcaatcagtgttttctttgttcagtgtgccaagatcatactctttagaacattgcattatgaaaatgaagttttgacagtcagttgtggagtttttgttttgtgtgtgtgtgtgtttatttgttttttaccttcccagttcttcagccctcttcccaccaccacaatgaccccatcaagagagacaataaatgtacccataatgtttgtgtaggatcagaatttattccagtattcacagcttttgaagcaagctttaagattgcataaatccttagtaatcatggtttaagagaaacaatcccagctcctataatttttcttcactccaatcagaaaggcaactggccatgaaatctcagctggaatatttaaaaggaaattcagatatggcttgctcgtttgttaacttattaccaaatgtattaaccaaaggaaagaatttaggccaaatctgacagggtcatatgacatatgcagggaaaagccaacaggttcctattaggctactcgaactcatcctactactactactcttttgcggggttaggggtaggttttttaaaatgttcttgtgtccatcagtcacaagaggaggtagttttcactaaagataaaaaattgaggcaacttttggaactatacattacccccttttgatagggtaatggaaattgacagggtgggttattgatggaaatgatgtcataactagtctgaagactatgttatgttaactaagtatgttattacttagtctgtttaaattccccttgatgaatgagggaagattgttaaataccttgtatggtgatagtctgccctttatttttttaagtttaaccagtaaagactataataaaaggtaagatttttaaaaattgctgatagaaaagaatcacaagcaatagaaacggaaacaacagatttttattttgtattttagaacacttggcttgtaatttgcatctaatgtttgcttgcatattgtcataaaattaacagttttaaggtagtacgtttgacatgtgtgtatttttataacagcctattaaaatgatgtggaagattatacttttaaatatgcccactttgtttttttaaactcattgtagtcttagtctttcctccaataaaattgttgtgtctttatatggcaaatgtatagttattataagcattctcacgcatgtgatcccagcactttgggaggccaaggcaggtggatcacgaggtcaggagatcaagaccatcctgactaacatggtgaaaccctgtctctactaaaaataaaaaaaaattagccgggcgtggtggcgggtgcctgtagtcccagctactcgggaggctgaggcaggagaatggcgtgaacctgggaggcggagcttgcagtaagctgagaccgtgccactgcactccagcctgggtgacagagtg

SEQ ID NO: 8666 - DNA, 143 bp, Homo sapiens
gtaatcccagtactttgggaggccaagacaggtggatcacgaggtcaggagatcgagaccatcctggctaacacggtgaaaccctgtctctactaaaaatacaaaaaaattagctgggcatggtggcgggcacctgtagtccc

SEQ ID NO: 8667 - DNA, 163 bp, Homo sapiens
ctgggcgtggtggctcacgcctgtaatcctagcactttgggaggccaaggcaggtggatcacgaggccaggagatcgagaccatcctggctaacatggtgaaaccccgtctctactaaaaatacaaaaattagctgggcatggtggtgtgtgcctgtaacccc

SEQ ID NO: 8668 - DNA, 303 bp, Homo sapiens; identical to SEQ ID NO: 6717

SEQ ID NO: 8669 - DNA, 264 bp, Homo sapiens
cagcactttgggaggccgagacaggcagatcacgaggtcaggagatagagaccatcctgactaacacggtgaaaccctgtctctactaaaaaactacaaaaaaattagccgggcgtggtggcgggcgcctgtagtcccagctattcgggaggctgaggcaggagaatggggtgaacccaggaggcggagcttgcagtgagtcgagatcgcagccactgcactccagcctaggcgacagaggcagactccgtctcaaaaaaaaaa

SEQ ID NO: 8670 - DNA, 146 bp, Homo sapiens
ctggtgcggtggctcacgcctgtaatcccagcactttgggaggccgaggcgggtggatcacaaggtcaggagatcaagaccatcctggctaacatggtgaaacactgtctctactaaaaatacaaaaaattagccgggctaggttg

SEQ ID NO: 8671 - DNA, 296 bp, Homo sapiens; identical to SEQ ID NO: 7617

SEQ ID NO: 8672 - DNA, 182 bp, Homo sapiens
ctgggcatggtggctcacgcctgtaatcccagcactttgggaggccaaggcgggcggatcacgaggtcaggagatcgagaccatcctggctaacatggtgaaaccccgtctctactaaaaattcaaaaaattagccaggcgcggtggcgggcacctgtagtcccagctactcagtaggctga

SEQ ID NO: 8673 - DNA, 4727 bp, Homo sapiens
ttgggaggccaaggcaggcggatcacgaggtcaggagatcgagaccatcctggctaacacggtgaaaccctgtctctactaaaaatacaaaaaattagccaggcgtggtggcgggcgcctgtagtccaggctactcgggaggctgaggcaggagaatggcctgaatccaggaggtggagtttgcagtcagccaagatcgtgccactgcactccagcctgggtgacacagcgagactctgtctcaaaaaaaaaaaaaaaaccctcggtttctgcatacctgtgtacttgtacctgttggtgcctgtatacctgaatggcctcacaactcaggcacctgctaatcagctcattagacagaccaaagagaaagctcattattgttttcatttacattttttatttccaagcacaagtaatctgcatcattgtttttttgagggttggatttattcttatcatagcattctttttatattatggttattaaacctctgactaacgtattttggcaagttagttttcctttctgttatttgcctctcatctcttcgttactttgggatgtgcacgttttaacagccgtcagatacagatgcatattttcacagtggtcagatagagcttgcctcctctgtcaggccgcgtggtacaggtgacagtcccgagctgagctttgtcactctcagcagaactcacctgcctgggcttcagcctccacacttgtaaaaaagggagccagttgtcgtctctcatttccctccagctccggaaagataaactgtctagtgactcagtgcaaggcaaactcagttcatccttcctaaacttcataaatagcaaatgttgccaataaggattaggtgacacataaaatcagagtctctcagacaacctgaggggcatgatttgtttgctgcaaacttacgatttttccttaagtaccttacacatggctaacatttgttcattttactttgcctatcctagaacaggagtcttcaatccctgggctgtggtctgggaccagtccgtggcctgttaggaactgggccacacagcagcaggagagctgcaggtgagtgaacctgactgcctgagcttggccccctgttagatcagtggcagcattagattctcataggagcacaaatcctattgtgaactgcacatgtgagggatctaggttgcacactccttatgagagtcgaatgcctgatgatctgaggtggaatagtttcatccccaaaccatacccctcccccaatcgcccatctgtggaaaaaagtgtcttccacgaaacagatgcctggtgccaaaaaggttggggaccctgtcctaaaacacaggattaaaataaaaaattcttgtctgagttttgagatccttgttgatctaagtcccaggaaatgatgtttcaaatagagactgaaacagcaataatgatgctttacctagtagctccatctgtctcagagtgaaaagtagcacccttcctttctgtatttaggaagaagagaaacacaattcactatttggggaacttacggtctttattatgttcttaacctttttcactgtggtctctgggaaccaattctctctccattcatcttaactcacaccagaagtgaccagtttcttatgagcagatgaccttaagacccgcagcatggacttcatttggggttggccctttgtcgcctgaggagaggcttatcttctttagtgctttatttaatggaatattcttcacctttgagctgttagtagcaaatggtgagtggcttctcgtcaccagttttcagactatttcagagaaaactggtgatcaatggttgataattctctgacttgaatcctaattgccaaatgcaatccaaagttattccgacaatgaaacattaacacatgaatactcacttgccctagtttagtaacagagacctgtacggtctaaatctacggatggatgttaggtgacaagttagccacccaatatgctcaagtgtaggtaaaactgtatttattttctaaacacagtgagctgaagaccagaaaagggaatgcatggtatgtctcagaccctgtgttaggtgctttatatatgtggccttgttgaattctcacagcaaacatgagaagcagaagtatcatctccagttcataggtaactgaatttcaaagggttttattcacttaatgaaaccacttttgcaaaaattatgacagaaaagtctgacctaggaaaattatgacagtgaaagaaatctgacctaactgactccattttgtttctaagctctaagttgcccttggttcattcttgggcccagcctaactaactttgggaggaattcagcttatagttcaactttaaaacgaagaagataacagcccctccccaaaacaaaccccgttcttacttggagaccagactgccttcgttaaactaacaaagtagccacaagattagaatttatggctagggagtcatgcagccagaggccacaaggttccaaacttggccaattgctcctacggataactagtaccactgtaacacctaaaactgatgtttgtggtatttttcagactgtgcattgtgatggaccagctggtgccacccagaccagtaaactggtttaactatttatgtgatcccactcaggaatgaaaaacaagaagacagttttggtccctatgatttcatccccgacttgactagtcagcattccccagccccttgcccaccaaactatctctaaaaaaaaccccagccttctaattttttaattgtggggggaggctgatttgaggaaataataaaactcctgtctcctgtctagcaggctctgtgtgcattaaattctttctctactgcaatttctgtatctcaataaatcagctctatctaggcagcagtcaagaactcgacgggcacttacattgttatggccctaatatgtacatactccagcccatacacatctgtctgattccaaagaatgactctgactatgcagatagtcatagttctcataatcaactggatatctggaggatcccagtgctgccacacattcatctgcatgtgcattttcccttctgatggtcaggccttctgttagctgctgctgcctgaagtgtacattttaaagggattcctccatcattcctgccaatactgccatattatttgcacgaggttccctgtccagcatttgcaggctttgtgtaggtgctcacacatctgtgatgtaatgctgatttcctcacccatagtaattgacatttgaatggaaattggccattttgattgcaaacattctggaactgctatgttgccaattgaaacggaaccctcaaaaccattattcaacaacaaaggaagtcacaggatacccatttggatgataggtcataggtgagaatcactacgctaaaataaattgatcaaattgttcctacaagcaattccatttcagtccctggaatttgttttcactttcctattcagccacatgaatacagaggctgcatccactctattttgctcttgcgaccaaggggtaaagacggtgccttcagatgcctgtgatggctcaggaaggggcctgggaggttgttggaggcagccatggaaccactgtcaatggtacaagtcatgcactattctttagcttgttgaagtttcattttctgtttgaaaaatgaaaccaataatttatctaaaacaagttaaggctgggcgcagtggctcatgcctgtaatcccagcactttgggaggctgaggcaggtggatcacttgaggtcaggagttcaagaacagccttgccaaggtggtgaaactccatctctattaaaatacaaaaattagccaggcgtggtggggagcgcctttaatcccagctacttgggaggctgaggcaggagaatcgcttaaacccaggaggtggaggttgcaatgagccaagatcgtgccactgcactccagcctaggcgacagagagagactctggctcaaaaaaataaataaataagtaaataaataaataacaggttaagtatcatgatgatggcaaatggaaagctgaaaatcttgagactattttcaacaaacttgactgaaatataccattttccaaacaggttcacctggtagtctgaatagagagtagaaagaggaagatggaaatgaggaagaaatacatgttctttgtcaagaaaggagtagtttattagcataatccagcatgttcctggagagcaagcaccatccaccatgagcaccggcctgcactgggccacccatggggaggcacaccagaaagttacattgtaaaagcatcttgttgccagtattgtcaggaatcatggaggaatccctttaaaaagcacacttcagggagtggcaactaacagaaggcctgaccatcagaagggaaaatgaggctgggcgtggtggttcacacccgcaatcccagaactttgggaggccgaggcgggtggatcacaaagtcaggaatttgagaccaacccggccaacacggtgaaactcggtctctactaaaaatacaaaaattagccaggcatggtggcacgcccctgtaatcccagctactcaggagtctgaggcaggagaattgcttgaacccgggaggtggaggttgcggtgagtcgagatcatgccactgcactccagcctgggcgacagagcaagactcca

SEQ ID NO: 8674 - DNA, 270 bp, Homo sapiens; identical to SEQ ID NO: 6749

SEQ ID NO: 8675 - DNA, 453 bp, Homo sapiens
aaaattcagcctaattattagctgtgctttcttggataagttatttagattctctaagctgttgtctcacaagtaaaatggagatatgtctgcctcataggctattaagaggatagcattctcatacagcagtgttacaaatgatgtatcataaaataatagtccaaccacctgccacatttcagaaacaaaaaaagatttatactttacatgcaatagacatacaaaaaattttaaattctgagggaaaaaaatgaaaatgccccacacatttgagtcatttatatattaatctggaaagaaatgctatctttctgtaacttctgttttatatttttatttcagcattcaccctgtgtgcatgagctgtattaaatgtatctgacatacatatatatatatatattttgtttgttttgttttgtttgtttagacagggtcttgctctattgc

SEQ ID NO: 8676 - DNA, 106 bp, Homo sapiens
ttacaggcgcctgccagcacgcccagctaatttctgtatttttagtagagacgggttttcaccatgttggtcaggctggtcttgaactcctgacctcaggtgatcc

SEQ ID NO: 8677 - DNA, 970 bp, Homo sapiens
tttccatcttatacacaataaatttgaggcatagagaggttaaatttgagcagtgtcactgtaactcacttttaaaaactgtgtgataattaaatggcagtccttagttttaacccagttatggctggctgtaagttccatcccgtcatgaccattatgtttcctcaacttttctattttcctacttcctttgctctgctctcagtcactgggagacgaaagtgctgctggttagcacagaagaaactgctgctgctgcggcttctactgttgtctgccatctctgttaccatcgagaccggggctgtgtatgctcgaggtgcagggagctaatgtataaggagttaaatgaactcttgctgctgccaaatatgttgttatcactaactgcaccgctgctgtcattagtgctgctgccaacactgcaagccctgctgctgccagtgccaattctgctgatgccttgggctctccatgtcccagggtgattccatagacaagcagctgcttttagatttcacttgctcattacctgtagatcctttgccttaggactcaagcttaagcccatgaagcctgggatagaagacaattggaggtatgttttatcttctctagcatctgggacaactggccttgaaccaaacatgtgcacctcgtttttcttttcccttcttcctctgagatttcttttcccataggctcttatttcatgcaatgatccactagccctggaaacaggaacataaacactcgaaccctagaatgaacataatttagtcttaactacattagatattttagtttgaaagaaatcactcacatttcataatcctgaaacatataaatttatacttagttatctgtgcaaaaattgaatcatgataattattaaagaattactatgcaagtgtaaatagctttggtattaaccaagagtggtttcagtgtgcttttgtaaaaaaaaaaa

SEQ ID NO: 8678 - DNA, 6044 bp, Homo sapiens
gggaggagccaagatggccgaataggaacagctctggtctacagctcccagcgtgagcgacgcagaagatgggtgatttctgcattttcgtctgaggtactgggttcatctcactagggagtgccagacagtgggcgcaagtcaatgggtgcgcgcaccatgcacgagccgaagcagggcgaggcattgcctcactcgggaagcgcaaagagtcagggagttccctttcctagtcaaagaaaggggtgacagatggcacctggaaaatcgggtcacttccacccgaatacagcgcttttccgacgggcttaaaaaacgccgcaccaggagattatatcccgcacctggctcggagggtcctacgcccatggagtctcactgattgctagcacagcagtctgagatcaaactgcaaggtggcagcgaggcttggggaggggcgcccgccattgcccaggcttgcttaggtaaacagagcagccgggaagctccaactgggtggagcccaccacagctcaaggaggcctgcctgcctctggaggctccacctctgggggcagggcacacacaaacaaaaagaccgcagtaacctctgcagacttaaatgtccctgtctgacagctttgaagagagcagtgtttctcccagcacgcagctggagatctgagaacgggcagactgcctcctcaagtgggtccctgacccctgacccccgagcagcctaactgggaggcaccccccagcaggggcagactgacacctcacagggctgggtactccaacagacctgcagctgagggtcctgtcagatagaaggaaaactaaaacagaaaggacatccacaccaaaaacccatctgtatatcaccatcatcaaagaccaaaagtagataaaaccaccaagatggggaaaaaacagagcagaaaaactggaaactctaaaacgcagagcgcctctcctcctccaaaggaacataattcatcaccagcaacggaacaaagctggacggagaatgactttgacgagctgagagaagaaggcttcagatgatcaaattactccgagctacaggaggaaattcaaaccaaaggcaaagaagttgaaaactttgagaaaagtttagaagaatgtataactagaataaccaatacagagaagtgcttaaaggagctgatggagctgaagaccaaggctcgagaactacgtgaagaatgcagaagcctcaggagccgatgcgatcaactggaagaaagggtatcagcgatggaagatgaagtgaatgaaatgaagcaagaagggaactttagagaaaaaagaataaaaagaaacgagcaaagcctccaagaaatatgggactacgtgtaaagacgaaatctacgtctgattggtgtaactgaaagtgatggggagaatggaaccaagttggaaaacactctgcaggatgtcatccaggagaacttccccaatctagcaaggcaggccaacattcagattcagaaatacagagaacgccacaaagctactcctcgagaagagcaactccaagacacataattgtcagattcattgaagttgaaatgaaggaaaatatgttaagggcagccagagagaaaggtcgggttacccacaaagggaagcccatcagactgacagcagatctctcagcagaaattctacaagccagaagagagtgggggccaatattcaacattcttaaagaaaagaattttcaacccagaatttcatatccagccaaactaagctttataagtgagggagaaataaaatactttacagacaagcaaatgctgagagattttgtcaccacgaggcctgccctaaaagtgctcctgaaggaagtgccaaacatggaaaggaacaactgataccagccgctgcaaaatcatgccaaaatgtaaagaccatcgagactaggaagaaactgcatgaactaatgagcaaaataaccagctaacatcataatgacaggatcaaattcacacataacaatattacctttaaatgtaactggactaaatgctccaattaaaagacacagactggcaaattggataaagagtcatgacccatcagtgtgctgtattcaggaaacccatctcacatgcagagacacacgtaggctcaaaataaaaggatagaggaagatctacgaagcaaatggaaaacaaaaaaaggcaggggttgcaatcctagtctctgataaaacagactttaaaccaacaaagatcaaaagagacaaagaaggccattacataatgggaaagggatcaattcaacaagaagagctaactatcctaaatatatatgcacccaaaataggagcacccagattcataaggcaagtcctgagcgacctacaaagagacttagactcccacacaataataatgggagactttaacaccccactgtcaacattagacagatcaacgagacagaaagttagcaaggatatccaggagttggactcagctctgcaccaagcggacctaatagacatctacagaactctccaccccatatcaacagaatatacatttttttcagcaccacaccacacctattccaaaattgaccacatacttggaagtaaagctctcctcagcaaatgtaaaagaacagaaattataacaaactgtctctcagaccacagtgcaatcaaactagaactcaggatgaagaaactcactcaaaaccgctcaactacatggaaactgaacaacctgctcctgaatgactactgggtatataacgaaatgaaggcagaaataaagatgttctttgaaaccaacgagaacaaagacacaacataccagaatctctgggatgcattcaaagcagtgtgtagagggaaatttatagcactaaatgcccacaagaggaagcaggaaagatccaaaattgacaccctaacatcacaattaaaagaaccagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccaatcccacagaaatacaaactaccatcagagaatactacaaacacctctacgcaaataaaccagaaaatctagaagaaatggataaattccttgacacatacactctcccaagactaaaccaggaagaagttgaatctctgaatagaccaataacaggatctgaaattgtggcaataaacaataccttaccaaccaaaaagagtccaggaacagatggattcacagctgaattctaccagaggtacaaggaggaactgataccattccttctgaaactattccaatcaacagaaaaagagggaatcctccctaactcattttatgaggccagcatcatcctgatagcaaagccgggcagagacacaaccaaaaaagacaattttagaccaatatccttgatgaacattgatgcaaaaatcctcaataaaatactggcaaactgaatccaacagcacatcaaaaagcttatccaccatgatcaagtgggttcatccctgggatgcaaggatggttcaatatacgcaaatcaataaatgtaatccagcatataaacagaaccaaagacaaaaaccacatgattatctcaatagatgcggaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcacgactcctattcaacatagtgttggaagttctggccagggcaatcaggcaggagaaggaaataaagggtattcaattaggaaaagaggaagtcaaattgtccctgtttgcagatgacatgattgtatgtctagaaaactccattgtcttagcccaaaatctccttaagctgctaagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcttgaaaatggccattctgcccaaggtaatttatagattcaatgccatccccatcaagctaccactgactttcttcacagaattggaaaaaactactttaaagttcctatgaaaccaaaaaagagcccacatcgccaagtcaatcctaatccaaaagaacaaagctggaggcatcacactacctgacttcaaactatactacaaggctacagtaaccaaaacagcatggtaccggtaccaaaacagagatgtagatcaatggaacagaacagagccctcagaaataatgccgcatatctacaactatctgatctttgacaaacctgacaaaaacaagcaatggggaaaggattccctatttaataaatggtgctaggaaaactggctagccatatgtagaaagctgaaactggatcccttccttacaccttatacagaaatcaattcaagatggattaaagacttaaatgttagacctaaaaccataaaaaccctagaagaaaacctaggcagtaccattcaggacataggcatgggcaaggacttcatgtctaaaacaccaaaagcaatggcaagaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaccacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacactttgacactgttggtgggactgtaagctagttcaaccattgtggaagtcagtgtggcgattcctcagggatctagaactagaaataccatttgacccagccatcccattactgggtatatacccaaaggactataaatcatgctgctataaagagacatgacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacacggatgaaattggaaatcatcattctcagtaaactatcacaagaacaaaaaacccaacaccgcatattctcactcataggtgggaattgaacaatgagaacacatggacacaggaaggggaacatcacactctggggactgttgtggggtggggaaagtggggagggatagcatggggagatatacctaacgctagatgatgagttagtgggtgcagcacaccagcatggcacatgtatacatatgtaactaacctgcacattgtgcacatgtaccctaaaacttaaagtataataataataaattaaaaaaaaaaaacaaaacaa

SEQ ID NO: 8679 - DNA, 16386 bp, Homo sapiens
ggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgaggtatctatatgtattgtcattctgctttttcttcagcatttgctgcaatatcagttttaaccattgagatgaggctatatggataacatgttttaaaattctttcaggctagtttaattcaaaatataatgtttgaattagagtcaacagattggatgtaggaggaaagaaaagaagaataaagaatcactcctaggttgtggtgtcagcagttgtgtagagagacaagaggaatgatagtttcttttttatccctaccttgttctttgttcagaacctaagagaaatgccagtagtcaggttgttgtggaaagaaagatggccgtattccataattcaccctttaaggaaggagatgtaatgattcttcgaaagccttaaactacatttcttttcttttccggattcattcattcagtactgactactttactttgtgttaggcactattctaggcactgtagataacagcagcgaataggacaaattcctgccctcatggagtttacagactagtgtgagagatagaaaataaccaaataaacaaatgaagaaagtaaagcagagtgagggtatagaaaatgactggggggtaagtgtgagggttagcaaccatcatccaaaggcggagagacctgagggagccagccatgcaaaggctggaagagggaacaggtggaggaaataccctgggttttcttccctgccactctttcatctaggtcttaaaaagaggaaccctagaggtagaaggtaaattgttgtgggatagtaggtgaaaagaaggaaattttaaaagactgggaatcgtggaagtcaactctgggcactatttttacaattttgtcatcaccttgtcagcctgtcctcaaaatgactcctttatattcttgtatttaaactaaaggacaacaatagaaatcaatgaggatgcatataaaattgatggactaattaagcctactaaattttacagagattgcaaggcttgttgtgttgcttttctcatctcttcctgctcttcaatcttttgagtccacagttagctgactttgatcttcagtgggcataatgaaagatgaagatatcacagcactataaataattatatttgaagatagcaggaaataaaactttatttttaatccaaaaatttttttatttccatagtgcttgaaaacaatatagttctgatgtaacataacatatattaacttgtggtatttagagatccaggtaaggcttttacatgcaattcataggtaatttataataacaaataccaaacctgcctttccctctgtccatattctctattcccctattctgctttgctttttaatctgagtacttctcccattctaatccattccatatttactactatatttgttatctgtctttctccaatatataagttttctgagggcaagtacttggtctatttccttcattactatatcctcaagttctagaacagtgcttgaatcataataggttcactaaatatttggaaaatgagtactctacatgtcatttcaactttttggttttaactaatcctgtcagagcagctagaatacagccaaactaggtgattcagattcccaatcttcatcctatagctgtgtaccaaattctgactgaggttctattatagagtggtataaatgaataatgaataggctatgggagaaagaagttaatatactaaaccaaaaactagataactgattttaaattatttaacatttaattatattttgtaactggaagatattacgctatcacttcctatttgtttttataagttgtggtttttgatagtcaggtttttaatagaagcaatttctaatatctacctattttcaagtttgttctcttcaatagatatagacttgattcataatcatattagcatcttacctacctatgttctttggtgatttgtttttagataaaaaactgtttttcatgatgtataaattttaataaaaaatttgagagctctaaaaggtaattgataatgttaaatcctcttggttaactaaaaaaaactcagtctttgaaaaataaagacctttttttttcatttcaagggatggagagaggaaaagtatgagcgttgagaggtaatgttttattatttattgttaattgtgcataattcatgttattttaaactaatattgaattaatttttagtaaatatcactgaaataagaaatctatttgcaaattactataacagtttttagtagtttacactccctgcaataaatgccttagtataagactattattttcagttgctataatctcaaaaattaacttcagctattttttaatgttggttttaatcctacctagtgaaaaccaagcattttagaatttcatatcttaatttctagcttgtttataaggacaattgagtatttacttcggaaatttaagaagtaacaatgggaattcttcctaaaattctttcaacattggtgattaagcagaagcttaatcaaacagtaaaatattactgataaaagagagcttaaagatgatctagtttagtggtttacaatcctgtttgaaaaccaaatgaaataatgatggaaacttaccgtttggggaaataagtcattgtttgaaacatccctcaattatctcctcaaagcagcaagtttccactgagacatttaagaaacactgacctagggcccggcaaggtggctcacccctgtaatcccagcattttgggaggctgaggtgggcagatcacttgaggccaggagttcgagaccagcctggccaacatggcaaaaccctgactctactaaaaatacaaaaatcagcccggtgtggtcgcttaaactttaatcccagctacttgggtggctgaggcacaagaattgaacccaggaggtggagtttgcagtaagctgagatggcaccactcactccactccagcctaggtgacagagtgagactctgtctcaaaatcaaaacaagacaaaacaaaacactgacctagtacaagattgtgttcatatttcacatatattatttgtggtcagaaaagctgattaacttttacaatacaacataataaatggctttgataaaaattgctattttaggttttggtccatatgaaagcaatcaaagagagagagaaaaaaaaaatccaaaagcaaaatagtattgccatatttgataaatttctctgccattttctctgctattgggaaaactattttatgtacaggaatgtgttctccactttttttttctggaaactttctccccttggctttctaaaatgggcaatataacatcaaatttggtatgaagttgggggaaaggaggttgcaatttatatcacaaactaactaacttctctaatatagaaagaactcataatcaataaaaaggaacagtaagccaacagaagaaatgaacaaagttctaaataattaacagaaaaggaaatacaaatggctcttaaaacaagtgaaattactaccattttcatttataattaaagaaatacagattgaaagttctctcagatacctttctttcactagtcaggttggcaaagattctaacatactctattggcaagactgtaggagtgaaaaatgtgtaaactttagagggagtacattaggtttttttattgctattaaaacaaatttctacaaatttagtggctcaaaacaaaacaaatttattctctatcattctgaaagtcagcggttctaaagttaatgtgttggtagagttccatttcttctagaagctctgggagagagtccatttctttatgaaaagcttctagaggccacagaatctttggctcatagcctcagcaacttctttctctgactctaaccctcctgcctccttcttataaggacccttgggattacgttgggcacagctggacattccagagtaatctctgtccgtcagaatttaatcacctctgctaaatcccttttgtcatgtaagatactaggttcacagattccagggattaggatgtggacatctttagggaccattatctagcctaccacagggggtaagaaatttcataatatgtatcaaaatcacagatacacatgtactttgatgccataattcttttactaagaattaattccacagatttagtcacatgtcattttacatatatacagggttactcactgcattttttatgatagaaaaaaactgtaatatccatgaatagagaattggttaaattaccttacatcattaaattagaatattatgctgctgtataaaaatgaggaaatcatttactcatggggaactctcaccatgataaattgagaaaagcagggtactaaacaatgtatctaaaattctactgtttatataaaaaatgagaggaaaatgtcttcttgtttgcttattttatatatatacacacatacacacacacacacacacacacacacacacacacacacacacacacacacgtggaatatttcttttttttgtttgtttttgagagggagtctcgctctgtcgcccaggctggagtgcagtggtgcgatctcggttcactgcaagctccgcctcctgggttctcgccattctcctgcctcagcttcccgagtagctgggactacaggcgcccgtatacgtggaatatttctaaggaattcataagaataagaagctgacacattggttgccactagggaagagaactgagtagctgaggataaggttagaagtagaaaggggactctttactgaagagtcacttgctcagggtccatactcatcattctggtctctttgtattatcctcttttaagttaatatcacttgtcaacttctttcaacacttttttgcagatgaattcaaaatacctacatttaatcttatcagccttctattttcagctgtctattaaacaactctgcgtaggttccatgagccaaccccttaaatctacttaaagatgtttctcatccataaaatccatgtgcagtaattggaatgatgttctcatttggactttcttaagataatcttctgtaataaagtctatatatacatataccctaatctgttttaagttctggaggcattaccattatctgttggtaattttaattatcttttttgtgatataatagagcaagagcataaaattgtttctttgctaatcaagctttcctgtttaggtgggtttccattatttatatagatcttagatgtttttacttaattaaattttagttcatctgaaaactttattttgtaatacagaaaaatataacttaatgctagccatataaacatgcataccatttccaaattatcctggattatagtttactttgtgcgccaaaattattcttgtctttctaggacattcagtgagataaataaagcggaagagcaatacagcctatgtcaagaactttgcagtgagcttgctcaggatctacagaaagaaagacttaaggtgctttattttgatatggtgtccttagtttttaagttttttaatagtaaaatgctaccttaaaagctagagttagattacacatttcttaaagatgaatacaaattaataaacgtcagaatagtgtattcctatccccaacagtcagatacaaatccaattctgacccatatctggagtctgtgatgaggtgattctatgaagaagcaccttatgagaatagagtggttcagtataattcagaggactttacttctgtacctcaggagtacatttgaataagttaaaaccaaagttacactggcattagagaataaggcaaaagaaaggatttccagagaattgtattcacatattacaaatgtctttccaatcatcctttaatgtttttcttacttagacaatgaccttctaaaataggcattttgtttcaaggttgtagtccaggttgcttaacacaggacaacaaaacctataaggctttgaacttgctattttataatcttcactcacaacaatttatatttagtgtattcccaacactctcaaaccagaggtagagtcagtacaaagcgtaataaaaaggtattttaaaattgctacacaggtacaaatatctggtttgatagaagaaataagacctagtgttcaatagatcagtaaggtgactatagtgtacagtaatctgtgttacataccagaatagctagaagagaataatttgaatgtttctcgcataaagaaaatacaaatatttaaggtgatagatatccgaagtacacttatttgatctttacaaagatcaaaactatgaggtacatgtgataatttactatgttcatataatgcatcagtaaaactattatgctaatcagtaaaaaatttgttttaaaaaaattactacaaagagtggaatatctgatgagtatctttctctatcataccttgaatttaaagaattttctttttaaaaaatatttaaataaacatttaattttatgatcattttagatttccagaaaagtcacaaaaataatagaatttcagcatactcctcacctggtttcctccattattaacatattaccagagtacatttgtcaaaaataagaaactgacatttaatacattgtcaattattaaccccagactttatttggagtttacttatttttccattaatgtcgtctctgccttccagaattcagtccaggggactacattgcatttagctgtcatgtctctccagtttcctggtctgtgatagtttcttagtttttccttctttttcatgaccttgacagtgttgggtagtactatacaggtattctgcagaatgtcgcccaatttgggtttgtctgatgattttctcatgattagatcagggttatggatttttagaaagagtatcacaaagaggaagtgtccttctcataacatcctatcatggggtgtataatagccacatgatgtcatggttgatattaaccttcatcacttggttagtgtttgctaggcttctccactgtgaagttagtgtttttccctttggaagtaagtcagtaaatctaactaccctcagatgagagagagcaggaattaacttcctcctccaggggatactaaaatatacataacataaaatttacattttaaccatttttaagtgtacagttcatattgttttataaccatcaccaccacccatctctagaactgtttcattgtctccactgaaaccctgcactcataaaacactaagtgtaaagggaattcttacattaaattgtttggcatagcatctggcaatgcagaaggcacacaataagtgtgaactattcataagtcgttttcagtgagacacttttagaaagatttttttccttcctttgtaggtaattaatcaacctccaaaagagattcagtaaaaataaaagtgatcatttaacctttccctcttgtaatggtcttttataaaaattcagttggggggccaggcacggtggctcattcctgtaatcccagctctttgggaggccaaggcagggggatcacctgaggtcaggagtttgagaccagcctggccaacatggtgaaaccccatcactactaaaaatggtggcgggcacctgtaatcccagctactctggaggctgaggctggagaatcacttgaacctgggaggcagaggctgcagtgagccaagatcccgccactgcactccagcctgggcatcagagtgagactctgtctaaaacaacaaaaaaaaaaacaaacaaaaaaattcagttgggaaggggaataaaaattactggctaaaatgggattttaggtcaggcatagtggctcatgcctgtaatcccagcacattgggaagctgaggccagaggattgcttgagcccaggagttcaagaccagcctggacaacatagcaaaatcacgtctctacaaagaaaatgtaaaaattagctgggcatggtggcacgagtgtgtagtcccagctacttgggaggctgaggtaggaggatagcatgagcctgggaggtcaaagctgcagtgagccacgatcatgccactgtactccagcctgggcaatagaatgggacccccatctcaaaaacaaaataaaatgggattttagcttatgtttggaaagggaagtaaacgtttttggctaaaatggtattttaattattctttttttttctgagacagagtcttgccctgtcacacaggctggagtgcaatggtgtgatctcggctcaatgcaacctccatctcctggcttcaatctattctcctgcctcagcctccccagccgctgggattacaggtgcctgccatcacgctcagctaatttttgtatttttattagagacagggtttcaccatgttggccaggctggtcttgaactcctgacctcgtgatccgcccgcccaaaatgctgggattacaggcgtgagccactgcagccggcctcttattctttatgatatgtttatcaccatgttttataaataattggttataattccatattcttatgtccgtaaacctttctgaatttttctaacatgtaaatgacttttttctagaagttaggaagtcatacagaataatgtattctggttgggtgcagtagctcatgcctataatcccaacactttgggaggccaggatcgcttgtggccaggaatttgagactagcctgggtaacatagtgagactctgattctacaaaaaaataaaaaattagctggtgtactggcacgcacttgtaatcttagctactcaggaggctgaggcaagaggattgcttgaacccagaagttgaaggctgcagtgagctacagctgtgccagcgcactccagcatggacaacagagagagaccctgtctcataaataaataaataacatattgtatatgttatagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtatgactttttcatttttttgtttttccttaaatctgctagattttcccaaataatcaactttgggaatacagggggcccccaacttaacaatggttcaacttaatgatttttcaactttgcgacagtgggaaagctgtatgctttcagtacactcttgacttacaaggtggttacatcccgataaacccatcataaattgaaagtattgtaaattgacttattatgttttcaatttacagcgggtttatctggatacaatcctactgtaactcaatgagcacctgtattctcgccttcattttatttcttaaacctgtttacgaagttcttcctttgctgctgccatttgtcttagttattagaccctgatgtgtgaagccatgatcattagtttaattccagtaagggtcaattaaagttgttattttccttataacttaatgaaattcttgtggccaggtgtgtttcaaaattcaaaacttttcagattttagaaagcaaattcagtgcatgtagagtatattacgttgtaatacttctttgtggatctggggcaacaccccctgttcaaacacattaatatttctgtagcaaaacaaaatattcagagactgtaaagactgatgacattaatttagtcatcaggtatcacttgttgcttacaattttcagaactttttggattttggaattacagataaaggattgtgacattgtgaaatcacatctccagccactacatggtaaaaagtaacaagccatgtttccaaagtgtactggttgaaagtatatatgtggatcaccactccaaatgcacattttactagtaaggagtgggtcactagccataattttatttatgaaagatatagcacacactgaaatcaactgaataaagtgttaattgaaagagccaggctgggcgcggtggctcacgcctgtaatctcaacactttgggaggccaaggcaggtggattgcctgaggtcaggagttcaagaccagcctggccaacatagtgaaactgcatctctacaaaaactacaaaaaattagctggacatggtggcgggcacctgtaatcccagctacttgagaggctgaggcaggagaatcgcttgaacccgggaagttgcagtgagctgagatcacgctgttgcactccagcctgggcaacaagagtgaaactccacctcagaaaaaaaaaaaaaaaaaaaaaaaaagcccaagagcagatatctatagaagcttaattcataattgccaaaactttgaagcaagcacgatgtccttcggtacgtgaatggataaataaactgtggtacatacagacagtggaataatattcagcacagaaaataaatgaattatcaattcatgaaaagacacgaatgaaacttaactgcataatgttaagtaaaagaagccagtctgaaaaagctaaatactgtgtgattccaaccatatgagattctggaaaaggcaaatatgagtaccataaaaaataattgattgtcaggagttaagaggggcaggaggtataaataggcaaaacacaggaattttagggcaatgaaatgattccgtatgattctataatgacacgtcattataaatttgtccagcgcccaggatgtattccaagggtgaaccctatgtaagctatggactttgagtgacaatgttgtggcagtgtaggtttatagattgtaacaaatgtaccactctagtgccacatgttgatagttggggtggtggaggggtgtgcatgtgtagggaaaggggatctttgggaactcattgtaccttctgctcaattttgctgtgaacctaaaattcctctaaaaaataaagtctattagaaaaaaaagagctaaagagtctgtatagttgactccagttagttactggtattaatttaatggtattatgtgtcacatatgaattaaaatcctacatcattatactaactccaaatagttaatatttaatgatattcttttataaaggaaggtaaatctgtacttataataccagctttgaaatgttacttatagtttctctctagccaaccttttgtatatgtcatagcactagacaaaatgtttttatgcattgtgagtgaattggctttgttcaatttgaaattgattgtgattggtttaatttaggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtaagtgtgtaattgttttaaactgcatgattttctaggaatatgtattattaaaattaatgagattgttgttaaatctgaaacatatactattaaatgggtagtttgtgtatgccgccatttagggaaatgttggttacattgccataggttagaattaactcaagcctgtagattgtgaatttggggaaaactttggtttgatcttgatttagcacagaatgaactcaaaggtttaaggagctgagtgatctaatcaaacaaattccttcagagaacatctgtgaaggcacagtggtaaattaactataactgcataactagaaagcctctttaacttattttttggtagtgctgactctacccaaatttcaccaataaaattaagtgtaatgctaataaaattagtaaattacaaagaaattatagtttttggtgtgtttacatatgaactatatagtactaaggaagtttaatcaataagttttaactttttaaatttgtatacaactttttaattatttcatattattcattatggaatttcttgactttctttcctctaaaggtagctcaagtggagtacagaaggctgtaacaagaacaaaaaggtatggctaatttgagctttaataaagctggctacaatatgaaaattcaattattttataaattattaagtaatcaatattaaaaatgaattattttctagaatctcttcctgcattttaattgtgtgttccttttcattctaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatacatatactgattctgtgtatcttttttataaccatgagaattttacttccattatacatcaattggaaatcaatcctgttaagagataattcttaaaagggaaattaggaatgggataagaaggtgatttttttattatttttatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggttttcttcaggaaaataaatatcacagtattatctgtgttaaaatggtttttgcctaaaatataatttttaatttggcttttcttatttaaaattccattatcttatgaataagcacttgaatcagtttttaaaatatttagtctaagatgattcaaagtagttttattttaatacaggacttttaaatggcagtatttcatttcttgtcaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaatagtagttagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctactaaaacgataaaaaaaaaaaaaaaattagccaggcttggtggcacacgcctgtaatcccagctactcagatggctgaggcaggagaactacttgaacctgggaggtcaaagctgcagtcagccaagatcttgccactgtactccagcctgaagagcgagactctgtctcaataatataataatagttattatttaattgcaacatgaagttggaagccattttctgttacttctttaaggagctaaatcttttatatttttgttttctctccccttgcgtttcatattttagcttatgatctaaatatatattttgtatattataatattttaggaatagcttaattaagaactcacagactttgacaaagtggtaactagacttttaattactagattcttcaaattaggcttaatgcctgctagcatgccaatccaatcccatgactgatgttattatacactatggcaaatacaaagttgtagtattatggttcttgatggtgtgatttacttatgtaaattatgtacaaatttaagttcaatgaaacactgatttaatgtactgaaaggtaaatagtaccatagtgaattattttctgtcttgccttaggtttatttttattatcttcaatattagaataaatgctaaattattttcatttaaggatttatgtagttgaatattatcatttagtaatatttaatcatttgaaataaaatttaaagctttaattgatctaatagagatggttttctacttttccactcttcctccctcttatgccttcacttttgttttctgtgcccagaattttcttcacattctttactacctgttttgtctattatatccaacccattttctttttattataattttgatttggggcatttgaagaaaatacagcaaaactacaagaactggtaataagcatgcataatctcacctacttagtgaacctaatataaacctaatataaagaaccaccgtatttgcaatatatataactggtgaaaaactagtgtccagaatatataaatgatccctatgaatcagtaagaaaaagacagtcaatagaaatttggacaaaagactttatatggcatttcaagtgaaaggaaatccagatgaccaagaaacatgaaaatattcccagccatattaatatttgagaagtaaaaaataaaactacaaggaggtattacatctttaccttatttgcaaaaatgaaatgatctaatgatactaagttttggtgatgatgtcagctcttacattgaaaacaatcactgtggaaaaatttgtccctcagtaaatttaaagataaacatgctcaaaacctagcaattgcactctgaagtatacatctttgcaggttatctttcattacagttatttttttccctgtcaggaccctaactaatacaatgccttgggaaaactaatgaacatgtatcctaggaagcatgtacaagaaagttcttcccagtcaggaaggtggccaagaaaaaaattttttaatgttcatagcagcactgcaatatccaaaagttagaaatgaaccaaatattcagcaatggtagaatggttaaattgtaccatggcatttatattgaaacagtagaattctacacagtggtgaaaatgaaggaaatagctaaccacaacatagatgaatatcacagacatagcatagagcaaaagaagcaaatcacagaaggatgccatcaacatgattccatttgtataaagtttaaaacagtataaactgaacaactatattgttttaagggtatatagttatatatatgagatacaactgtaaagaaaagcaagtgttttgctgtccccagaaccagaataatgatttcctctgtggagaagtacagcagtgtgattggggagtggcacctggtgcttctgggatgctggcaatgttctatttcttgtcttgggtggtgattgcatggatgttcacttttaaaatactctttatacatatatattttatatattcttgttcatatataacctttataataaagagaaaaaaatggcaaaaa

SEQ ID NO: 8680 - DNA, 10806 bp, Homo sapiens
taggacattcagtgagataaataaagcggaagagcaatacagcctatgtcaagaactttgcagtgagcttgctcaggatctacagaaagaaagacttaaggtgctttattttgatatggtgtccttagtttttaagttttttaatagtaaaatgctaccttaaaagctagagttagattacacatttcttaaagatgaatacaaattaataaacgtcagaatagtgtattcctatccccaacagtcagatacaaatccaattctgacccatatctggagtctgtgatgaggtgattctatgaagaagcaccttatgagaatagagtggttcagtataattcagaggactttacttctgtacctcaggagtacatttgaataagttaaaaccaaagttacactggcattagagaataaggcaaaagaaaggatttccagagaattgtattcacatattacaaatgtctttccaatcatcctttaatgtttttcttacttagacaatgaccttctaaaataggcattttgtttcaaggttgtagtccaggttgcttaacacaggacaacaaaacctataaggctttgaacttgctattttataatcttcactcacaacaatttatatttagtgtattcccaacactctcaaaccagaggtagagtcagtacaaagcgtaataaaaaggtattttaaaattgctacacaggtacaaatatctggtttgatagaagaaataagacctagtgttcaatagatcagtaaggtgactatagtgtacagtaatctgtgttacataccagaatagctagaagagaataatttgaatgtttctcgcataaagaaaatacaaatatttaaggtgatagatatccgaagtacacttatttgatctttacaaagatcaaaactatgaggtacatgtgataatttactatgttcatataatgcatcagtaaaactattatgctaatcagtaaaaaatttgttttaaaaaaattactacaaagagtggaatatctgatgagtatctttctctatcataccttgaatttaaagaattttctttttaaaaaatatttaaataaacatttaattttatgatcattttagatttccagaaaagtcacaaaaataatagaatttcagcatactcctcacctggtttcctccattattaacatattaccagagtacatttgtcaaaaataagaaactgacatttaatacattgtcaattattaaccccagactttatttggagtttacttatttttccattaatgtcgtctctgccttccagaattcagtccaggggactacattgcatttagctgtcatgtctctccagtttcctggtctgtgatagtttcttagtttttccttctttttcatgaccttgacagtgttgggtagtactatacaggtattctgcagaatgtcgcccaatttgggtttgtctgatgattttctcatgattagatcagggttatggatttttagaaagagtatcacaaagaggaagtgtccttctcataacatcctatcatggggtgtataatagccacatgatgtcatggttgatattaaccttcatcacttggttagtgtttgctaggcttctccactgtgaagttagtgtttttccctttggaagtaagtcagtaaatctaactaccctcagatgagagagagcaggaattaacttcctcctccaggggatactaaaatatacataacataaaatttacattttaaccatttttaagtgtacagttcatattgttttataaccatcaccaccacccatctctagaactgtttcattgtctccactgaaaccctgcactcataaaacactaagtgtaaagggaattcttacattaaattgtttggcatagcatctggcaatgcagaaggcacacaataagtgtgaactattcataagtcgttttcagtgagacacttttagaaagatttttttccttcctttgtaggtaattaatcaacctccaaaagagattcagtaaaaataaaagtgatcatttaacctttccctcttgtaatggtcttttataaaaattcagttggggggccaggcacggtggctcattcctgtaatcccagctctttgggaggccaaggcagggggatcacctgaggtcaggagtttgagaccagcctggccaacatggtgaaaccccatcactactaaaaatggtggcgggcacctgtaatcccagctactctggaggctgaggctggagaatcacttgaacctgggaggcagaggctgcagtgagccaagatcccgccactgcactccagcctgggcatcagagtgagactctgtctaaaacaacaaaaaaaaaaacaaacaaaaaaattcagttgggaaggggaataaaaattactggctaaaatgggattttaggtcaggcatagtggctcatgcctgtaatcccagcacattgggaagctgaggccagaggattgcttgagcccaggagttcaagaccagcctggacaacatagcaaaatcacgtctctacaaagaaaatgtaaaaattagctgggcatggtggcacgagtgtgtagtcccagctacttgggaggctgaggtaggaggatagcatgagcctgggaggtcaaagctgcagtgagccacgatcatgccactgtactccagcctgggcaatagaatgggacccccatctcaaaaacaaaataaaatgggattttagcttatgtttggaaagggaagtaaacgtttttggctaaaatggtattttaattattctttttttttctgagacagagtcttgccctgtcacacaggctggagtgcaatggtgtgatctcggctcaatgcaacctccatctcctggcttcaatctattctcctgcctcagcctccccagccgctgggattacaggtgcctgccatcacgctcagctaatttttgtatttttattagagacagggtttcaccatgttggccaggctggtcttgaactcctgacctcgtgatccgcccgcccaaaatgctgggattacaggcgtgagccactgcagccggcctcttattctttatgatatgtttatcaccatgttttataaataattggttataattccatattcttatgtccgtaaacctttctgaatttttctaacatgtaaatgacttttttctagaagttaggaagtcatacagaataatgtattctggttgggtgcagtagctcatgcctataatcccaacactttgggaggccaggatcgcttgtggccaggaatttgagactagcctgggtaacatagtgagactctgattctacaaaaaaataaaaaattagctggtgtactggcacgcacttgtaatcttagctactcaggaggctgaggcaagaggattgcttgaacccagaagttgaaggctgcagtgagctacagctgtgccagcgcactccagcatggacaacagagagagaccctgtctcataaataaataaataacatattgtatatgttatagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtatgactttttcatttttttgtttttccttaaatctgctagattttcccaaataatcaactttgggaatacagggggcccccaacttaacaatggttcaacttaatgatttttcaactttgcgacagtgggaaagctgtatgctttcagtacactcttgacttacaaggtggttacatcccgataaacccatcataaattgaaagtattgtaaattgacttattatgttttcaatttacagcgggtttatctggatacaatcctactgtaactcaatgagcacctgtattctcgccttcattttatttcttaaacctgtttacgaagttcttcctttgctgctgccatttgtcttagttattagaccctgatgtgtgaagccatgatcacttagtttaattccagtaagggtcaattaaagttgttattttccttataacttaatgaaattcttgtggccaggtgtgtttcaaaattcaaaacttttcagattttagaaagcaaattcagtgcatgtagagtatattacgttgtaatacttctttgtggatctggggcaacaccccctgttcaaacacattaatatttctgtagcaaaacaaaatattcagagactgtaaagactgatgacattaatttagtcatcaggtatcacttgttgcttacaattttcagaactttttggattttggaattacagataaaggattgtgacattgtgaaatcacatctccagccactacatggtaaaaagtaacaagccatgtttccaaagtgtactggttgaaagtatatatgtggatcaccactccaaatgcacattttactagtaaggagtgggtcactagccataattttatttatgaaagatatagcacacactgaaatcaactgaataaagtgttaattgaaagagccaggctgggcgcggtggctcacgcctgtaatctcaacactttgggaggccaaggcaggtggattgcctgaggtcaggagttcaagaccagcctggccaacatagtgaaactgcatctctacaaaaactacaaaaaattagctggacatggtggcgggcacctgtaatcccagctacttgagaggctgaggcaggagaatcgcttgaacccgggaagttgcagtgagctgagatcacgctgttgcactccagcctgggcaacaagagtgaaactccacctcagaaaaaaaaaaaaaaaaaaaaaaaaagcccaagagcagatatctatagaagcttaattcataattgccaaaactttgaagcaagcacgatgtccttcggtacgtgaatggataaataaactgtggtacatacagacagtggaataatattcagcacagaaaataaatgaattatcaattcatgaaaagacacgaatgaaacttaactgcataatgttaagtaaaagaagccagtctgaaaaagctaaatactgtgtgattccaaccatatgagattctggaaaaggcaaatatgagtaccataaaaaataattgattgtcaggagttaagaggggcaggaggtataaataggcaaaacacaggaattttagggcaatgaaatgattccgtatgattctataatgacacgtcattataaatttgtccagcgcccaggatgtattccaagggtgaaccctatgtaagctatggactttgagtgacaatgttgtggcagtgtaggtttatagattgtaacaaatgtaccactctagtgccacatgttgatagttggggtggtggaggggtgtgcatgtgtagggaaaggggatctttgggaactcattgtaccttctgctcaattttgctgtgaacctaaaattcctctaaaaaataaagtctattagaaaaaaaagagctaaagagtctgtatagttgactccagttagttactggtattaatttaatggtattatgtgtcacatatgaattaaaatcctacatcattatactaactccaaatagttaatatttaatgatattcttttataaaggaaggtaaatctgtacttataataccagctttgaaatgttacttatagtttctctctagccaaccttttgtatatgtcatagcactagacaaaatgtttttatgcattgtgagtgaattggctttgttcaatttgaaattgattgtgattggtttaatttaggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtaagtgtgtaattgttttaaactgcatgattttctaggaatatgtattattaaaattaatgagattgttgttaaatctgaaacatatactattaaatgggtagtttgtgtatgccgccatttagggaaatgttggttacattgccataggttagaattaactcaagcctgtagattgtgaatttggggaaaactttggtttgatcttgatttagcacagaatgaactcaaaggtttaaggagctgagtgatctaatcaaacaaattccttcagagaacatctgtgaaggcacagtggtaaattaactataactgcataactagaaagcctctttaacttattttttggtagtgctgactctacccaaatttcaccaataaaattaagtgtaatgctaataaaattagtaaattacaaagaaattatagtttttggtgtgtttacatatgaactatatagtactaaggaagtttaatcaataagttttaactttttaaatttgtatacaactttttaattatttcatattattcattatggaatttcttgactttctttcctctaaaggtagctcaagtggagtacagaaggctgtaacaagaacaaaaaggtatggctaatttgagctttaataaagctggctacaatatgaaaattcaattattttataaattattaagtaatcaatattaaaaatgaattattttctagaatctcttcctgcattttaattgtgtgttccttttcattctaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatacatatactgattctgtgtatcttttttataaccatgagaattttacttccattatacatcaattggaaatcaatcctgttaagagataattcttaaaagggaaattaggaatgggataagaaggtgatttttttattatttttatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggttttcttcaggaaaataaatatcacagtattatctgtgttaaaatggtttttgcctaaaatataatttttaatttggcttttcttatttaaaattccattatcttatgaataagcacttgaatcagtttttaaaatatttagtctaagatgattcaaagtagttttattttaatacaggacttttaaatggcagtatttcatttcttgtcaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaatagtagttagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctactaaaacgataaaaaaaaaaaaaaaaattagccaggcttggtggcacacgcctgtaatcccagctactcagatggctgaggcaggagaactacttgaacctgggaggtcaaagctgcagtcagccaagatcttgccactgtactccagcctgaagagcgagactctgtctcaataatataataatagttattatttaattgcaacatgaagttggaagccattttctgttacttctttaaggagctaaatcttttatatttttgttttctctccccttgcgtttcatattttagcttatgatctaaatatatattttgtatattataatattttaggaatagcttaattaagaactcacagactttgacaaagtggtaactagacttttaattactagattcttcaaattaggcttaatgcctgctagcatgccaatccaatcccatgactgatgttattatacactatggcaaatacaaagttgtagtattatggttcttgatggtgtgatttacttatgtaaattatgtacaaatttaagttcaatgaaacactgatttaatgtactgaaaggtaaatagtaccatagtgaattattttctgtcttgccttaggtttatttttattatcttcaatattagaataaatgctaaattattttcatttaaggatttatgtagttgaatattatcatttagtaatatttaatcatttgaaataaaatttaaagctttaattgatctaatagagatggttttctacttttccactcttcctccctcttatgccttcacttttgttttctgtgcccagaattttcttcacattctttactacctgttttgtctattatatccaacccattttctttttattataattttgatttggggcatttgaagaaaatacagcaaaactacaagaactggtaataagcatgcataatctcacctacttagtgaacctaatataaacctaatataaagaaccaccgtatttgcaatatatataactggtgaaaaactagtgtccagaatatataaatgatccctatgaatcagtaagaaaaagacagtcaatagaaatttggacaaaagactttatatggcatttcaagtgaaaggaaatccagatgaccaagaaacatgaaaatattcccagccatattaatatttgagaagtaaaaaataaaactacaaggaggtattacatctttaccttatttgcaaaaatgaaatgatctaatgatactaagttttggtgatgatgtcagctcttacattgaaaacaatcactgtggaaaaatttgtccctcagtaaatttaaagataaacatgctcaaaacctagcaattgcactctgaagtatacatctttgcaggttatctttcattacagttatttttttccctgtcaggaccctaactaatacaatgccttgggaaaactaatgaacatgtatcctaggaagcatgtacaagaaagttcttcccagtcaggaaggtggccaagaaaaaaattttttaatgttcatagcagcactgcaatatccaaaagttagaaatgaaccaaatattcagcaatggtagaatggttaaattgtaccatggcatttatattgaaacagtagaattctacacagtggtgaaaatgaaggaaatagctaaccacaacatagatgaatatcacagacatagcatagagcaaaagaagcaaatcacagaaggatgccatcaacatgattccatttgtataaagtttaaaacagtataaactgaacaactatattgttttaagggtatatagttatatatatgagatacaactgtaaagaaaagcaagtgttttgctgtccccagaaccagaataatgatttcctctgtggagaagtacagcagtgtgattggggagtggcacctggtgcttctgggatgctggcaatgttctatttcttgtcttgggtggtgattgcatggatgttcacttttaaaatactctttatacatatatattttatatattcttgttcatatataacctttataataaagagaaaaaaatggcaaaaa

SEQ ID NO: 8681 - DNA, 9411 bp, Homo sapiens
taggacattcagtgagataaataaagcggaagagcaatacagcctatgtcaagaactttgcagtgagcttgctcaggatctacagaaagaaagacttaaggtgctttattttgatatggtgtccttagtttttaagttttttaatagtaaaatgctaccttaaaagctagagttagattacacatttcttaaagatgaatacaaattaataaacgtcagaatagtgtattcctatccccaacagtcagatacaaatccaattctgacccatatctggagtctgtgatgaggtgattctatgaagaagcaccttatgagaatagagtggttcagtataattcagaggactttacttctgtacctcaggagtacatttgaataagttaaaaccaaagttacactggcattagagaataaggcaaaagaaaggatttccagagaattgtattcacatattacaaatgtctttccaatcatcctttaatgtttttcttacttagacaatgaccttctaaaataggcattttgtttcaaggttgtagtccaggttgcttaacacaggacaacaaaacctataaggctttgaacttgctattttataatcttcactcacaacaatttatatttagtgtattcccaacactctcaaaccagaggtagagtcagtacaaagcgtaataaaaaggtattttaaaattgctacacaggtacaaatatctggtttgatagaagaaataagacctagtgttcaatagatcagtaaggtgactatagtgtacagtaatctgtgttacataccagaatagctagaagagaataatttgaatgtttctcgcataaagaaaatacaaatatttaaggtgatagatatccgaagtacacttatttgatctttacaaagatcaaaactatgaggtacatgtgataatttactatgttcatataatgcatcagtaaaactattatgctaatcagtaaaaaatttgttttaaaaaaattactacaaagagtggaatatctgatgagtatctttctctatcataccttgaatttaaagaattttctttttaaaaaatatttaaataaacatttaattttatgatcattttagatttccagaaaagtcacaaaaataatagaatttcagcatactcctcacctggtttcctccattattaacatattaccagagtacatttgtcaaaaataagaaactgacatttaatacattgtcaattattaaccccagactttatttggagtttacttatttttccattaatgtcgtctctgccttccagaattcagtccaggggactacattgcatttagctgtcatgtctctccagtttcctggtctgtgatagtttcttagtttttccttctttttcatgaccttgacagtgttgggtagtactatacaggtattctgcagaatgtcgcccatttgggtttgtctgatgattttctcatgattagatcagggttatggatttttagaaagagtatcacaaagaggaagtgtccttctcataacatcctatcatggggtgtataatagccacatgatgtcatggttgatattaaccttcatcacttggttagtgtttgctaggcttctccactgtgaagttagtgtttttccctttggaagtaagtcagtaaatctaactaccctcagatgagagagagcaggaattaacttcctcctccaggggatactaaaatatacataacataaaatttacattttaaccatttttaagtgtacagttcatattgttttataaccatcaccaccacccatctctagaactgtttcattgtctccactgaaaccctgcactcataaaacactaagtgtaaagggaattcttacattaaattgtttggcatagcatctggcaatgcagaaggcacacaataagtgtgaactattcataagtcgttttcagtgagacacttttagaaagatttttttccttcctttgtaggtaattaatcaacctccaaaagagattcagtaaaaataaaagtgatcatttaacctttccctcttgtaatggtcttttataaaaattcagttggggggccaggcacggtggctcattcctgtaatcccagctctttgggaggccaaggcagggggatcacctgaggtcaggagtttgagaccagcctggccaacatggtgaaaccccatcactactaaaaatggtggcgggcacctgtaatcccagctactctggaggctgaggctggagaatcacttgaacctgggaggcagaggctgcagtgagccaagatcccgccactgcactccagcctgggcatcagagtgagactctgtctaaaacaacaaaaaaaaaaacaaacaaaaaaattcagttgggaaggggaataaaaattactggctaaaatgggattttaggtcaggcatagtggctcatgcctgtaatcccagcacattgggaagctgaggccagaggattgcttgagcccaggagttcaagaccagcctggacaacatagcaaaatcacgtctctacaaagaaaatgtaaaaattagctgggcatggtggcacgagtgtgtagtcccagctacttgggaggctgaggtaggaggatagcatgagcctgggaggtcaaagctgcagtgagccacgatcatgccactgtactccagcctgggcaatagaatgggacccccatctcaaaaacaaaataaaatgggattttagcttatgtttggaaagggaagtaaacgtttttggctaaaatggtattttaattattctttttttttctgagacagagtcttgccctgtcacacaggctggagtgcaatggtgtgatctcggctcaatgcaacctccatctcctggcttcaatctattctcctgcctcagcctccccagccgctgggattacaggtgcctgccatcacgctcagctaatttttgtatttttattagagacagggtttcaccatgttggccaggctggtcttgaactcctgacctcgtgatccgcccgcccaaaatgctgggattacaggcgtgagccactgcagccggcctcttattctttatgatatgtttatcaccatgttttataaataattggttataattccatattcttatgtccgtaaacctttctgaatttttctaacatgtaaatgacttttttctagaagttaggaagtcatacagaataatgtattctggttgggtgcagtagctcatgcctataatcccaacactttgggaggccaggatcgcttgtggccaggaatttgagactagcctgggtaacatagtgagactctgattctacaaaaaaataaaaaattagctggtgtactggcacgcacttgtaatcttagctactcaggaggctgaggcaagaggattgcttgaacccagaagttgaaggctgcagtgagctacagctgtgccagcgcactccagcatggacaacagagagagaccctgtctcataaataaataaataacatattgtatatgttatagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtatgactttttcatttttttgtttttccttaaatctgctagattttcccaaataatcaactttgggaatacagggggcccccaacttaacaatggttcaacttaatgatttttcaactttgcgacagtgggaaagctgtatgctttcagtacactcttgacttacaaggtggttacatcccgataaacccatcataaattgaaagtattgtaaattgacttattatgttttcaatttacagcgggtttatctggatacaatcctactgtaactcaatgagcacctgtattctcgccttcattttatttcttaaacctgtttacgaagttcttcctttgctgctgccatttgtcttagttattagaccctgatgtgtgaagccatgatcattagtttaattccagtaagggtcaattaaagttgttattttccttataacttaatgaaattcttgtggccaggtgtgtttcaaaattcaaaacttttcagattttagaaagcaaattcagtgcatgtagagtatattacgttgtaatacttctttgtggatctggggcaacaccccctgttcaaacacattaatatttctgtagcaaaacaaaatattcagagactgtaaagactgatgacattaatttagtcatcaggtatcacttgttgcttacaattttcagaactttttggattttggaattacagataaaggattgtgacattgtgaaatcacatctccagccactacatggtaaaaagtaacaagccatgtttccaaagtgtactggttgaaagtatatatgtggatcaccactccaaatgcacattttactagtaaggagtgggtcactagccataattttatttatgaaagatatagcacacactgaaatcaactgaataaagtgttaattgaaagagccaggctgggcgcggtggctcacgcctgtaatctcaacactttgggaggccaaggcaggtggattgcctgaggtcaggagttcaagaccagcctggccaacatagtgaaactgcatctctacaaaaactacaaaaaattagctggacatggtggcgggcacctgtaatcccagctacttgagaggctgaggcaggagaatcgcttgaacccgggaagttgcagtgagctgagatcacgctgttgcactccagcctgggcaacaagagtgaaactccacctcagaaaaaaaaaaaaaaaaaaaaaaaaagcccaagagcagatatctatagaagcttaattcataattgccaaaactttgaagcaagcacgatgtccttcggtacgtgaatggataaataaactgtggtacatacagacagtggaataatattcagcacagaaaataaatgaattatcaattcatgaaaagacacgaatgaaacttaactgcataatgttaagtaaaagaagccagtctgaaaaagctaaatactgtgtgattccaaccatatgagattctggaaaaggcaatatgagtaccataaaaaataattgattgtcaggagttaagaggggcaggaggtataaataggcaaaacacaggaattttagggcaatgaaatgattccgtatgattctataatgacacgtcattataaatttgtccagcgcccaggatgtattccaagggtgaaccctatgtaagctatggactttgagtgacaatgttgtggcagtgtaggtttatagattgtaacaaagtgtaccactctagtgccacatgttgatagttggggtggtggaggggtgtgcatgtgtagggaaaggggatctttgggaactcattgtaccttctgctcaattttgctgtgaacctaaaattcctctaaaaaataaagtctattagaaaaaaaagagctaaagagtctgtatagttgactccagttagttactggtattaatttaatggtattatgtgtcacatatgaattaaaatcctacatcattatactaactccaaatagttaatatttaatgatattcttttataaaggaaggtaaatctgtacttataataccagctttgaaatgttacttatagtttctctctagccaaccttttgtatatgtcatagcactagacaaaatgtttttatgcattgtgagtgaattggctttgttcaatttgaaattgattgtgattggtttaatttaggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtaagtgtgtaattgttttaaactgcatgattttctaggaatatgtattattaaaattaatgagattgttgttaaatctgaaacatatactattaaatgggtagtttgtgtatgccgccatttagggaaatgttggttacattgccataggttagaattaactcaagcctgtagattgtgaatttggggaaaactttggtttgatcttgatttagcacagaatgaactcaaaggtttaaggagctgagtgatctaatcaaacaaattccttcagagaacatctgtgaaggcacagtggtaaattaactataactgcataactagaaagcctctttaacttattttttggtagtgctgactctacccaaatttcaccaataaaattaagtgtaatgctaataaaattagtaaattacaaagaaattatagtttttggtgtgtttacatatgaactatatagtactaaggaagtttaatcaataagttttaactttttaaatttgtatacaactttttaattatttcatattattcattatggaatttcttgactttctttcctctaaaggtagctcaagtggagtacagaaggctgtaacaagaacaaaaggtatggctaatttgagctttaataaagctggctacaatatgaaaattcaattattttataaattattaagtaatcaatattaaaaatgaattattttctagaatctcttcctgcattttaattgtgtgttccttttcattctaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatacatatactgattctgtgtatcttttttataaccatgagaattttacttccattatacatcaattggaaatcaatcctgttaagagataattcttaaaagggaaattaggaatgggataagaaggtgatttttttattatttttatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggttttcttcaggaaaataaatatcacagtattatctgtggttaaaatggtttttgcctaaaatataatttttaatttggcttttcttatttaaaattccattatcttatgaataagcacttgaatcagtttttaaaatatttagtctaagatgattcaaagtagttttattttaatacaggacttttaaatggcagtatttcatttcttgtcaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaatagtagttagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctactaaaacgataaaaaaaaaaaaaaaattagccaggcttggtggcacacgcctgtaatcccagctactcagatggctgaggcaggagaactacttgaacctgggaggtcaaagctgcagtcagccaagatcttgccactgtactccagcctgaagagcgagactctgtctcaataatataataatagttattatttaattgcaacatgaagttggaagccattttctgttacttctttaaggagctaaatcttttatatttttgttttctctccccttgcgtttcatattttagcttatgatctaaatatatattttgtatattataatattttaggaatagcttaattaagaactcacagactttgacaaagtggtaactagacttttaattactagattcttcaaattaggcttaatgcctgctagcatgccaatccaatcccatgactgatgttattatacactatggcaaatacaaagttgtagtattatggttcttgatggtgtgatttacttatgtaaattatgtacaaatttaagttcaatgaaacactgatttaatgtactgaaaggtaaatagtaccatagtgaattattttctgtcttgccttaggtttatttttattatcttcaatattagaataaatgctaaattattttcatttaaggatttat

SEQ ID NO: 8682 - DNA, 355 bp, Homo sapiens
gaaggtggaaggactacactggctaagtcttctggcctccgtctttctcctgtgctgcatgtcttctgcccttgaacatcagactccaagttcttcagcttttggactcttggacttccaccagtgatttgccagggactatcaggccttcagccacagactgaagggctgcaccatctgcttgtctgcttttgaggttttgggactcagactggcttcctggcttctcagcttgcagactgtgggacttcaccttgtgattgtgtgagtcaattttcctaagaaactccccttcatatatacatctattagttctgtccctctagaggaccctaatacaccaccaaacaagtca

SEQ ID NO: 8683 - DNA, 14103 bp, Homo sapiens
ttaatggtgtttcaatattatgttgtctaaaagtatgttaacttttttaaaaaattaaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctggtaagtaaagatcaaatacaaaaaggaaattttataacgtactcaagtaagctttactgtttcatgaagggggaattctttattgaggtctaccagtttgctgagtatttttctgggtgccttatatatgactcaattactgaatcctttcaacatactttaaggcaggggaccccaacccccagttcacagattggtattggtccatggtctgttaggaactgggcctcacaacaggaggtgagcgtcaggcaagcaaacgaagcttcgtctgtatttacaaccacttcccatcacttgcagtatgcccgagctctgtcagatcagttgtggcattagattctcataggagtgcaaactctattgtgaactgcacatgtgagggatccaggttacatactcattatgagaatcaaatgcctgatgatctatcactgtctcccatcacccccagatgggattctctaattgcaggaaaacaagcttagggctcccattgattctacattatggtgagttgtgtaattatttcattatatattacaatgtaattataataggaataaagtgcacaataaatgtgacgtgcttgaatcatctcaaaactatcaccccaccagtccgtggaaaaattgtcttccacgaaaccagtctctggtgccaaaaaggttaggaactgctgctttaaggtactagtttttatttccatttggcaaaaaagaaaactcagagagatgtttaataacttgcccaaagttacaaacctaataatttccatggcaaattaaatttttccataagtaaccgttctagttaaagagagttgaagaagaaagaaaaggaaatgttattctaaagtattaatagagattttcaaactgatctgcaggccaaatccagctttttattggaacaaagtcacacccatttatttattactattgttgcactaaaagagcagagttcaataattaagtgatctgcaaagcctaaaatgattactatctggacttccacagaaaagaaaaggtttgccaaccctagttctggaataacatacttcgttaatagagtacatttagaatgcagttaaattgtttttcccatgacttagaacttttgcttttctgattactgagttgctcttcctttttaccactctaaccttagaagaaccaggatagctatgtgtggctgaaagtgtgttggaaattaaaagtagcaactaaaatagatgagataatatttaaaaagtattagaaaaacaagaagagttcttccctgttcctaactccttcccatgccttagatagctacaaaactaattcttactgagtgattattttattataaaactataatctgtttgtttttttatctctgcctctgtgagtatgcaggcagctgataagtctgattccaaaacactgttttttgaaaggaaactcccctttcctacaaatcatcaataaatatttcaaaaaatatatttaattttattaagatataacaccataaatttatgtatgtttatgtatgtgtatacatacaaacttgctgtagccatgttaaagctaaaccaactgcttttgaaatctacaaaatattttctttcctacaatttctgtcctcctaaaaatcagttattgtttctaaattcaaaattattgttatatttaaacaaagattaccccttttgtatgttgaacaaatagttttcccttctactaagcataactttttgtcctattaaacatatgaaagtatatctacaaattaatgggagtgattgtttgattattcccactgataaaattcttttttggcgaatttgatggatttttgaaatgttctaacttggcactgagagttgcaactgagatcctacagcagttacctattgctgcataacagcctcccccagtatttagtggacagccaaaatttatttgctcatgattctgtaatttgagcagagtgcgatggcgatggctcaaccttgctctacctggagttggctagggcaatttaactgaggctaaaaaatccaaggtggcttcattcataggtctggcacttcgactgaggagattggaatggattccagcttcagaactttctcctctccattgttgcttcaacatttagtaatctaccccaaaatatttacaatggttgctggattacaaaaagcaaaagcctaggtttcagaactcagtgtcacttccttcacattatttttatcaaggcaagtcacgtggcatgaggaactagaacccacttttgataagagtaacttgtaaagtattgtggctgtgatctacaatataccacaaatctaaaagttagagaaattcttatttaaaagtttgtttgtcctctgctatagatctagcttttatgtcaattatattaaacttatttactaaaccattggttttgtttctagtgctatccacattttctgttccagaacactgaccaaggattagtatagttctgagtactatcaagatgttttaagtgccatttgaaaatcattagacgaaaattcatattattctgaaataatcccttcatttgtttctgttttgcatttctttgaaatttcacttgagattctaaataaggatttaatttgtgataaaatttgttttataaatagtactgtggtctaccacgttcacatagactttcatcagatatcatcaccaacaggatttaataagcaatattctcctttttactctcatacttttgtagttccatctcctagtcaaaatgttttcagcaaaaaagataattaagccttaagaaaaaccttaatttctaaacttattttaagctttaatcacttcattttggagacttaatttggctgaccacatagaccttttatttttgttctagatgaaaagtttccaaaatcccaaatagaccaaattcgaaaagtttactattatactatactattactttatataatgtaacatctatactaattgtactatactattattttatgactattctatacaacttaccatactattactttcatgtaacataactcactatcatccaaattttgatattcattctataataagtatgccttaaaaccaatgaagtttagttggtagaaatataagaaaatctttttattagcacagtcttgcttatacctggtatcacattataaatatagggatagtaatgggagagggtcatggtatcaaaataccgtgacagaataagtcaaaacttggattaaaacagtggcctataatcagagaaatgcaaatcaaaaccacaatgagataccatctcacaccagttagaatggcgatcattaaaaagtcaggaaacaacaggtgctggagaggatgtggagaaataggaacacttttacactgttggtaggactgtaaactagttcaaccattgtggaagttagtgtggcgattcctcagggatctagaactagaaacaccatttgacccagccatcccattactgggtatatacccaaaggattataaatcatgctgctgtaaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatgtcctttttagggacatggatgaagctggaaaccatcgttctcagcaaactattgcaaggacaaaaaaccaaacaccacatgttctcactcatagatgagaattgaacaacgagaacacgtggacacaggaaggggaatatcacactctggggattgttgtgtggtggggggaagggggagggatagcattaggagatatacctaatattaaatgacgagttaatgggtgcagcacaccaacatggcacatgtatacatatgtaactaacttgcacgttgtgcacatgtaccttaaaacttaaagtataattaaaaaaatatatgatagaatgatgaccttgagtcattaataaaaaacaatgcttaatacattctatttttggaaaacaacaaaaacaaaaacaaaaaactggcctataaatgaaatgtccttgaattgaaaatgcacatattaatgtgtttcttatgaatgcattgatcaatatgtccatttaggtttgtgtatttttttccatgtggtcaattttctttcagtctacttcaaattaccatgcaaggagatttggtgttcgtgcagccatgccaggatttattgctaagaggctgtgcccacaacttataatagtgccccccaactttgacaaataccgagctgtgagtaaagaggtaagttaatgtctcacccctactttaggctttcactgagttcctgtcacctacagaatctcaagtccaagtgccttagcacgtaggatttggtcttagcttatcctttcagttgagcctcctatcacttcttcagcttgtatattgaatactgagctgcatatagcatccagaatacatcattctttttcccaattctttgcctttccatgcagttttcatttgcttagaaaacttcccatttcctcaaactttgaactgccttaatgataatataaaattaaatttagctattttttcttaatgtacaatatacattttttctagaaccacattttatttataacttacagaatctactcatcattaatttcaacctattgtctgaataattacttattaatgttgttaaacagtgacaaaattcatgtattttgattagcctactttacttgccccataatcatttgctgtctaagagactgataattgaaaagggagtaatccattgcttcaaaaaggatctttgaagtagatttgattatttactaaaattgccaaactgtcatatgtgaaaaccgccattttttctattttttatgacaactggtctatcatgcagtgctggaatttaatttttgaattaaaattttagactactacatcaaatacttttagactgctatagtaaaatgtgtttaagactgctgcctgaatggaaacacttaaaaaaactgtgacctaatacttattactctttagttataccaggggtctttaaattcacccctcttatttgtattccacctcattttccctagaagtgacactattccaagtttaaacacaggtttgtttgttttttttctgtccaaggcagtctgtgacagcaagtgctttttgcatacctctgaaaaggtggtggaggagaggggagcacacttacatttggttactgcttatctctttcattgtattcctaattaaaaagagataaaatactaatcataaatatagccttttaagaagttttaaaaatcctacaaaagtttagtaagaaaaggtattttttaaagtcgtactttaactcagcaaaacttctggcagtatgccagtgaaaaccaaagtgtttttagttattttagtctggttatttatgtaagtcagagaactcttcaaatttgagccggatctagctagtttatatgcagataacaaatgagttcttctgtgtaaatgaactgtagaacaaattcatcactgcctatggatacataaatattcatgacttggttagaaaatttaagaaaaagccctcccgttttttttgacacagggtctcaccccatagcccaggctggagtgccgtgactcgatcatacctcactataaccttaaactcttgagttaagcaatcctctggcctcagcctcctgagtagctagattgacaggcatgcatcaccacacccacctaattttaaaatttttttgcagagatagggttttcctatgttgctcaggctaggcttaaactcctggcctcaaaaaattatcctgcccaggcctcccaaagtgctgggattacaggcatgagccatcatgcccagttagccatttttgttttatccaaaatattggagctttaagtgcttgatttttactggaacgtctcttttaattcttacagcaatatcctatgtaaaggaagttaataaatactcaacagtgtctctagggagtacttctcattcagaatcttagttggctgccagttacagacttcacagagtttcattttcattggaaagattctatttgagcacattataacaagaacaaagctaattaaggcactctctgagtaaaacttggccaagtttatatcaccattttctaaaattccctttgactcagctgttcataattatattaagctaaaaacctttgtttttataaaagaagaaacagttttctcatgatacagtagacagttttaaaagctaaatggaagcttaacgtaattcagcaaatatgttttctaatataaattttttttgaggcagggtctcactctgtcacccaagctggaaaatatgcatattattttgacaaccattgcctctaattatagctaatacttaagtggttagaaaaaaaagtcatagttttatgtagtaacactatgttatataaaaggcatttctgaattaaaagccactataattctaatctttatatgtatttcttttatcctaagatgttactccagacttttccccatcatttaaggtaatcatggagtacactatagattgtcatttttttccattccagatcttaataagtaataggaaatagaaaacattccttttcctgtatggattaatgcattaattaatgttaagtggacttttatgtgcatgttataattaattggaatattttctaaagcaacatagtacctttatataagattattcctttttaaaatgaaccaaaaacaataaatcacaaaaggcaggagggaatagaatcctatcattcccacttcagcttctgacgagctacctaaaaccttaaccatttttttgtatgggcctaccagataatgttttctgagatttatttgaattgcttattataactagatataggtagctaaatagagattgtatcaaatgaagctattttatggtcttctgccttcatggtctattttaatacaaaaggaaattttgaaaatattccctggtagtggattatttattccttaaatccatgaactattgactgcaggattgttactgtagttgcaaactaagaatattaacatttcttatcagctacatatgacagaagaagtttgctatcacagcaaaatttaaacttttttttgtttcctttgaaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatggtaagcaacttattaagactatcaaaccaagaagcagtgaaaaaaaaaaacccacaactctttgaattaatccaattaatttattagcctgcataggtagaagggatagatatgtacctttataaaaatgtaaaatcagaaaattttaaaaataccagtgggttttctgagttaaacatgtggaatatcacatataaacaaaatgtgattgttaaatctctgagcttaagagtctgcagagtccctgaacaaagtaattttatagcagttattttcctaaggtctaactaacaaagagtttggatggcattgaagctgaggaagttgtctgtttaaagcggccttttcttgttgttagaaaagactagcctcaaacatatcaaaacattggatgattctatttttcttcattttcctaattttctataatctaattattatagcaattatgactgtttttagctctgccaaaattaatgacttcccactcccttctttgccttagactttataatttcaagactccagggtttttttaaaaaaataatccctttatgacctatccaaaagcaatgccaagaaacatgcagatattacacatactgctttcaacattttgtcaaaggtatgattatgtctgagatgtcctggacccctgaacaaagttcacctggatgaaaaagtgacacagaagggtttgctcacaacccacaggaacatttcatgtgcaccactcattgcttcagacgggccaggcagtgctggggagacctgtttgtaactttccctgaagcaaaaatggtagatccacaatgacattaatctaactctctcacattatttgtgactcacatcatttgatgcaagtttaatatgggcatcaaatacaacttcattaccttatttaaagtgctaagggatagctctctctttttttttataggagcattaaacaataatcatcatttctcgacacaggcacagagcaaaaggttttccttatttggtgtaactttattgtttgaggatgtggaacataaagcctgatgtcactttgtataaaatcttactttattaattccttactttcacaagagaatgggggaaaatcattaaataattatgtcaaagcatcccctgagggcctcccataacaattacttgcatgatgtgttttaaaagctttacattgggattaaagtaaatgttttcattttctactaatttttttcttttttttgagatagggtctcactgtgttgcccaggctggagtgcagtggtgcagtctcagctcactgcaacctccgcctcctgggttcaagcagttctcctgccttagactcccaagtatctgggattagaggcgcgtgccaccacacccgactaattttttgtatttttagtagaggtggggtttcaccatgttggccaggctggtctcaaactcctgacctcaggtgatctgcccgcctcggccttccaaagtgctgggattacaggcatgagccaccacgcccagcctactaatgttcttttcatttattataatgtccaaactcactatgaatatgtgaatttttaatatctattgcttttaacatatttacttgtatattgccctcttcgtgtattttcatattcttaaacaattggaatagttaaacttttcttctcatgtgtaaatacctgtgggctggactttcaggcgtgtctcacctcacatcatgccatgggaaattgtcaatagtgcattggaactgtggaaggcaattgatatatcttcctctaaagtccaagacattgttttgctgtttccccattttctaaaaggtgtttgtctttggaaatatattgctaactaccatctctacatacaaataaaataataattttttaaatgtttactctcccatgtaaatctggatggtgagtgccagataatataagaaactgaaataccatacactttttagcacttgtcttccaaatgaaatgctttaatcctagtgttacattctgattaccttagttatggggattataaagatgtttctgtcacaaagcaaataagaaactacttcagctcttagttacacagccaggcctcacaaaaaagtagaaagtagttcagattgaaaaggtacctgaacattctgcagcagctctgataatgtgtgagaaggcagcattcttcacttcctgctgtatagttctgctctcacagtggctcacctgagggcagggtggtagaggcatgaggtacaaaacatggcataaaaaactctgcagaacgggtttatgaatgtggcagataacttacttggtttgcagtttttctgtagctttctttaccgtgacttctacccatccagatggggaaaagggctccaggtagataccatttcaattgtttcacagtctttattttttttttatttttttttatttttttgagatggagtctcactctgtcaccaaggctggagtacagtggcacaatctcagctcactgcaacctctgcctcctgggttgaagtaattctcctgccccagcctccggagtagctgtgcgccaccattcctggctcatttttgtatttttagtagagatggggtttcaccatgttagccaggctggtctcgaactcctgacctcaggtgatcctcccacctcagcttcccaaagtgctgggattacagacgtgagccaccttgcctggcctgtttcccctctgaattgttctacattttaaaaccagcatattaaaaaatgacaggaactgaagcacataaatatcagctaatgtaagtttgaaaataaggcttattggcgaggcaaggtggttcacatttataatcctagcactttaggaggctgaggtgggaggatcagttgaggccaggagtttgagaccaccctgggcaagattgtgaaaccctatatttaccaaaaaattataaaattagctaagcgtgatggctcgcgcctgtagtcctagctatactccagcctgggcaagagggagaccctgtcttaaaaaaaaaaaaaaaaaaagagagaaagaaaataagcttattgtgtatgtgccctgggaattcagatttggaaaacatctgactgaattaacatctatgacttacttcacactacatattttaaatttttaaattaatcagatgtctgtcatatttattttatattatctttaaaattttttcctaaacagccaaatacatttttcaagtaatatacattcgtatgcatcttaaaactagaaatttaattttttcttctgtattgaccttaatttggaaaatatttatatgtaataaaattacgagatgggatcagaaagctttgttgctaaccttggttgttataaatacatttaaattgtatttcttctacattaagccaagaaaacaggctttaatagatttgttcatggagacatttttagtatcagtatagatttaagaatattttacagtccatttatgaaaaatataaatataaagaggcaataaccagactggtatttttactttactttgtaataatagtttatagcctattaataataacgtctctttttcttaaacttggattatccaatcagaccttcagaatttgtatattcaaagaagcataactttcacaggtaatttctatttattacaaatgtgcccttagtcaaagtgatactttataaacaagcaaatcaaaattaaaatcagcatttgaaagaagaaaattcagattattttaacatctaaaaggtttcttccataaatgaagaaaagttaagtgtttttccttctaaaaacaaaacttattttcagtataattattatatattgtttattatattctaaattctaattttcgaagattctttttcttcctaaagaagaataaagaaaagatttcctttttttttttttaagaaaaaggtaatgtgaactgaaacctaattctgaatttcaattaatttaggtacgaacattagtgagttttacataagatatttccttttaatatttatactgtggaaatggataatagtctttttaagaaaaattcataatcagtgttctctttaatggttataaaacattaaatgataaatgatggcatttctgatcttggatcctagaaactaaactaaactagatttttgtttttgtcttcagaaataatgtagggaaacctaacttatgaagtatatacttcttaaaataaaggtgagttattttcctgtttatgacttagataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggtatttaaaagagtattgatggccactgtagttataattttcagactggctaatttaagtgtaatattagtagtttctcattataaagtatatagtaacattttacttacttagtctttcattcaacttctaacaactttacctattcagaatagctgtgaacctagtaagtaaattggaattaagcagactatgagcctgaaggaaaaaaaagattatacgtttctttctttttttttttttttgagatggagtcttgctctgttgcccaggttggagtgcagtggggcgatctcattcagcttactgcaacctctgcctcctgggttcaagcgattctcctgcctcagcctcccaagtaggtgggactacaggcgcatgccaccatgcccagctaattttttgtattttcagtagtgacggtgtttcaccatgttagccaggatggtctccatatcctgacctcatgatccgcccaccttggcctcccaaagtgctgggattacaggcctgagccaccgcgcccgactcataaatttcatatagctatctttttctagcacaaaatatatttttattggttttgcatgtaataacttgagtattagtttttccttgggagacttcaatcctgtccaagattacattgcaggagagaacccagacggccacaaggtaagagacaaaagaaatactaactagcaacatagcaatccagaacaatctggtaaaaggaaaaacaaatttacatatgttgataacccatgaggccatcactgtctcttaacataataactgttattcatcatgaggaccctgaactatcttgtaaaagccatattgtgattaggtaaatcttttctttctacaccaaagcatgagaatgaataatgcattttaggaagatctatataacaattaaaatgaactgtttaatgaatatatttgaatatagctatttcaaattatcttaattaggactcctagaaattgtgaaacatctttttgaaaaatagtaatttgttttgtgaataacataaaaaggatacaccatctaattatcattattttaaatatactgtaaccagaatctttgattttttgctttatgtggataatctacgcaaaagacattttcaaagagtaaacatccaccctaaattatattctgtatcttttcttagagatagatatagaaccactataaaaacaatctgggctgggcatgatggctcacgcctgtaatcccagcactttgggaggccgaagctcgtggactacctgaggtcaggagttcgagaccagcctgaccaatatggtgaaacccccatctctactaaaaatacaaaaattagccaggcatggtgttgcgtgcctctaatcccagctactcgggaggctgagacaggagaatcgcttgaacccaggaggcggaggttgcagtgagccaagatcacgccattgcactccagcctgggcgacagagcaagactccatctgaaaaaaaaaaaaaaaaatctgtattcctactaaaggtagtaagtaagctaatagtaacacttaatattgcttagctcagaaattactcttacattttaaaatgtcatggagaattaaatatttctcatttttgctgccacaatgactgtaactagtacaatttattttcctaaaaccatagcaaaccctggggagatagatggtaatcaaatgttatttttaaagtagcattatatatcatttgagattttttgcaattaactttttttttctgttttgttattgcatatttaaaagtcatacatatcaacttctttgagtcatcagagtattcttcttttaaggcattgccccaaatacaatgttagcaaaagtatgcagtgataagaataaaccaaatggacaataccaaattcttcccaatagacaagctgt

SEQ ID NO: 8684 - DNA, 157 bp, Homo sapiens
atatttcttttttttgtttgtttttgagagggagtctcgctctgtcgcccaggctggagtgcagtggtgcgatctcggttcactgcaagctccgcctcctgggttctcgccattctcctgcctcagcttcccgagtagctgggactacaggcgcccg

SEQ ID NO: 8685 - DNA, 355 bp, Homo sapiens; identical to SEQ ID NO: 8682

SEQ ID NO: 8686 - DNA, 157 bp, Homo sapiens; identical to SEQ ID NO: 8684

SEQ ID NO: 8687 - DNA, 3264 bp, Homo sapiens
gggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggagattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattcttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgtaa

SEQ ID NO: 8688 - DNA, 1308 bp, Homo sapiens
agttttaagttcctgcatgctgctgacacaaatgaagattggtttgtctgcctggctgcacagttttcatggtcactcgtcacccaacctgtattatgtgcagattggtgtatgctggctctttgaggtctttaaacagataactaaacctcaatgcataatttttccattccacattcacaaaatgtttggcctcagcacagaaatccacatatctcaatcatctttttaagtttggctatgaatttgcatctagttcccatgtccttgccctccatctaaaagaactaatgaaacttcttgttttctgtttcattttaaaagtagattgtttgggaatgctaacgttgctttgggttttctactttttttaatgcagctttcaaaacgtcctagttgccgtcactcaccccagcccaccccactgcttgaaagttgagccatgtgatgtttctagtgccccatgatctcttctgatgtgtgtttggttttgatgctgagcagtcatgttttatagtctgggttttgtttctctcctaaatccaccatctccttgttctgccggccaattctcacctctctattttctcatcctccttttccttcccctggtatagatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagt

SEQ ID NO: 8689 - DNA, 133 bp, Homo sapiens
caaaaaactagccgggcgtggtggcaggtgcctgtagtcccagctactcgggaggctgaggcaagagaatggcgtgaacctgggaggcggagcttgctgtgagccgagatcatgccactgcactccagcctgg

SEQ ID NO: 8690 - DNA, 487 bp, Homo sapiens
cagacatgcaagtgcatgacctcagcttttttaattcatttgactcttgttttagtacctactgtgaacaagacacaaactctgggctcaaaaatctcatgctctaggtaaggaacacagacatataaagatattatgagactagagcagctttccctgaggaggtcagaaaatccttcacaaaacatgaaaaattctgtcttgagggatatatgggaatttgctgggtagagaaagagaggaaatgcattctggtggcatatagtctcaaagcatggaagagtatgctgtttacatactttcgagtttacaaagtgctttcctatatgtcatatgctttaatcattcactagctttgtatgatatcagatcaaaaggagttaagtgattatgcagtcaccggaataataggtatcagactagagtttgaattaatccatttcttccttgacttagtgcttatctaaatccaaaaactaaaaataaa

SEQ ID NO: 8691 - DNA, 487 bp, Homo sapiens; identical to SEQ ID NO: 8690

SEQ ID NO: 8692 - DNA, 1213 bp, Homo sapiens
cccacaaacagcactagaaaaagacatctgattatacctaggtggtacaggttttaaggattggacctttgactttgtgctcatccttctgtgtggaccagctttgctctttgattccagttattttaattccagttgtaatgatgggttttggacactctcagtctgtattatgaccaacagcatgtatccgtaagatagctaggtcactaatagtctgtggcatggaaaaaaatttgttttgttttaatatggtgctaactaagcatatagagattgactctgtaactttaactccagtaacacactgttatcaccacgcaaattgaccagcctagttagtaacatcatatgcaatatcatacaaactacgtagaaccatgcctggggcactcatctgttagctcttacatgccctttgtgctcaaagagaacaatttgtggttgttgtatgccagtcaattcagtcatcatggagcttagttgtttactgtattgcatgctaagcagtagactctaggaatctaataaatttgattctcacattggtcctgtttgccacaaacattgccatgcctcaagaacctcacaagtttgtttttcttagaacagtgcatatgtagttctcatactctgcaagtgtttgcctcagcataattgtgtttatgtggaattgcactggcattgcaatgtgagaatgacagagttgacaggaccactaacatgtaccctgggaattgtttcccccatccccatagctggctgaagaaactttatttctgagttattatgtagggactgaaaggttttttttttgtttttgtttttgtttttttttacatatatacacagattgttttttacctacaatgagcaaaaataatctggacaaaaaaataatgctctccctgttttttctttcaaatgtatacatatatttgaaatcttaggcatagggaaaaacttttatgtcatcttcagagctacagccatattttttagctagaaccaactcttaaatctctcccgacagaaccttaaggaaggggacaaagtgatctccaatggaaatgtgaaaggcataaaaaggaaaagttagatatctggaggattcagatgacacaaagaaaataagttgaagataaaggaaatgagagggtaaacctagtagtacaatggcatctttcatcttcaactattttaaagtattttt

SEQ ID NO: 8693 - DNA, 1213 bp, Homo sapiens
cccacaaacagcactagaaaaagacatctgattatacctaggtggtacaggttttaaggattggacctttgactttgtgctcatccttctgtgtggaccagctttgctctttgattccagttattttaattccagttgtaatgatgggttttggacactctcagtcggtattatgaccaacagcatgtatccgtaagatagctaggtcactaatagtctgtggcatggaaaaaaatttgttttgttttaatatggtgctaactaagcatatagagattgactctgtaactttaactccagtaacacactgttatcaccacgcaaattgaccagcctagttagtaacatcatatgcaatatcatacaaactacgtagaaccatgcctggggcactcatctgttagctcttacatgccctttgtgctcaaagagaacaatttgtggttgttgtatgccagtcaattcagtcatcatggagcttagttgtttactgtattgcatgctaagcagtagactctaggaatctaataaatttgattctcacattggtcctgtttgccacaaacattgccatgcctcaagaacctcacaagtttgtttttcttagaacagtgcatatgtagttctcatactctgcaagtgtttgcctcagcataattgtgtttatgtggaattgcactggcattgcaatgtgagaatgacagagttgacaggaccactaacatgtaccctgggaattgtttcccccatccccatagctggctgaagaaactttatttctgagttattatgtagggactgaaaggttttttttttgtttttgtttttgtttttttttacatatatacacagattgttttttacctacaatgagcaaaaataatctggacaaaaaaataatgctctccctgttttttctttcaaatgtatacatatatttgaaatcttaggcatagggaaaaacttttatgtcatcttcagagctacagccatattttttagctagaaccaactcttaaatctctcccgacagaaccttaaggaaggggacaaagtgatctccaatggaaatgtgaaaggcataaaaaggaaaagttagatatctggaggattcagatgacacaaagaaaataagttgaagataaaggaaatgagagggtaaacctagtagtacaatggcatctttcatcttcaactattttaaagtattttt

SEQ ID NO: 8694 - DNA, 1621 bp, Homo sapiens
aggagatgataaatggtggttaaatgtggtaatagtttgtggaagttcttttctgattgcttcagttttcttagtgaaatagaaagcaagaccagcagccaagaaagaacgtgaggaaggaggtgttgggtgtttgagttaaaagggaaaggggtaaagtatttatctaggaaagtaaatggactagggaagtatctgtgtgtgcattatagtccactaaaggttcaaagtaatgaatttaaattgagaccaatgagcatggttgtatgtttttttccagccacatttagttgcacaggtgcgggtgtggagtaggcagaaaattggatttaaacaaggttatagttttgccaagcactatgaagggagagaggggagagtgatgataataatgataaatcatggaatgtaagctcgataaagaggagagtgaagggacatcaagagcatgagagacagtggagatttcatgaggttgaacaatgaacaatagttcaggatcaccctagtagaaagaataagctggaaagatacgatgtggagatacagaattgagattatggaggggttatagttttttgtaatggcaacaaaaagttagctgaagaagaaaagaatacttctgaaaagtataaacttccttgtagatactgcatgggtaaggaggtaattataatgagaattacaaaatagttagagctgaacaacaatgaaattacttcacattagatcttgtagagtagctaaagagagaaaactgtaaccttaaatacatgtttaaggttaaaaaattagaaaaagtgaaaataaatgagctaagctttcaactcaagaagttgaaaacagagtaagcccaaagtaagtagaaggaatgaaataaaataaagataaaagcagaaattaatgaacagaaaacagaatagcagtagaaatagtgttaataccagaagctgattctttgaaaagatagaaaattcaataagcctttttattttccaatgtccaccttgactgcagtgttctaggacttctcaaaggcatcttacatgctagtctggggcctgggatgcaaacaaaaacagatcagaggcagttattttggcaacaatagggagagagaagagtcttcaaggtcccttaaagcaacacatagaacaattgagctgcatacataaccagggcatctactttttccagctgctgcacactgagccccatcagggagggtaaaatgcagtaaacctttcaaaagctgatctagagaaaaactataggtgaaaacaaatagtatttggaagagaaatagggacaaaattaagataaacatatttaaaatataagattattttgagcaactttatgacaataagcttgaaaacttagtttaagtggacactcttctgggaaaatataaaatatcaaaatgacttaggaagaaatggcaaaacaaagaagtcccgtaacctttaaagaaatttaatcatacttaaccaccacctccccaacctcctgcccaaaacaccaagcctagagtaatttgggggatgaattctatcaaactgtcaaggaacaagtataataatacttgccttacataaactgtttcagaaaataaaaagaa

SEQ ID NO: 8695 - DNA, 1621 bp, Homo sapiens; identical to SEQ ID NO: 8694

SEQ ID NO: 8696 - DNA, 711 bp, Homo sapiens
gggtaaagaaattttaatgaggattcaaggtttgtagggaagacacagaggaccggcgctcagccccagcctcctcacgtgtacatggctccatggaggttctccagtcggttctgctgctgctgctgttttcgagccttatctcgtctgtgttcctcataagtgtagtcatcagtgggcagctcatggcggcacaagggacaggaatttgtcttgcttagccagggcagaatgcaactggaatgaaaaaggtgttgggaagcatctcaatggcagtctcctcctcagattccaaaagatacacggggcacttgagctcagccttgagagcctctgatgactgtcctggagaggttctcaaccacaatcttggcagccggtggaggcaggtggtggtcccaatctactaccaaccccaagtcttcaaagtccatcctattcaaaagtgaccttacgagctccagcaccatgttggttcgagtctcctgcttgagggtccaacggctcacagtcgtgttcatcgatataggacgccatggctgcccagccgtctgacatgtgatgttttgatacaggtatacaatgtgtaactatcaaatccgagtaactggggtattgatcatcttgagaatttatcatttctttgtgttaggaacagtccaattccactcttttagttattttaaaatatgcaataaattattaactgta

SEQ ID NO: 8697 - DNA, 711 bp, Homo sapiens
gggtaaagaaattttaatgaggattcaaggtttgtagggaagacacagaggaccggcgctcagccccagcctcctcacgtgtacatggctccatggaggttctccagtcggttctgctgctgctgctgttttcgagccttatctcgtctgtgttcctcataagtgtagtcatcagtgggcagctcatggcggcacaagggacaggaatttgtcttgcttagccagggcagaatgcaactggaatgaaaaaggtgttgggaagcatctcaatggcagtctcctcctcagattccaaaagatacacggggcacttgagctcaaccttgagagcctctgatgactgtcctggagaggttctcaaccacaatcttggcagccggtggaggcaggtggtggtcccaatctactaccaaccccaagtcttcaaagtccatcctattcaaaagtgaccttacgagctccagcaccatgttggttcgagtctcctgcttgagggtccaacggctcacagtcgtgttcatcgatataggacgccatggctgcccagccgtctgacatgtgatgttttgatacaggtatacaatgtgtaactatcaaatccgagtaactggggtattgatcaccttgagaatttatcatttctttgtgttaggaacagtccaattccactcttttagttattttaaaatatgcaataaattattaactgta

SEQ ID NO: 8698 - DNA, 711 bp, Homo sapiens; identical to SEQ ID NO: 8696

SEQ ID NO: 8699 - DNA, 301 bp, Homo sapiens
gggcgctgtggctcacgcctgtaatcccagcactttgggaggccgaggcaggcagattacgaggtcaggagatcgagaccatcctggctaacatggtgaaaccccgtctctactaaaaatacaaaaaattagccaggcgtggtggtgggcgcctgtagtcccagctactcaggaggctgaggcaggagaatggcgtgaacccgggaggtggagcgtgcagtgagcagagaccgcaccactgcactctagcctggacgacagagcaagactccgtctcatttaaaaaaaaaaaaaaaaacaa

SEQ ID NO: 8700 - DNA, 837 bp, Homo sapiens
ttttatttcagtgtttgctcttcactagtatatataaaagttacttgagaaattgaaaatatttctgtaagcagaaatagtatttttttcaaaaagtgtttcagatgcttcagttattccttgcatcatttattgttcttttacagattttaatcccctttgttcttgttatgtgtgcttttgaagcagttcagttgactactcagttatcgtcaaaaaggtaagatgaattagtttaagaaacatttgatttgcctatttttaggagatgagagtaaactttcgaagacatttcatatgattgctattaagacactgtaacatagattgtttattacaaaaatgagaaaattttcacccgtttagtcagtgttgcttgtcattagaggaaattagttgattagggcctctagcagacaaacttgctttctcagcaataaaatgttattagagtattattcaagctagtgaagaacctccctagaaaacagtaaaacataaatgttaaattattgtagttaattacttgttataactgtgcctacaaaaagcaaaagatactctaacttttattttggtttatttcttaaatatgttatataaatatgttaacattatttcattttccatgacttaaaattaacttttctacatgtcaaaaatatactcagtttctctgtcatgatttctgtacatttgacaaatggagtaggaagtattctttctgagttttgaggaatttctggagcagtccgtcttaagcaatcaagactgtggaagaaaagctgtcaactcaactatttgctttttttaaccaataaaattgcctcatcagca

SEQ ID NO: 8701 - DNA, 837 bp, Homo sapiens; identical to SEQ ID NO: 8700

SEQ ID NO: 8702 - DNA, 837 bp, Homo sapiens; identical to SEQ ID NO: 8700

SEQ ID NO: 8703 - DNA, 555 bp, Homo sapiens
ttttagtatatttttgcaggatatttacatgaatttaatattgaaagtatttatgccttgtcaatatcacataagagatatttacttagatgcaataaaaactggtgaatgacatgtactttcctgcatctttgttggtggataagatttttagaagggattttaattaaggtttaaataagaagagctggggacatgtggaatgagaaatagaaggctcatcaaaatgtatgtgtgtatgtattcttatatttgtgcgtgtctatagtaatgctatctggaaactagtgcaatgaaaaacaaaacacaacaggagagaactgaggcaaaggtggctcagaaaggtctcttttgacctttaaactcagaagtcactgacatttcttcctggatatcacactgactcatcaaatttaatgtcacacattgaagccagtgatgccttttcttcctattgcaaactagcttctcatcctgttttctttatttaatacatcacacaagctgaagtccagccacccttactgccatactgcttaccaaataatcactgat

SEQ ID NO: 8704 - DNA, 555 bp, Homo sapiens; identical to SEQ ID NO: 8703

SEQ ID NO: 8705 - DNA, 555 bp, Homo sapiens; identical to SEQ ID NO: 8703

SEQ ID NO: 8706 - DNA, 12423 bp, Homo sapiens
agggcaacgtgtttatgtattatggactgtctaatttctatcaaaaccatcgtcgttacgtgaaatctcgagatgatagtcaactaaatggagattctagtgctttgcttgtaagtaaaatgataaatatgaaaatatgatatctgtaaaataagaatatgtagtaactgttcagttagaattgttaggatgaaattaaagtgttgtcatttatagtttgtatagtgaggatttttttccccccgagatggagtctcactttgtcgcccaggctggagtgcagtggcacagtctcagctcactgcaacctccaccccccaggttcaagcaattttgcctcagtctcccgagtagctgggattacaggtgtataccaccacacccagctaatttttgtatttttagtagagatggggtttcaacatgttggccagtctgctttcaaactcctgacctcatgatctgcccacctcggcctcccacagtgctgggattacaggcatgagccaccatgcctggcctgtatcatgaggatttttagttaaaatattttttcctggaattcacacagatgcattgatgcccagactggtttggaaatctgtggactaggggatcttagtttctttactgttcttcagttttccatattagtggttagtgcctatgtatttttttttattttttattttattttatttttttgagacagagtctcactctattgcccagactggagtgcagtggcgcgacctcggctcactgcagcctccacctcctgggttcaagtgattctcctgcctcagtctcccgagtatctgggattacaggtgcgcatcaccaagcccggctaatttttgtatttttagtagagacggggtttcgccacgctggccagactggtctcaaattctggacttcaggtgatctgccctcctcggccttccaaagtgctgggattacaggcttgagccaccgtgtccggccctaagtattttatgttactgttgccaatgcagcaaacattcagaggcccagagcaatttaggatttcttagaattaatgaatctcttagaatacaatttaggactatgttgtgagcagcatgggcctccgaaatgtaaaatataactgctctaggttatcttgattggttttattgctgatcatcagttgctgatgtgtgggattttaagcaatacaagtctacttaaagattccttggtatacacagggttctggttaggcctatgatattttgaatctatgtggggtttattccataggatccaatttttagcactcaaatccagagaagatgttgtactgtgagatacaccaagtttctagacctttctgaatgtgttttttagggattatagatagtgtgtgttccaaaaccccagaaatggtggctgatttacaattattttatttatatatgtgctgtgttcactgagggtaaagaaaactgaaactgattcttttcttccaaactgtaagcaaagatttcaggccacaccaggaatagatcaactttttctgtaaagggtcagatattatgtgtaaggccctgtacaatctggcatcagccttattatcttatatactatttttaatacattaaacaaggcctggctgccctgggccttgtttgctgctccctaaccatgcattgtgacacaagtaatctgctcattttgccagttagcattttatttgcttagaatgtcatttttactgtttccctggaggtcttctcatctcaaggcctgctattttttctaagtgcccttccatgcaaaaatgtgcttctttacatatttacttcatttatttttttgttccaagtcactaccactttttgcttggatgaacaaattgtgtctcacatcatccaatcctgctcctttccaggccattctcatagcagctatagtgaagtttttaaaaagtataaatatcacttccctacctaaaatctttcagtggtcatattagcacttgtagtaaaatctcaggatgatctgagctatgcgtaatcctcttatctcatcacatatcatcctccctcttggcatgctccagctacattcaccattaccttcacagaaataagttcttgtttagtggcatgtggtgttctctttgcttaaaactctcttctgtcttctctttacatggctggctcctggtcttttttttatgtcttaacttaaatgatacctcctccagagtcaaacttttcattaccatagattctaaagcagctcctcctatcctttttccattaaatactcacatagcctcttcataacacttactgtaatttgtaattacatatttgcttatctgttatctttctttccagctatactgtaagctcatgaaggcagggagcatgactttctttaatcactgtttaccaagtgcctggctcgtgcttgcacatggaaggcatttaataaatatttgctgaatgaatgtagacatcttcatcatggctcttatttcgtatgatagttggttttgtaagggtctgcttcccctgttacattttgagttgcttaaaaatagggattgtattcttttcgtttttctgtttttagcacctagtattgtacatgctgcatattaggtactcatcaaatagctttgtttttttttgttgttgttgtttgttgtttttttttttgagacggagtctcaccactctgtcgcccaggctggagtgcagtggtgcgatctcggctcactgcaacttctgcctccccggttcaagcaattctgtgcctcagcctcctgagtagctgggattataggcccccaccaccatgcccggctaatttttgtatttttagtagagacgtggtttcaccatcttaggcaggctggtcttgaactcctgacctcgtgatccaccagcctcggcctcccaaagtgctaggattacaggcgtgaaccactgtgcccggcttgtttttgtttttttctgagacagggttgactttgtcacccaggctggagtgcagtggcacgatctctgctcactgcaacctttgcttcctggactcaagcaaaccacccacctcaccctcctaagtagttgggactaaaggtgcacgccaccatgcctggctaattttttgtatttttgtagagatgggatttcgccatgttgcccaggcttatctcgaacacctggactcaagggatcctcccaccttggcctcccaaagtgctgaaattaggggcatgagccaccgcacccggccctcatcaaatagcttttgtaagccagttaatgcaaagtacctagcattgcttagtttagtacctgacacatagatagtaaatactattttcctttcttttaaaacttccttaagaatttagtggctagcagatatatttgccctattgttaatagctttatcaatacagatggtgtagggaccaaaaagctgagaagtcaaatattgaagagactttatgagatacctaccacagacttccttagccttatcttttccattcacacaagtgcttttatccaatctagacatggagaatatagatacaagtcaaggttagctggtaatgaaatagtcctaagaggtctaattagggtcctcttaatttcaaattgagattatcttggtatgtttatgtgttttgagacatggcttaatgtggcgggagggtcccagctcagacagacccctaacctcagacttgatatgatctctagttgaatcccataactgccacacctctttaagatcctcagtagggagtaagtcaaaaccaaaatctggaccacaggcaaatgttctgccttgtcagcatttttgtttttcttgtacctggatgcacagtttaaagattgatatattctaggaatctgcactagactccttccttcctttcttagatataggatttaaccccaaatcacaaaatttcagattgtatagttggacatgtttattttgtgaggcccagttaaattaaaggaattgcccaaggaactagaacctctagcctctttagttccagtttaagattttcttgttatatcacaactggattggcaatagaccatttcttaatttttcttgggcagaaaaccctttgtggtaatgtttctgtgataagaaaatcaaaaagatgtttatttgatatatgcatatatgacaaaacatatgcaagtaaaggttatattaaaaaggtaaggcagtaatgttcagaatacattttgaatatttaaatgtggtgttatctatagcctacttacattacagacctgtgtattataagtgagaaaaatataggtgttgaattcttaatcagtaatttagggatagctcatagttctcccaaaggcctggataataatttctctcttcttttccttgtaaaaaccagaatcccagtaaggaatgtgaaccttatcgaagaaatgaagacaaaccaattgctccttgtggagctattgccaacagcatgtttaatggtatgatatagatacaaatatagacatatataattaggacaatttgcataatttcattacagatttgatagtttagtaaacatgaatgaaattgagaaactcaaacatttaagactaaatcgagtattgaatggggtattataatgatttgtgattttcttttgagcatacttacattttagagtggatttctgtctctgagaagaaagaagcagaaacattctgctaatcttatttcatataaaaataaaagtcaggctgaccttcccactgacttcatttttatcattgaaaaggagctatagttgatcatttagagcagcactatctgatagaaatataatgtgagctataaatacaagtcctgtaggtaattttacattttctgtctttttttttttttcctttttctttttttgagatggagcgtcattctgtcgcccaggctggagtgcagtggcgcgacgtcggctcactgcaacctctgctccctgggttcaagcatttctcttgcctcagcttcccctgtaactgggattacaggcgcccgcaaccacgcctggctattttttttgtatttttagtagagacggggtttcaccatattggtcaggctggtcttgtattcctgacctcgtgatccgcccacttcggcctcccaagttgctgggattacaggcgtgagccactgcgcctggcctggtaattttaaattttctaatagtcatatttaaaactatgaaaagaaacaagtgaaattaattttagcaatatgttttatgtaacagtatatccaagatactgttatttcggcatataatactatataaaagttgagatacttcatattctaattttttatactaagtctttgatatctgatgtgtattgtacacttatagaacatactcatttggaccaaccacatatgaaagactcagtagccctgtgtgcctagtggctgttgtatgagacaatgcaaacagaaatggataagcaagaagctattggggatgcattattggaaggaaggaaatgcagatttaccttgcaattatagttgggttaatattaaaacatttgatcttactgcatgtcagctagcctatgggtaactgaattagaactctgttaaaggaagagaagtccatctagaattataaagttaccatagttaatccacataggaataaagaacaaatgtgaatcatatgcctactctgtcacaaccacttttggaaacaaatatcaggtccttatttctcatagagttaagcagatgctatgagttttcaagagatagttagtaatgtctttctttgcttgtgtttagatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtaaaacattactaatatcccttaaaaaattaaactaggagttttaatgaagtattttaaattttctatcttcagaatcttaaagttatgctttgaaaaacacaatttttctttcctcagcttcataccaagttaggtaaatgttctaatgtactaaaattctaaaggaaatgtatacttttaattatgaattcagtttctgtgatgtcttataagcatttcagctataatattttaaaattgcagcaaagcttcttttgaataaacccctatttattatccaaatttattcgtttctccgccactttaatttcacaatgtaatattttgtctccttatcccctccccactccttttaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacagtatccttttttggctgggtatacagattcatagagcttgaaaggagtcgagtccaaccttatatctgttatgtggcatgttaccttgtgctttagttttggtctctgcatttttacaaaagtatgtgtggtatatgtgagaatgtatttttaaatttacgtcttctagaaatgttttgaattcgcatatacttggtactggggtttgaagcatattgtttggtaaaattacttaaaatataggtgcttgttttattaacaagctaggtatttttacaagggagattgtaattgggcttaatgtaaaggccaatgagagtacctaaaattgggtgttgagtggtactgggctgttttaatatatatattttagatattaaaaatcaacggatgtgttaatttgtatcaatgtaattgttcatgattttgatctattggtagtatcaaaacattttattattagctatattgttccatattaataagttcacattcagtgctgataaatacatttattccactctaactatgtgttaacactgtgctgagtattttccgctcattacttaattcaggcagcagcatatctccctattacagaccagaatacaggaatatcgagcacttaagtaacttagctgactttacacaggtaataataaagagttgaggttcataaccaggctgttgactccaaaggccataattttactctcagctaccaacatagcctgcgtcttagctagttcactcagttacaccaacccatatctgcatagatgcagtcttttttaggagggaaatactcagtaatttcttttattctaaccaaagtctttgcatcttttaatctggagtctatattttacatacactgtgagtgaagagatctctcaatattagaattgtaaatgtttgctgatctttgcatttttatttccataatccaaatgagtcataatccatatgggttttggttttaaaatggattagtaaatggttaaattaatagacccaatttcaaaataaggttttttttgaattctactctcttgatgttgcacctgaatacacaagtaaatatggcctgctatggcaggctaaaagtgaccaagtttttgaaactaaatccacattggagcagttttggacagacagacccacttcaagtgctggtagaaataacattatcctgaggggatagtcaaactagagagtagctctgttaaaattagcatccagaaaatctctagagagtaagggcaaatttagcaacctgtagcctaaggcacaatgaagggaagtctgtgaagcactgaggaatttttagttgatagatgatttccatacaggaattctgcagcagggtcccaggtttgaaagaactatctaaaggaatgcatgatatatggcagattgagaagacttgataagacaggaatttggacctgcaaaacatcaagggttaattatcaaaattgggcataaggtgggaactaaagactagaatgatggcagaagcctgtttctttaggtttgggagactagagagagacaagcatgggtaatttgatactgtatcccacagaatgttgggttagctagaggtcttaaaatcattcctgccttagtttagggttaatttaagaagttagcagaactgaacctgccattgggagttagggacccatagggacccatctgtggggatggagagttgaagaaactagagaaacagatggggcctaaccctagattcaaaagatgcttttgaaaaagttgtaaactttttgcatggagacttggttctgtcttctttgctgccttacctcttgcaaaattctacaactggtccatgtagataattcatctagtacactggtgccctgtttcctaaatctccttaacagcccacccttcactgccactgttagctatcagctgtgtcacagagtgagttttgccattgctccaaatcagcaagttaaaacttttttattaccatgctttttgatcttttgctcagagccttttcatagtctcataactacactcttgatacatgtgttctttgagctcatggagacttctagttcctgatttttccattttctcctggtctgtcagtctccttgtgtgggcttcattgttcacttgaagtatttttttcacattgcattcctttgaggccttttgccccttccatgtaatgagagcaaaagcacctgagaaactacataacctttacatttatttgttttggtaaaatattttggcttttactactaacatttagtttgctaaatcagtctttcaagataatactttgtgtgtgtgtgtgtgtgatttagaacgtaggagtgaggtacctgtatatcctagaattacacaaatgaattaccaacaattaaatggcaacttttaaaattgtattttaaacatcaagtaaccagagatggaaaaatcttcctataccctcttcagattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaagtgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctaattaaattatggggattttggagtatgtacatgataaattataatatgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaactggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcgtatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagcgtcagtgagtccaggttttaacttcttcatgcctggatgggataaaatgtaattcattgttaaattaattcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtacacaggaaaaacctgactagtgaggaggagcagctgagagatagggtcagtgaatgcggttcagcctgctacctctcctgtcttcatagaaccattgccttagaattattgtatgacacattttttgttggttaagctgtaaggttttgttctttgtgaacatgggtattttgaggggagggtggagggagtagggaagtggtccttttacaagaattttgatgcataagtgtctattgtagggtttggatgatctagtaaagtgttttagaacccctttttatcccatgcaccattcagtaaacataaaaatcacaattctgctaatgtcatttggaacttcaaaataaatatcttgtctaaaaacaaatcagac

SEQ ID NO: 8707 - DNA, 12421 bp, Homo sapiens
agggcaacgtgtttatgtattatggactgtctaatttctatcaaaaccatcgtcgttacgtgaaatctcgagatgatagtcaactaaatggagattctagtgctttgcttgtaagtaaaatgataaatatgaaaatatgatatctgtaaaataagaatatgtagtaactgttcagttagaattgttaggatgaaattaaagtgttgtcatttatagtttgtatagtgaggatttttttccccccgagatggagtctcactttgtcgcccaggctggagtgcagtggcacagtctcagctcactgcaacctccaccccccaggttcaagcaattttgcctcagtctcccgagtagctgggattacaggtgtataccaccacacccagctaatttttgtatttttagtagagatggggtttcaacatgttggccagtctgctttcaaactcctgacctcatgatctgcccacctcggcctcccacagtgctgggattacaggcatgagccaccatgcctggcctgtatcatgaggatttttagttaaaatattttttcctggaattcacacagatgcattgatgcccagactggtttggaaatctgtggactaggggatcttagtttctttactgttcttcagttttccatattagtgggtagtgcctatgtatttttttttattttttattttattttattttttgagacagagtctcactctattgcccagactggagtgcagtggcgcgacctcggctcactgcagcctccacctcctgggttcaagtgattctcctgcctcagtctcccgagtatctgggattacaggtgcgcatcaccaagcccggctaatttttgtatttttagtagagacggggtttcgccacgctggccagactggtctcaaattctggacttcaggtgatctgccctcctcggccttccaaagtgcggggattacaggcttgagccaccgtgtccggccctaagtattttatgttactgttgccaatgcagcaaacattcagaggcccagagcaatttaggatttcttagaattaatgaatctcttagaatacaatttaggactatgttgtgagcagcatgggcctccgaaatgtaaaatataactgctctaggttatcttgattggttttattgctgatcatcagttgctgatgtgtgggattttaagcaatacaagtctacttaaagattccttggtatacacagggttctggttaggcctatgatattttgaatctatgtggggtttattccataggatccaatttttagcactcaaatccagagaagatgttgtactgtgagatacaccaagtttctagacctttctgaatgtgttttttagggattatagatagtgtgtgttccaaaaccccagaaatggtggctgatttacaattattttatttatatatgtgctgtgttcactgagggtaaagaaaactgaaactgattcttttcttccaaactgtaagcaaagatttcaggccacaccaggaatagatcaactttttctgtaaagggtcagatattatgtgtaaggccctgtacaatctggcatcagccttattatcttatatactacttttaatacattaaacaaggcctggctgccctgggccttgtttgctgctccctaaccatgcattgtgacacaagtaatctgctcattttgccagttagcattttatttgcttagaatgtcatttttactgtttccctggaggtcttctcatctcaaggcctgctattttttctaagtgtccttccatgcaaaaatgtgcttctttacatatttacttcatttatttttttgttccaagtcactaccactttttgcttggatgaacaaattgtgtctcacatcatccaatcctgctcctttccaggccattctcatagcagctatagtgaggtttttaaaaagtataaatatcacttccctacctaaaatctttcagtggtcatattagcacttgtagtaaaatctcaggatgatctgagctatgcgtaatcctcttatctcatcacatatcatcctccctcttggcatgctccagctacattcaccattaccttcacagaaataagttcttgtttagtggcatgtggtgttctctttgcttaaaactctcttctgtcttctctttacatggctggctcctggtcttttttttatgtcttaacttaaatgatacctcctccagagtcaaacttttcattaccatagattctaaagcagctcctcctatcctttttccattaaatactcacatagcctcttcataacacttactgtaatttgtaattacatatttgcttatctgtcatctttctttccagctatactgtaagctcatgaaggcagggagcatgactttctttaatcactgtttaccaagtgcctggctcgtgcttgcacatggaaggcatttaataaatatttgctgaatgaatgtagacatcttcatcatggctcttatttcgtatgatagttggttttgtaagggtctgcttcccctgttacattttgagttgcttaaaaatagggattgtattcttttcgtttttctgtttttagcacctagtattgtacatgctgcatattaggtactcatcaaatagctttgtttttttttgttgttgttgtttgttgttttttttttgagacggagtctcaccactctgtcgcccaggctggagtgcagtggtgcgatcttggctcactgcaacttctgcctccccggttcaagcaattctgtgcctcagcctcctgagtagctgggattataggcccccaccaccatgcccggctaatttttgtatttttagtagagacgtggtttcaccatcttaggcaggctggtcttgaactcctgacctcgtgatccaccagcctcggcctcccaaagtgctaggattacaggcgtgaaccactgtgcccggcttgtttttgtttttttctgagacagggttgactttgtcacccaggctggagtgcagtggcacgatctctgctcactgcaacctttgcttcctggactcaagcaaaccacccacctcaccctcctaagtagttgggactaaaggtgcacgccaccatgcctggctaattttttgtatttttgtagagatgggatttcgccatgttgcccaggcttatctcgaacacctggactcaagggatcctcccaccttggcctcccaaagtgctgaaattaggggcatgagccaccgcacccggccctcatcaaatagcttttgtaagccagttaatgcaaagtacctagcattgcttagtttagtacctgacacatagatagtaaatactattttcctttcttttaaaacttccttaagaatttagtggctagcagatatatttgccctattgttaatagctttatcaatacagatggtgtagggaccaaaaagctgagaagtcaaatattgaagagactttatgagatacctaccacagacttccttagccttatcttttccattcacacaagtgcttttatccaatctagacatggagaatatagatacaagtcaaggttagctggtaatgaaatagtcctaagaggtctaattagggtcctcttaatttcaaattgagattatcttggtatgtttatgtgttttgagacatggcttaatgtggcgggagggtcccagctcagacagacccctaacctcagacttgatatgatctctagttgaatcccataactgccacacctctttaagatcctcagtagggactaagtcaaaaccaaaatctggaccacaggcaaatgttctgccttgtcagcatttttgtttttcttgtacctggatgcacagtttaaagattgatatattctaggaatctgcactagactccttccttcctttcttagatataggatttaaccccaaatcacaaaatttcagattgtatagttggacatgtttattttgtgaggcccagttaaattaaaggaattgcccaaggaactagaacctctagcctctttagttccagtttaagattttcttgttatatcacaactggattggcaatagaccatttcttaatttttcttgggcagaaaaccctttgtggtaatgtttctgtgataagaaaatcaaaaagatgtttatttgatatatgcatatatgacaaaacatatgcaagtaaaggttatattaaaaaggtaaggcagtaatgttcagaatacattttgaatatttaaatgtggtgttatctatagcctacttacattacagacctgtgtattataagtgagaaaaatataggtgttgaattcttaatcagtaatttagggatagctcatagttctcccaaaggcctggataataatttctctcttcttttccttgtaaaaaccagaatcccagtaaggaatgtgaaccttatcgaagaaatgaagacaaaccaattgctccttgtggagctattgccaacagcatgtttaatggtatgatatagatacaaatatagacatatataattaggacaatttgcataatttcattacagatttgatagtttagtaaacatgaatgaaattgagaaactcaaacatttaagactaaatcgagtattgaatggggtattataatgatttgtgattttcttttgagcatacttacattttagagtggatttctgtctctgagaagaaagaagcagaaacattctgctaatcttatttcatataaaaataaaagtcaggctgaccttcccactgacttcatttttatcattgaaaaggagctatagttgatcatttagagcagcactatctgatagaaatataatgtgagctataaatacaagtcctgtaggtaattttacattttctttcttttcttttttttcctttttctttttttgagatggagcgtcattctgttgcccaggctggagtgcagtggcgcgacgtcggctcactgcaacctctgctccctgggttcaagcatttctcttgcctcagcttcccctgtaactgggattacaggcgcccgcaaccacgcctggctattttttttgtatttttagtagagacggggtttcaccatattggtcaggctggtcttgtattcctgacctcgtgatccgcccacttcggcctcccaagttgctgggattacaggcgtgagccactgcgcctggcctggtaattttaaattttctaatagtcatatttaaaactatgaaaagaaacaagtgaaattaattttagcaatatgttttatgtaacagtatatccaagatactgttatttcggcatataatactatataaaagttgagatacttcatattctaattttttatactaagtctttgatatctgatgtgtattgtacacttatagaacatactcatttggaccaaccacatatgaaagactcagtagccctgtgtgcctagtggctgttgtatgagacaatgcaaacagaaatggataagcaagaagctattggggatgcattattggaaggaaggaaatgcagatttaccttgcaattatagttgggttaatattaaaacatttgatcttactgcatgtcagctagcctatgggtaactgaattagaactctgttaaaggaagagaagtccatctagaattataaagttaccatagttaatccacataggaataaagaacaaatgtgaatcatatgcctactctgtcacaaccacttttggaaacaaatatcaggtccttatttctcatagagttaagcagatgctatgagttttcaagagatagttagtaatgtctttctttgcttgtgtttagatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtaaaacattactaatatcccttaaaaaattaaactaggagttttaatgaagtattttaaattttctatcttcagaatcttaaagttatgctttgaaaaacacaatttttctttcctcagcttcataccaagttaggtaaatgttctaatgtactaaaattctaaaggaaatgtatacttttaattatgaattcagtttctgtgatgtcttataagcatttcagctataatattttaaaattgcagcaaagcttcttttgaataaacccctatttattatccaaatttattcgtttctccgccactttaatttcacaatgtaatattttgtctccttatcccttccccactccttttaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacagtatccttttttggctgggtatacagattcatagagcttgaaaggagtcgagtccaaccttatatctgttatgtggcatgttaccttgtgctttagttttggtctctgcatttttacaaaagtatgtgtggtatatgtgagaatgtatttttaaatttacgtcttctagaaatgttttgaattcgcatatacttggtactggggtttgaagcatattgtttggtaaaattacttaaaatataggtgcttgttttattaacaagctaggtatttttacaagggagattgtaattgggcttaatgtaaaggccaatgagagtacctaaaattgggtgttgagtggtactgggctgttttaatatatatattttagatattaaaaatcaacggatgtgttaatttgtatcaatgtaattgttcatgattttgatctattggtagtatcaaaacattttattattagctatattgttccatattaataagttcacattcagtgctgataaatacatttattccactctaactatgtgttaacactgtgctgagtattttctgctcattacttaattcaggcagcagcatatctccctattatagaccagaatacaggaatatcgagcacttaagtaacttagctgactttacacaggtaataataaagagttgaggttcataaccaggctgttgactccaaaggccataattttactctcagctaccaacatagcctgcgtcttagctagttcactcagttacaccaacccatatctgcatagatgcagtcttttttaggagggaaatactcagtaatttcttttattctaaccaaagtctttgcatcttttaatctggagtctatattttacatacactgtgagtgaagagatctctcaatattagaattgtaaatgtttgctgatctttgcatttttatttccataatccaaatgagtcataatccatatgggttttggttttaaaatggattagtaaatggttaaattaatagacccaatttcaaaataaggttttttttgaattctactctcttgatgttgcacctgaatacacaagtaaatatggcctgctatggcaggctaaaagtgaccaagtttttgaaactaaatccacattggagcagttttggacagacagacccacttcaagtgctggtagaaataacattatcctgaggggatagtcaaactagagagtagctctgttaaaattagcatccagaaaatctctagagagtaagggcaaatttagcaacctgtagcctaaggcacaatgaagggaagtctgtgaagcactgaggaatttttagttgatagatgatttccatacaggaattctgcagcagggtcccaggtttgaaagaactatctaaaggaatgcatgatatatggcagattgagaagacttgataagacaggaatttggacctgcaaaacatcaagggttaattatcaaaattgggcataaggtgggaactaaagactagaatgatggcagaagcctgtttctttaggtttgggagactagagagagacaagcatgggtaatttgatactgtatcccacagaatgttgggttagctagaggtcttaaaatcattcctgccttagtttagggttaatttaagaagttagcagaactgaacctgccattgggagttagggacccatagggacccatctgtggggatggagagttgaagaaactagagaaacagatggggcctaaccctagattcaaaagatgcttttgaaaaagttgtaaactttttgcatggagacttggttctgtcttctttgctgccttacctcttgcaaaattctacaactggtccatgtagataattcatctagtacactggtgccctgtttcctaaatctccttaacagcccacccttcactgccactgttagctatcagctgtgtcacagagtgagttttgccattgctccaaatcagcaagttaaaacttttttattaccatgctttttgatcttttgctcagagccttttcatagtctcataactacactcttgatacatgtgttctttgagctcatggagacttctagttcctgatttttccattttctcctggtctgtcagtctccttgtgtgggcttcattgttcacttgaagtatttttttcacattgcattcctttgaggccttttgccccttccatgtaatgagagcaaaagcacccgagaaactacataacctttacatttatttgttttggtaaaatattttggcttttactactaacatttagtttgctaaatcagtctttcaagataatactttgtgtgtgtgtgtgtgatttagaacgtaggagtgaggtacctgtatatcctagaattacacaaatgaattaccaacaattaaatggcaacttttaaaattgtattttaaacatcaagtaaccagagatggaaaaatcttcctataccctcttcagattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaaagaaagaattcaggtgatatgggaaaactgcttggcagaaccttcatcttctgctccaactgtaaaccacatgtaaatgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctagttaaattatggggattttggagtatgtacatgataaattataatacgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaattggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcatatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagggtcagtgagtccaggttttaacttcttcatgcctggatgggataaaatgtaattcattgttaaattaattcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtacacaagaaaaacctgactagtgaggaggagcagctgagagatagggtcagtgaatgcggttcagcctgctacctctcctgtcttcatagaaccattgccttagaattattgtatgacacgttttttgttggttaagctgtaaggttttgttctttgtgaacatgggtattttgaggggagggtggagggagtagggaagtggtccttttacaagaattttgatgcataagtgtctattgtagggtttggatgatctagtaaagtgttttagaacccctttttatcccatgcaccattcagtaaacataaaaatcacaattctgctaatgtcatttggaacttcaaaataaatatcttgtctaaaaacaaatcagac

SEQ ID NO: 8708 - DNA, 12423 bp, Homo sapiens; identical to SEQ ID NO: 8706

SEQ ID NO: 8709 - DNA, 12421 bp, Homo sapiens; identical to SEQ ID NO: 8707

SEQ ID NO: 8710 - DNA, 3661 bp, Homo sapiens
ggggggtgcgcgcgcccgggtccggcctctcactcgctcccctctcgtccgcagccgcagggccgtaggcagccatggcgcccagccggaatggcatggtcttgaagccccacttccacaaggactggcagcggcgcgtggccacgtggttcaaccagccggcccgtaagatccgcaggtgagccctgcgctcggggctgccctggggctcgtgcccgcggctgcgccttggcttgcgggtggccgatgccagggcggggggcgctgtctgcaaccgtcgcggagcgctggcctggcggccttaggcaagggtgaccgccgctgcgcttctctccaccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtgagtactggcagcgctgcggtgtcaggaaggccccgaagtcccctctgttggcctcagtcgcgtgatgacattctccggaatcgctgtacggccttgatgaaagcacatttgaacccttttccatctgattgctgaggcttttcatccaggcctcggggctggagaaagcccgggcctgtctccatctctctctggttctggggcaggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgtgagtacacggctctctggccgtcctggtgcgcggggacagtgaggcttggctcctttatcagtgacaccggtccctgggtcttgctggggtgagaagaaccaaaacattgtgggtgatgagctaagcgggactgctaaggttcacctgtgcgtttccgcagagataaccttaatggacatggcaaggctgtgtgacttggaggcagctttttccattgacgttgctctccctaaaatgcttcgtattccaaaatatttctagaaagaccttgtaggataaggttgataaagagtccattgtatacgtttccgggtagttaaattagggaacagttttctctgccccgcccgtggttcacaggtagataactgtctcgtgcgtgttgcgtcaactcagtaagatatagtcacctaactaataaggactgttcttaacattggggccacaaagtgtgttgtagaaaaggctcagacactggtcctgaacacggaatccccaggggaaagtttggggccaggtgagggtggagtccttgcagcagtgcggccaaccccacttaactcttctcattcaccaacaggctgaagaactgaaactggccacccagctgaccggaccggtcatgcccgtccggaacgtaagtgaacacttactcaaatccaggcttcagacgagatcagtgggtgaacacgtgggtatctgagatgcgggtgatgggggtcaggcttaagaacgttaatagtggcagttgtgggtgtggaggtttgcggaaaggaacatttcttcttagtttttacttcttgcaaccatgaagccatacattgggaagtatttttgtttgttttgtgtttttttgttgttgttggaaagagagtttctctatgctgcttacattggttttgaattgctgggtttacaggcttgagccgccatgtccagctcagggagggtttttctttttttttttaaatcccagggaaggtgattgactcagggttgcttttcagcagtacttatggcagcgaacctgacccccaatccccgggaggtcctccaggttctcctgacgcttggttgttcccttgccctttggtgcatgtgggtttaacaacctgtctttctcttctaggtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaagagacagggtcttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccagagagagtgccaggggtgccctggtctgagctggcatccccatgtcttctgtgtccgagggcagcatggtttctcgtgcagtgctcagacacagcctgccctagtcctaccagctcacagcagcacctgctctccttggcagctatggccatgacaaccccagagaagcagcttcagggaccgagtcagattctgttttgtctacatgcctctgccgggtgccggtattgaggcacccagggagctgttactggcgtggaaataggtgatgctgctacctctgctgctgcactcacagccacacttgatacacgatgacaccttgcttgtttggaaacatctaaacatctagtagatgacttgcaggctgttggctaccagtttcctgtctgaggtgtatatgttaacttcgtgatcagtttgtatgtttgggactcttgtcctatgtaaagttaaggtgggccgggtgcagtggctcacgcctgtaatcctaacactgggaggccgaggcgggtggatcacctgatggtgaaacctcatctctactgaaaatacaaaaattagctgagtggtgacaca

SEQ ID NO: 8711 - DNA, 1191 bp, Homo sapiens
cattttgaggttggttggaagttcaagaccaagcttggccaacatgtcagaactactaaaaaataaagaaatcagccatgcttggtgctgccccacttgtagttccagctcctgggaggcagaggtgagggatcccttaacccaggaggcagaggctgcactgagccaggatcacgccactgcattttagctggggcaacagtgagactgtctcaaaaaaaaaaaaagagacagggttctttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccagagagagtgccagggtgccctggtctgagctgggcatccccatgtcttctgtgtccgagggcagcatggtttctcgtgcagtgctcagacacagcctgccctagtcctaccagctcacagcagcacctgctctccttggcagctatggccatgacaaccccagagaagcagcttcagggaccgagtcagattctgttttgtctacatgcctctgccgggtgccggtattgaggcaccccagggagctgttactggcgtggaaataggtgatgctgctacctctgctgctgcactcacagccacacttgatacacgatgacaccttgcttgtttggaaacatctaaacatttagtagatgacttgcaggctgttggctaccagtttcctgtttgaggtgtatatgttaacttcgtgatcagtttgtatgtttgggactcttgtcctatgtaaagttaaggtgggccgggtgcagtggctcacgcctgtaatcctaacactgggaggccgaggcgggtggatcacctgatggtgaaacctcatctctactgaaaatacaaaaattagctgagtggtgacaca

SEQ ID NO: 8712 - DNA, 3902 bp, Homo sapiens
  misc_feature (3274)..(3274): n equals a,t,g, or c
attgcggggccgcttcctttccgctcggctgttttcctgcgcaggaggtgagggagactgggtcctggcctttgggcatcatccagcgccatcggcctggcgcttcagccaacgcgggagtggatgggccccttcttcttcgcagacagcgttcggccgctgcccgggctctaggcgcggccggacggcccagtctggagggttcggggcggaggcccgggggggtgcgcgcgcccggggtccggcctctcactcgctcccctctcgtccgcagccgcagggccgtaggcagccatggcgcccagccggaatggcatggtcttgaagccccacttccacaaggactggcagcggcgcgtggccacgtggttcaaccagccggcccgtaagatccgcaggtgagccctgcgctcggggctgcccctggggctcgtgcccgcggctgcgccttggcttgcgggtggccgatgccagggcggggggcgctgtctgcaaccgtcgcggagcgctggcctggcggccttaggcaagggtgaccgccgctgcgcttctctccaccagacgtaagggcccggcaagccaaggcgcgccgcatcgctccgcgccccgcgtcgggtcccatccggcccatcgtgcgctgccccacggttcggtaccacacgaaggtgcgcgccggccgcggcttcagcctggaggagctccagggtgagtactggcagcgctgcggtgtcaggaaggccccgaagtcccctctgttggcctcagtcgcgtgatgacattctccggaatcgctgtacggccttgatgaaagcacatttgaacccttttccatctgattgctgaggcttttcatccaggcctcggggctggagaaagcccgggcctgtctccatctctctctggttctggggcaggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgtgagtacacggctctctggccgtcctggtgcgcggggacagtgaggcttggctcctttatcagtgacaccggtccctgggtcttgctggggtgagaagaaccaaaacattgtgggtgatgagctaagcgggactgctaaggttcacctgtgcgtttccgcagagataaccttaatggacatggcaaggctgtgtgacttggaggcagctttttccattgacgttgctctccctaaaatgcttcgtattccaaaatatttctagaaagaccttgtaggataaggttgataaagagtccattgtatacgtttccgggtagttaaattagggaacagttttctctgccccgcccgtggttcacaggtagataactgtctcgtgcgtgttgcgtcaactcagtaagatatagtcacctaactaataaggactgttcttaacattggggccacaaagtgtgttgtagaaaaggctcagacactggtcctgaacacggaatccccaggggaaagtttggggccaggtgagggtggagtccttgcagcagtgcggccaaccccacttaactcttctcattcaccaacaggctgaagaactgaaactggccacccagctgaccggaccggtcatgcccgtccggaacgtaagtgaacacttactcaaatccaggcttcagacgagatcagtgggtgaacacgtgggtatctgagatgcgggtgatgggggtcaggcttaagaacgttaatagtggcagttgtgggtgtggaggtttgcggaaaggaacatttcttcttagtttttacttcttgcaaccatgaagccatacattgggaagtatttttgtttgttttgtgtttttttgttgttgttggaaagagagtttctctatgctgcttacattggttttgaattgctgggtttacaggcttgagccgccatgtccagctcagggagggtttttctttttttttttaaatcccagggaaggtgattgactcagggttgcttttcagcagtacttatggcagcgaacctgacccccaatccccgggaggtcctccgggttctcctgacgcttggttgttcccttgccctttggtgcatgtgggtttaacaacctgtctttctcttctaggtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaagagacagggtcttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccnattggttttcccttttgggcgtttcccatggggacaaaggagcgcaagccaagagagagtgcaggtgccctggtctgagctggcatccccatgtcttctgtgtccgagggcagcatggtttctcgtgcagtgctcagacacagcctgccctagtcctaccagctcacagcagcacctgctctccttggcagctatggccatgacaaccccagagaagcagcttcagggaccgagtcagattctgttttgtctacatgcctctgccgggtgccggtattgaggcacccagggagctgttactggcgtggaaataggtgatgctgctacctctgctgctgcactcacagccacacttgatacacgatgacaccttgcttgtttggaaacatcttaacatcttgtagatgacttgcaggctgttggctaccagtttcctgtctgaggtgtatatgttaacttcgtgatcagtttgtatgtttgggactcttgtcctatgtaaagttaaggtgggccgggtgcagtggctcacgcctgtaatcctaacactgggaggccgaggcgggtggatcacctgatggtgaaacctcatctctactgaaaatacaaaaattagctgagtggtgacaca

SEQ ID NO: 8713 - DNA, 690 bp, Homo sapiens
ccccgctggtggggacaagtgcctgagtgtgggccgtgcccgagtgtggccatccctgagtggggccgtcctgactaggaagtggcttttcagttgtgatgtgtgggcctgacctagggggcgctgtggaacccgggctggaaccagccctctgtgccaggccgcagacaggttccgccggccctgaggggcagctgccatggcgtgggtcactgggagctgagaggaagggcccccaccgcacctcaggcaaagcggctctgggaacaccttgatttcgtccatgtgagccgtcccagggagggcagccaagctgtgaagcctgagaaactgacctgtgtgccacgagcttgtggtctgctgcccggtggaggaagtgcaggtgcgcccaggctcctcattccgttttgcaggattccttcggggtgtgagcatttcctattcagcctgtcgcccccggggagcacgggctggctctgtggtgcccgtggccttttgtagaagcgttggttttacggcaggttcatctctggggcagcctcccacagtgggtggggctttgccagcagtgcccacgggggtcatggggccaggcgcgctccggcgcctgcagaactgatcggggatagtctcaggaggcgctagtcacgtgccccggtgatcggggatagtctcagaaggcgctagtct

SEQ ID NO: 8714 - DNA, 690 bp, Homo sapiens; identical to SEQ ID NO: 8713

SEQ ID NO: 8715 - DNA, 292 bp, Homo sapiens
ggtggctcacgcctgtaatcccagcactttgggaggcccaggcgggcggatcgcgaggtcaggagatcgagaccatcctggctaacacagtgaaaccccgtctgtactaaaaatacaaaaaatcagctgggcgtgatggtgggcgcctgtagtcccagctacttgggaggcagaggcaggagaatggcgtgaacccgggaggcagaacttgcagtgaacagagatcgcaccactgaactccagcctgggcaacagagggagactccgtctcaaaaaaaaaaaataataataa

SEQ ID NO: 8716 - DNA, 690 bp, Homo sapiens; identical to SEQ ID NO: 8713

SEQ ID NO: 8717 - DNA, 1069 bp, Homo sapiens
tcagctttaaaacgcagggattccatgtgtcacctctcccaggaatatttgtatctgtggaatgaaagaccttttgctgctgtctcagagaagtatttatgcaggtcaggggtcctttcccaatgcgttggactcatccatctggaggagctcttctaccgaagggcactaccttctcaccaggctgtggcagcagaggggttaaacagcatgccctgccctgctccaggcagaagggttgtaggacttaatcacgtttcagcttggctgtcgggctgtgagtcacggttgcactgcgattatgtaagcacgcaggaataggtggcatgacatatatgctgccagcagccacgggcctcgcccttccgagtcaccactactttttaagcctttttttggatacaagtttctttgggttcatctttggaatggaaatggaagcatgattgcagaataggcagaacaggaattatccatcaatcagagagaacccagccctttaagagaagctggaattagaatatggaattcctgagccttgagctggcatagccgagccctggtttatgctcttcctgcctccctccttttttccctcctgcctgtgtgctccacttcctctcctgagactcccccaaggtagcatcactcccaccaggagcctcaggcaggaaaaataaggcccagagaagggactgtccctggggacgtgcactgagtgtgtgtgagggtgcggggcaggaataggagtgccaggagtctacctctggagcaatgcctcccacagtatttctgtaggggaaaggatagaaactcacttcttgggttcctccaatcaccatgcacatgtcagtccttcagctataaatgcaaaggaaagccagaactgagatttgagctttctcaccatctccatggtcagatatctccactgccaaagggttcattccgcctctgggtttatctctttcttcatgcttcttcctggcagtgtcctgttgaagcttaccttcccatctgtgtttgcatccactccctaaaaaccacaagacaaaacaagaaaataaaa

SEQ ID NO: 8718 - DNA, 837 bp, Homo sapiens
gaagggttgtaggacttaatcacgtttcagcttggctgtcgggctgtgagtcacggttgcactgcgattatgtaagcacgcaggaataggtggcatgacatatatgctgccagcagccacgggcctcgcccttccgagtcaccactactttttaagcctttttttggatacaagtttctttgggttcatctttggaatggaaatggaagcatgattgcagaataggcagaacaggaattatccatcaatcagagagaacccagacctttaagagaagctggaattagaatatggaattcctgagccttgagctggcatagccgagccctggtttatgctcttcctgcctccctccttttttccctcctgcctgtgtgctccacttcctctcctgagactcccccaaggtagcatcactcccaccaggagccttaggcaggaaaagtaaggcccagagaagggactgtccctggggacgtgcactgagtgtgtgtgagggtgcggggcaggaataggagtgccaggagtctacctctggagcaatgcctcccacagtatttctgtaggggaaaggatagaaactcacttcttgggttcctccaatcaccatgcacatgtcagtccttcagctatcaatgcaaaggaaacccagaactgagatttgagctttctcaccatctccatggtcagatatctccactgccaaagggttcattccgcctctgggtttatctctttcttcatgcttcttcctggcagtgtcctgttgaagcttaccttcccatctgtgtttgcatccactccctaaaaactacaagacaaaacaagaaaataaaa

SEQ ID NO: 8719 - DNA, 1067 bp, Homo sapiens
tcagctttaaaacgcagggattccatgtgtcacctctcccaggaatatttgtatctgtggaatgaaagaccttttgctgctgtctcagagaagtatttatgcaggtcaggggtcctttcccaatgcgttggactcatccatctggaggagctcttctaccgaagggcactaccttctcaccaggctgtggcagcagaggggttaaacagcatgccctgccctgctccaggcagaagggttgtaggacttaatcacgtttcagcttggctgtcgggctgtgagtcacggttgcactgcgattatgtaagcacgcaggaataggtggcatgacatatatgtgccagcagccgacgcctcgcccttccgagtcaccactactttttaagcctttttttggatacaagtttctttgggttcatctttggaatggaaatggaagcatgattgcagaataggcagaacaggaattatccatcaatcagagagaacccagccctttaagagaagctggaattagaatatggaattcctgagccttgagctggcatagccgagccctggtttatgctcttcctgcctccctccttttttccctcctgcctgtgtgctccacttcctctcctgagactcccccaaggtagcatcactcccaccaggagcctcaggcaggaaaaataaggcccagagaagggactgtccctggggacgtgcactgagtgtgtgtgagggtgcggggcaggaataggagtgccaggagtctacctctggagcaatgcctcccacagtatttctgtaggggaaaggatagaaactcacttcttgggttcctccaatcaccatgcacatgtcagtccttcagctataaatgcaaaggaaagccagaactgagatttgagctttctcaccatctccatggtcagatatctccactgccaaagggttcattccgcctctgggtttatctctttcttcatgcttcttcctggcagtgtcctgttgaagcttaccttcccatctgtgtttgcatccactccctaaaaaccacaagacaaaacaagaaaataaaa

SEQ ID NO: 8720 - DNA, 1747 bp, Homo sapiens
agccaccgcgcccggccttagttgtgtgtgatttctatgtgtgctctaggcacttgccctatagctgctcctaaatgtggggtcttagaaaacatcttgtcccttcgaagcatactctgctggttggctaaattgcactgggaaaaaatagcagcagccctattgctatgtcacttgcctgcagagcaaaagttgattcaggaacagtaatttgactttgtctatattaaaaatcataaatagtcaacaaatgcaaaaaatgcaaagaatttgtaggtatgattagtgcattataggtgttttcaaatttctcctatgataaattaaaaatgtaatgttgggcattaatttcctaaacccagtgctcagcaattttctcaaattgtttacagtttttccaagagacttcagaaccattccctggagtgaattatttccaatggtgaagagtaatggatggatggcatgagattctcaaaaaaatcttgctcctatttcagaagtgtcactccagccccttgaaggtccaggaaacctggctgagtagtgtggtctatggaggtgcatgggcttcagaatcaggccaacgttgatcctgagtcccagccagctgcttagtagctgtgggatagttacacaagacacatctacaagaaaagtcatgataaaattgattgcaaaaacagcaatttgaaaaatttcttattgtattcatgtccttggaaatggcttttatagtcgttcctatcaagagacagattctgtttcccaaaccttgaacttctcttgacttatctgcactggcacagggtgccagtttggggcccaggtttaaaggtcctaaatgcttctgttatctttttcagaattcttccatctctatgacaacaagcccattttagctttctggagaatagcatctgagaaaagccaaagtgcctcagtttacagacagctcactcacagaagcagagccacctaattcaccagcatctaaccactcacacctgaaggagccaaactgagcccagaagaatggcccggctgagcccagcctaaatttctaaccagctcaatcctgagctagtatgtttcgggattgttatgcagttataagttagtaatatatacacccattaaagacaggatctcaggacagattgatcacaaataacctgcaaatgcttgccaccctgtaagtattgattttcttttttcctttatttaaagttagatttgttgtaagatgatattgagttacacagaagttaggcaggagaatagggtttggaggcagggaacttaaggccaattcgtgctgacttcctacaagaaaaaacaccaaggtctgggagcagggaacctaaagccagttaacgtgaacttcctacatctaaaccaaaaggaaagacctcatctacacccgagtagcaaaggatcgaaggcgactgtcgctacaaccctcccccttgtaccagttctctgatagaaaaggacagtgccttggagtggccgtgggccaagcacaggccatgccttcatctgcatagggtaccaattcgcctcaacctttgattagccaaggaccaaatccttcattcagataaggggtagctgataggaacctcaaaaggagtacttaaaacccagaaaacattgtaaccgggtccttgggcggcttgctggggctcacacccaccctgtagagtgctttctcactttaataaaatcttgcttttgctattcc

SEQ ID NO: 8721 - DNA, 261 bp, Homo sapiens
tttttttttgagacggagtctcactctcgcccaggctggagtgcagtggctcgatctcggctcactgcaagctccacctcccaggttcacgccattctcctgcctcagcctcccaagtagctgggactacaggcacctgctaccatgcccggctaatttttttgtatttttagtagagacggggtttcaccatgttagccaacaaggtcttgatttcctgacctcgtgatccgcctgcctcagcctaccaaagtgctggga

SEQ ID NO: 8722 - DNA, 3583 bp, Homo sapiens
  misc_feature (3513)..(3513): n equals a,t,g, or c
  misc_feature (3515)..(3515): n equals a,t,g, or c
tccctcctgactttatttttgtctattgtggccttgactgccgggactaaaactttacagcacaacttggcaggacgtggatttcatcacgatgcctttttcagcccttccaattcctgccttcttttcagaagtgagtgtcccagaaaagacaattgtacagcaaaggaatggacttttcctgaagctaaatggaacaccacagccagagttttcagtcacatccgtcttggcatgggccatgttcttattatagtccagtgttttatttcttcaatggctaatatctataatgaaaagatactgaaggaagggaaccagctcactgaaagcatcttcatacagaacagcaaactctatttctttggcattctgtttaatgggctgactctgggccttcagaggagtaaccgtgatcagattaagaactgtggatttttttatggccacagtgcattttcagtagcccttatttttgtaactgcattccagggcctttcagtggctttcattctgaagttcctggataacatgttccatgtcttgatggcccaggttaccactgtcattatcacaacagtgtctgtcctggtctttgacttcaggccctccctggaatttttcttggaagccccatcagtccttctctctatatttatttataatgccagcaagcctcaagttccggaatacgcacctaggcaagaaaggatccgagatctaagtggcaatctttgggagcgttccagtggggtaagtttgtgagggtgttcctttttgcttgttcttcccaaatttaaagcatagttaattcaaggaaaaaaataaaatcagtactgatttgtcaaagaatgtattggatctctgacttttaaaaccgaatcaacaaacattccttttactcctgatgtttgcaagggctcataatcaatgctgtcaggtgtagagaaaaagtataagtcaatctcaaggaccttatgtgttacttcatagaatactatagaattatacacctggaagatacctcacaggttgtcttgtcctgtctgcatagttttacaagaaacaggcaaaatggtttacagataataaatgaaagaactggtacacctatgtctgactccaagtccctttctctttcttttccaccatagttagggaaaataagctcatttgtgagagaagttggcctttcgtattagtaagtcctgttgaatagaaagcctggctcctcagtcctccctgtggttattcataagccagtatgccagaagggcagggtttgtttatttcactagaaaggtagttttcaagaggatccttgcaaggcgagtaggaggaaaatattttctagaaaaatgcttatgcaattattccgaatatctcccagttgcttgcaattgttttggaaggctctgtcaatcattttattggcaagttaatgatctctttgaagattcaattaaggagttaaatatacgtttaaataagtgaaatagacatctagctttagatttacaattttcttgagcacacaaaatatgaaatattttatacagtgaacatttcactctttgggaaaaataatctattgcttaataacattcatagcagagcttccctgggtgtaatgcctctgtcatgattcaacagattctaaagatgaaaaaattaggatcttgagtttcggataccctgctcttagccagagtgtatatccagaagtcttgtattcttttccaacagccgataatgccatttgctctaatttttaagcaaaagaaaatctatataggtaacaaggcctatgaagacctatttctgtaacctttaatcatttttctgcaagaccagcaggtggtgctcctcactttgctcatgttagctttgaaattttgagtactgagtacacttcacttttttatcctctcatacttctatagttaactttccaagaacataagtatttatttaatttgaccagattatatctatagcttaatgaggtaagacagtgatttgttagtaaggttttccctttaaaaatgctacatttccagttttgttctaattactgctttcatgtttccttttaggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttacacatttctgctctcctttctcctaagtttcatgcagatgaatataagggaatatactattatataattcattngngatatccacaataatatgactggcaagaattggtggtaattttgtaattaaaataattattaaaccta

SEQ ID NO: 8723 - DNA, 3583 bp, Homo sapiens
tccctcctgactttatttttgtctattgtggccttgactgccgggactaaaactttacagcacaacttggcaggacgtggatttcatcacgatgcctttttcagcccttccaattcctgccttcttttcagaagtgagtgtcccagaaaagacaattgtacagcaaaggaatggacttttcctgaagctaaatggaacaccacagccagagttttcagtcacatccgtcttggcatgggccatgttcttattatagtccagtgttttatttcttcaatggctaatatctataatgaaaagatactgaaggaagggaaccagctcactgaaagcatcttcatacagaacagcaaactctatttctttggcattctgtttaatgggctgactctgggccttcagaggagtaaccgtgatcagattaagaactgtggatttttttatggccacagtgcattttcagtagcccttatttttgtaactgcattccagggcctttcagtggctttcattctgaagttcctggataacatgttccatgtcttgatggcccaggttaccactgtcattatcacaacagtgtctgtcctggtctttgacttcaggccctccctggaatttttcttggaagccccatcagtccttctctctatatttatttataatgccagcaagcctcaagttccggaatacgcacctaggcaagaaaggatccgagatctaagtggcaatctttgggagcgttccagtggggtaagtttgtgagggtgttcctttttgcttgttcttcccaaatttaaagcatagttaattcaaggaaaaaaataaaatcagtactgatttgtcaaagaatgtattggatctctgacttttaaaaccgaatcaacaaacattccttttactcctgatgtttgcaagggctcataatcaatgctgtcaggtgtagagaaaaagtataagtcaatctcaaggaccttatgtgttacttcatagaatactatagaattatacacctggaagatacctcacaggttgtcttgtcctgtctgcatagttttacaagaaacaggcaaaatggtttacagataataaatgaaagaactggtacacctatgtctgactccaagtccctttctctttcttttccaccatagttagggaaaataagctcatttgtgagagaagttggcctttcgtattagtaagtcctgttgaatagaaagcctggctcctcagtcctccctgtggttattcataagccagtatgccagaagggcagggtttgtttatttcactagaaaggtagttttcaagaggatccttgcaaggcgagtaggaggaaaatattttctagaaaaatgcttatgcaattattccgaatatctcccagttgcttgcaattgttttggaaggctctgtcaatcattttattggcaagttaatgatctctttgaagattcaattaaggagttaaatatacgtttaaataagtgaaatagacatctagctttagatttacaattttcttgagcacacaaaatatgaaatattttatacagtgaacatttcactctttgggaaaaataatctattgcttaataacattcatagcagagcttccctgggtgtaatgcctctgtcatgattcaacagattctaaagatgaaaaaattaggatcttgagtttcggataccctgctcttagccagagtgtatatccagaagtcttgtattcttttccaacagccgataatgccatttgctctaatttttaagcaaaagaaaatctatataggtaacaaggcctatgaagacctatttctgtaacctttaatcatttttctgcaagaccagcaggtggtgctcctcactttgctcatgttagctttgaaattttgagtactgagtacacttcacttttttatcctctcatacttctatagttaactttccaagaacataagtatttatttaatttgaccagattatatctatagcttaatgaggtaagaccagtgatttgttagtaaggttttccctttaaaaatgctacatttccagttttgttctaattactgctttcatgtttccttttaggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttacacatttctgctctcctttctcctaagtttcatgcagatgaatataaggtaatatactattatataattcatttgtgatatccacaataatatgactggcaagaattggtggaaatttgtaattaaaataattattaaaccta

SEQ ID NO: 8724 - DNA, 590 bp, Homo sapiens
gggtacatgtggacacaggattccaaagtgagaagggtggtgtattagtccattctcatgctgctacaaagaaatacccgagactgggtaatctataaagaaaaggggtttaaatgactcgcagttctgcatggctggggaggaggcctcaggaaactcacaagcatggctgaaggcgaaacagaagcaagcaccttcttcacaaggcagcaggagagagagtgccaacaggggaaatggcagatgcttataaaaccatcagatctcatgagaacttactatcatgagaacagcatgggggaaactgcccccatgattcaattacccccacctggttccttcctcaacacctggggattatggggattacaattcaagatgagatttgggcggggacagaaagcctaatcatatcagatgggaaggacatgagggttgacaaaatatgtattgggtacaatgttcactgtttgagtgatgggtccactagaagcccaaacttcaccattatgcaatgtaccatatatacgcaatgtaacaaacctgtacatgtaccccttcaatctgaaataaaagttgttttttttttt

SEQ ID NO: 8725 - DNA, 4574 bp, Homo sapiens
ccaggaatcaggggcagccgggcgagtcccagggcaggggtcctccgccgccttgcacctgccctgctgggcggcaccgggtcagtgccctgccccctcctgcgggtcccaactctctctttcccatcgtgcgtcctctggagaagtgcgcgcgtgtaagtgtggcgagtgtggccaagggtgccggaggcagggttcgggtgcgtagtcgttgcgtgggcgctgcccaaaaggcgcagagcatcaagtgtgcgtgggcagaaccggcgcgggcgcccgccgcgggtctgcgcggggcgggggcgcagcaagtgcatccgagcgagcggagactagcgcaccggcgtcggtggcgagggtggtgcagaggagtccggctgggcggagggaggaaggatgggtgcgggtaactttttgaccgccttggaagtaccagtagccgcgctcgcaggggctgcctccgaccgccgggcgagctgcgagcgagtgagcccgccaccgcccctcccccacttccgcctcccgcctcttcctcgttcccggctcccagggcccgtcggtcccccgggagccctggaggcgcagccccaccccggccggcgcggctcgctcccacgcccccgccgcggcctcgctggagcggacggactgagtcagagggggcgccagcgctgcaggtaggggctccggcggcggtgggcgcaggtgccgcggtggaccgcggaggggaccggagcacgaggggaacggccttgggggagcgccctccccccgtcctccgccgacgcctcgtgtccctttttagggaattttttccctcttgctggctccagtgcgggtggggctgagaccgagagggagttctccatttcgctggctcctgcccggcccctggcagcctcctgcccccaaatctcttcaccccctttccagtacctataggtcgcgtaaacaactccctttctccagctctgggctccgcggccccccgggggacagctccttcagtctcgtgagatcggtggggttagggggaggggaaaagagagggggtgtcccagagcccctggcccccgtcagctcccccaccttggcctctccctccccctcctcgctgctggagcacaggctccaggggccctgggtatttttagcgttgtgacctgggcggcagctctaagagcctttcccgggaatcggcgtcagcgcctcgctcctccgccgccagcccgcggccgcacggtctccccagacttccgtggccctgccttggccagtcggggttgggtccctctccacctctgtggcgcccgtggagctggccagggtctgggatacgctgggtgcagatgaggtggggaaggcagtctgcggaggatgacgtctgatcctcaagctagaaactcccttgcctctggtgatgggctcagagcagaacgccgggaaggagatgagcgaatgggaatgaatgcaccgacctgggctggcccatagcctcagtgctctggcagggtctcagcttctcagccctaggggtcaggaggcctgctctgaactggacccagaacccgcctttccaattgctcctcactgactaatggggagataagtcagtgagatgtgtcccaggagggggacgcataaagagctgttggagttcaaaggaaagatggtagtctcctaaatagctcaccttcacaagcagggtcttgtatttgaggcaggtaggttggttatgccattttcagatggggagactaagaccagaaaggtgatttccttaggggcagagcctagtctggaagtcaggcctgtgacttcagagcaagggtttggggtagatggcacatgcgtgtgtacgtgtttgtgtgggtggagagaaaaggaggggcgcgggaggagttgctttagcctttgtctgggttttgaaggatgggaaggggtgggctgcagcactggaggaagggaaccctccaccctgagatctctgtctctatcctatcctgtccctggccttctgaggcaagcggggccaattaaggggaaaacgtacctcctccatttgtgctgaaccaatccctccaacccctctcaggagggcatgatatggagagttgggcattggctgtgttccctgaatacagagtatctctcttgtggtgcctggaactggcatcccctttgtggagcttagggcaagccccgcctctgcatgagacttggtttgtgggacacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagacgtaagtcccaagtcctgagaagagggactggggtagggtagggaggatgtcctgtgggtcctgaatcttgtggcactctctcccctctggttttcttggccctctatgcttctaacttgggacctgacatgtaactctcactgtcctggtgtgcagcttgggtcctcctgacttgcccacttcttgatccgcagcccccataggtagtatctcatccatggaagtgaatgtggacacactggagcaagtagaacttattgaccttggggacccggatgcagcagatgtgttcttgccttgcgaagatcctccaccaaccccccagtcgtctggtatgcccctctgctttggggacttcagtgccagtcagccagagccggatgtcaggctctgaaacgaggctacaaggctgggctggggaagtacacaagtaagggctggaagtgggtgtttctaccaatgaaacagctgcctgttctgattttagggaagttgaccctgagggagaactgggttacacatctctaatccaaaattctgggaacggtcaatctcttctttaattttacatttgttatattaatataattagtcactataattaaaataatgtaaaattgtaatttttatatttggcaacttaagtagttttagtcattataatgatattaatatgtattgagtactttagtaggttccaatactgtactaaagtactttacatatattatctcaatccttacaacgtcctgtcagggtaggtgatataatctctattttataagcaggaaattaggctcagagaagttaagtcacattgtagccagaaggtagataaactggaattcatgtctgtctgactccaaagcccatatgcttaacttgtaagatagatattcttttaattaaaactgctactatttattgatggcttactatgccagacattttataagcattcttaggttttattcccaaaaccctttggggatgtaggtatcccttttattttgcagaggaggaacagagtccttgaaagggaaagtgacttgctcaaagccactcagcagcaataagtgatgtaggtggaacttgaactcttgccattcattgacctgactgtagatcccagacatggtgtaatgacgtggaaggagctggcagtcaggagatggtgatcttaatcctggctctttgctggattggcaaagtcactttggacaagtctctgccccactgtggactttagttactcctggccagataatctttaagagttctctgaagccctgtttgtggcctgaccagcttttctctctgggcagggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaaccattcgacttcatttttcata

SEQ ID NO: 8726 - DNA, 322 bp, Homo sapiens
gacaggaaatggaggtgtattttaatataggcagcgagggagagggaggtggcaaggatgactcctagttcctgacttgctcgcggatgtttgtcgaatgaatgatccagtgaccccaaggcagaagtatctcagagagatccccccactcccctccccgcacccgtcaccacgctgccttcggagctctgaccgtaagggggtggatggaaggcaggaggaagggaatggccacggagtcttggtccaggagctgctagactggacacttctagcactggtctgagccaggagacgctgcgaaaagagggcaaacgtttct

SEQ ID NO: 8727 - DNA, 4151 bp, Homo sapiens
gggcagtctggcatgatctttttggaggtaagttgtgcctcactgaaaactaatccccagcccatctttgcctgctttctagccctgtctatcctgaagcgagctcgccgggagcgcccaggccgtgtagcctttgatgggatcaccgtcttctacttcccccgctgccagggcttcaccagtgtgcccagccgtggtggctgtactctgggtatggcccttcgccacagtgcttgccgtcgcttctctttggctgagtttgcgcaggagcaagcccgtgcacggcacgagaagctccgccagcgcttgaaagaggagaagttggagatgctgcagtggaaggtagagagagtcctctccgtggcgcacctcctgaggcagctcctggagtcctaaccttgaggggtgggcgtaccaggggtgggtgctgacttgctcattatggttatggggaaacagcctgtgggcctggtgattggcttgattggagcctgttgcctgggttgtctgcaacaggaggcgcagaggagggctcgtgtctatttgctgcaggggctgggggcatgatacctgaatctgaactttttggagagggggatgtgaagttgatatgaactggagggggtgcgtatctgtctggttaggaaagggagtctgtccatgatctagggaatgccatgagtaggatatctctttttttttttttcaaatgccctgagggcagttttcttggctgtcctgttcactgtctgacacacagtgcccatcgcagattaagcacgagtagtggcggggtaagcacttggggagggtttgtctagtgacagtagggctaagcccatgtccatgtctgtgcttctcacatccctctttcctgtggatgcagctttcggcagctggggtaccccaggcagaggcagggctgccacctgtggtggatgccattgatgacgcctctgtggaggaggacttggcagtcgctgtggcaggtggccggttggaagaagtgagcttcctacagccctacccagcccggcgacgtcgagctctgctgagggcttcaggtgtgcgaaggatcgatcgggaggagaagcgggagctgcaggcactgcgccaatcccgggaggattgtggctgtcactgcgataggatctgcgaccctgagacctgcagctgcagcctggcaggcatcaagtgccaggtgtggtggctggactgggatggggatcctgagcgtggggacttctttgcactccacagaaccctcacttgtacctctacttttctctgcagatggaccacacagcattcccctgtggctgctgcagggagggctgtgagaaccccatgggccgtgtggaatttaatcaggcaagagttcagacccatttcatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttccacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagtgtggggaacctggacaacctcagctgcttccatccagctgacatctttggtactagtgaccctggtggcctggccagctggacccacagctattctggctgtagcttcacatcaggcatcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctggacaacatcgaggcacctcacttccccctgcctggcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactagggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggcctcaagagccccttttgccttgtagtcctacaccttgccctgcctgggctttggtgcagactaggtgtggatttgagctctgtgatctatgtctgctgcctggctcctagatggctctgcgggcaggtgctggccaaggacatcatctaggcagggggagagcctgggctgaacagctgtgaccaaaactcccttctgccccaccctgccccctccacttcctgccctctgttccatcttcccccttcccaaaggccacagcctttattccaggcccagggatgtaggagggggaaggaggaaacaggaagcccagagagggcaaagggcctacctcggggcgcgaaccatgccccagactattatctcagggctttctgggcactgcacttcagcgtggcccacctgcccatgccctgaggccagttggcgaggggtggctcctgagggtttttataccctttgtttgctaatgtttaattttgcatcataatttctacattgtccctgagtgtcagaactataatttattccatttctctctgtgtctgtgccaagaaacgcaggctctgggcctgccccttgcccaggaggccttgcagcctgtgtgcttgtgggaacaccttgtacctgagcttacaggtaccaataaagaggctttatttttagcaatgtggtatgtatttgtggggtgggaagcaggggcaaaggggatgggggacaagccctgcagaggggagtatggacacaggctgtgttgaggggtaggagtaggcacacccagcatattgggcctctttccaggcaagccagtcaagttggaggcaggaagccagctgagaggctggccaggcagatagagcagtttttcctttggagtaacctgttcctctacagtggtgacctggggtggtggggaggagcagcaccagggtcttctgacatggggctatctgctggggatgggtaagggcacccttcttcctacacacccacactgagctgaggccttgtcctgagggtgaattcaccaacctgggtggaggcagggtaagggcatgtgcctggtcaaggcctggtgatggccttacgtagcagctgtggtccctggggacttgagcaggggggcagcggaaagggcagggggaagctgcagaacctcatccctctgcaccagccagacctgtctgacctgtccctggcagctcagctgggcagcaggccagaggagtaggccacaccctgctctggggagccccagtctgggggcctgagaaaggttgacttcccccttaggaatgatagtgatttgtacaagagctggaaggaggaaccgcc

SEQ ID NO: 8728 - DNA, 691 bp, Homo sapiens
tactccctctgtgcctgggtgtcctcaatactacatgcaaacagtaacactactcacctcataaacttgtttatttcatatttacaaagcccttaaagagtgcctggaacatgcaagtcctgtgtatgtttgcaacttgcatcgattttcatgtttctgccattctttctctgaatgtttaatcctttttttgcctgtcctgtcacccttcaggtatctgtctcttgcctctggacatgcatggtcatgaccacatggccatatcagtgccattagaggactcatagtttggagtctggcctatggtgcggcagtatgtccctgtaaccagcttaactaggaataggcttctcaggttagagtaccctggtacattgagttgtcctgtctcttcttcactggtgcctagacacccttctgtagcgattacttcagcaagcacaatccaaaacctgggttcttcaagggttcccagggtcactctgattggcctggtggtctgggtggcagccctcagctccagtactctggcaggaagtcccaacaggcttccaccacatggactcagcccatggctggactgaggcctgcctactcccatctagggccacagggttcttagtttttgtttctctgtttttagataaatgaagacaatctaggttttacagcaaaaacatgattaatgtac

SEQ ID NO: 8729 - DNA, 4151 bp, Homo sapiens; identical to SEQ ID NO: 8727

SEQ ID NO: 8730 - DNA, 691 bp, Homo sapiens; identical to SEQ ID NO: 8728

SEQ ID NO: 8731 - DNA, 4151 bp, Homo sapiens; identical to SEQ ID NO: 8727

SEQ ID NO: 8732 - DNA, 691 bp, Homo sapiens; identical to SEQ ID NO: 8728

SEQ ID NO: 8733 - DNA, 4946 bp, Homo sapiens
ggggcggggcaggcggagccgtcctaccttcctacccccagactccaacccggaactaacctcggctcccttgggaaggccgcgttgcatggccaggagcagcagtctgggccgcgagtgcgggacaccgaggtcaggtctcggaaagggaggacctcctcgtccccaggggccccaggccaggtgcacccttggccgcaggtgcacggtctccggaaagtgcaggcgcccacgtcccagctggaccatggcgcctccgcggaacgtggtgaagattgccatcaagatgcgtgacgccatcccgcagctcatccagctggaccaggtcacccggctggtcccgcctccatctgccccactgccccacctcccggtagccccctggccctcggggcagcccgccccacccctccccccaggctcctccccatccctccctgcccaggccgcgagaatgaccactccacttgcaggcgaagcccctggccgctgtgctgaaggaggtgtgcgacgcgtgagtgctgccgggccagggcctgcggagggcgggagggcaggaggggcggcgccccctgccggcctcgctgagcctcgtgcccctcaggtggagcctgacgcactctgagcgttacgccctgcagtttgcggatgggcaccggagatacatcaccgagaatgtgagtcccctctccccagccccaagctcggccttccgacccctctaacccacctggccccgataactctggctcttcatcccactaccggagcgcgatctgttattcacccccagccgccctcaccgacaccccagttgatcagtcctcggagccctccctgacctcgctgccttttctgctgtcttctccagaaccgcgcggagatcaagaatggcagcatcctgtgcctcagcacggccccagtaatgcccctcccgtcccgccttccccatccctgcccctttgctccaggtccagaggccccccgccccggaggcccccgccccagccctgccttgcgccacctagttgacgcgccggggccgcacacttccaggtcccacccttaccatgcccagcctcttcacctctgctcctgctccgttcctgccaggaccttgaggctgagcagctcttgggtgggctgcagagtaacagtcctgaagggcgccgggaagccctgaggcgccttgttccgctggcctcggacatgatctttgccagggaggtcatcagccgtaatgggctccagatactaggcaccatcattgaagatggggacgagtgagcacagggatgtgtgggctgggggagatggtgggtctttctggtcctggggtggtcctgctcagccccagatgtcccccctccagcctaggagaggtgctggccctcagcctgagggccttctcagagctcatggagcacggcgtggtgtcctgggagactctgagcatcccctttgtgaggaaggtgggtgggctttcctagggcagcgggtgggggcagtggagcagtggggcagtggtagacccggtcttccatgggggtgaggtggtgacacccccgccccttacaggtggtgtgctacgtgaacatgaacctcatggatgcctccgtgcctcccctggcccttgggctgctggagagtgtgaccttgagcagcccagccctgggccagctggtcaagagcgaggtgcccctggataggctgctggtgcacctacaggtgtaagcctctggggctggggtccagatgcagggagcagggctggagcctgaatgttccactgagccctcttcttgccataggatgaaccagcagctgcaaaccaaggccatggccctgctgacagccttgctgcagggggccagccctgtggaacgcaaggtgagtgtcgatcggtggctagatgggggcagcacccggtgggcgctgccccaccctgaagcaaaatcctctaagccccccttttttttttttttgagatggagtcttgctctgtcgcccaggctggagtgcagtggtgcgatcttggctcactgcaagctctgcctcccgggttcacaccattctcctgcctcagcctcccgagtagctgggactacaggctcccgccaccacgcccagctgatttttttttttttttttttttttttaagtagagacggggtttcactgtgttagccaggttggcctccatctcctgacctcgtgatccgcccgccttggcctcccaaagtgctgggattacaggcgtgagccaccgcgcccagcctaagccccctttctttctaccccctcagcacatgcttgactatctttggcagaggaaccttcgccagttcatctataaggtaggaagtggtgggccagggggacctctctgcccctccctccccgtgagccctcgcttacaccagggactggctgtcctgcagaacatcatccacagtgcagcaccaatgggcgacgagatggctcatcacctgtacgtactgcaggctctcatgctggggctgctggagccgcgcatgcggacgcccctggacccctacagccaggtgtgtgtctttggtgaggacaaggcagggggtggcttagagcttggccttgaatctataatcttgatcccctcccccgccacccaacactgaccccaggagcagcgggagcagctgcaggtcctacgccaggctgccttcgaggtggagggggagtcctcgggtgccgggctaagtgctgaccgtcgccgttccctctgtgcccgagagttccgcaaactgggcttttctgtgagtatcacccctacccaactccccacccctgcctcagcccagggctgttgttccaggcggccgtggcccttcttgaactgcctgtgcccacttcccccagaacagcaacccagcacaggacctggagcgcgtgccccccggtctgctggccctggacaacatgttgtacttctccagaaacgcgcccagcgcgtacagccgggtcggtgacagggtagggtgggggggtggcagcatcccccaggcagggtccccatgggcttagctgtgactccttgccccattctctgcgcccccagtttgtgttggagaacagcagccgcgaggacaagcacgagtgcccctttgcccggggcagcatccagctgacggtgctgctgtgtgagctgctccgtgttggggagccctgtgagtggcctggactgggcacagcatggccaagagcaggggacggaagggcagagagggccaggggctgtatgcactttctccctgagcccctcctgcccccccactccaggctctgagacagcccaggacttctcacccatgttcttcggccaagaccagagcttccacgagctcttctgtgtgggcatccagctgttgaataagacctggaaggagatgcgggctacacaggaggacttcgacaaggtgggtggggtgggagctgggaggcctgggccagggcagggggctgatctgggtacagagcttaggccctgagctgagcttgggcggccccaggtcatgcaggtggtgcgggagcagctggcccgcactctggccctgaagcccacttccctggagctcttccgaaccaaggtgaatgcgctcacttatggggaggtgctgcggctgcggcagactgaacggctgcaccaggagggcacactggctccccctatactgtgagtctggggggatggatcctcagtcctagccctaccttccttggtgccccctgggctactccccaggtcagatgtgctcagtgacacccctctatcagggagctgcgggagaagctgaagccagagctcatgggcctgatccgccagcagcgcttgctccgcctctgtgaggggacgctcttccgcaagatcagcagccggcggcgccagggtctctgaatgggcatgggcagggggcagagggcaggcagagggcaggcagagggcggctggcttggtgtcaggacctctcagcactctggccctcttccctttctccacgcagataagctgtggttctgctgcctgtcccccaaccacaagctgctgcagtacggagacatggaggagggcgccagcccgcctaccctggagagtctgcccgagcaacgtaaggcgggcaggggcgggggccagatacctgctctccccagaccgccctgggccccggggctgccagggctgcagtgctcagcccagccttcttcctgcagtccctgtggccgacatgagggcactcctgacaggcaaggactgcccccatgtccgggagaagggctccgggaagcagaacaaggtgagtacagcgggccaggggctccttcccacccgcccccgcctaccctgtcccctgctcagtgtccccgctcccttgcttccccaggacctctatgagttggccttctcaatcagctatgaccgtggggaggaggaagcgtacctcaacttcattgccccctccaagcgggaggtgagtgtccgccaggctgaggtcggcaggtgggcaggggaggcagatgggcagaccctcacggctctgtgccacccccagttctacctgtggacagatgggctcagtgccttgctgggcagtcccatgggcagcgagcagacacggctggacctggagcagctgctgaccatggagaccaagctgcgtctgctggagctggagaacgtgcccatccccgagcggccaccccctgtgcccccaccccccaccaacttcaacttctgctatgactgcagcatcgctgaaccttgacagtgtggctggccatgggccacagctgcggccactgcagcagccatgaagggcagtgggtagaggagtgcaggcaccctgaccagcagagattgctgcagaaataaagtctgcttggctcttgggatatgttgagccagctctgta
